(12) United States Patent
Coffin

(10) Patent No.: US 10,696,975 B2
(45) Date of Patent: Jun. 30, 2020

(54) GENES AND USES FOR PLANT ENHANCEMENT

(71) Applicant: Monsanto Technology LLC, St. Louis, MO (US)

(72) Inventor: Marie Coffin, Cary, NC (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 15/732,766

(22) Filed: Dec. 22, 2017

(65) Prior Publication Data

US 2019/0249198 A1 Aug. 15, 2019

Related U.S. Application Data

(63) Continuation of application No. 14/544,230, filed on Dec. 10, 2014, now abandoned, which is a continuation of application No. 12/386,976, filed on Apr. 24, 2009, now abandoned.

(60) Provisional application No. 61/125,908, filed on Apr. 29, 2008.

(51) Int. Cl.
*C12N 15/82* (2006.01)

(52) U.S. Cl.
CPC ..... *C12N 15/8241* (2013.01); *C12N 15/8271* (2013.01)

(58) Field of Classification Search
None
See application file for complete search history.

(56) References Cited

U.S. PATENT DOCUMENTS

| | | |
|---|---|---|
| 7,101,712 B1 | 9/2006 | Kondorosi et al. |
| 7,989,676 B2 | 8/2011 | Troukhan et al. |
| 2003/0233675 A1 | 12/2003 | Cao et al. |
| 2004/0031072 A1 | 2/2004 | La Rosa |
| 2005/0138691 A1* | 6/2005 | Orozco, Jr. ........... C07K 14/415 800/287 |
| 2006/0048240 A1 | 3/2006 | Alexandrov et al. |
| 2006/0107345 A1 | 5/2006 | Alexandrov et al. |
| 2006/0168696 A1 | 7/2006 | Feldmann et al. |
| 2007/0124833 A1* | 5/2007 | Abad ................. C07K 14/415 800/278 |
| 2008/0072340 A1 | 3/2008 | Troukhan et al. |
| 2009/0265815 A1 | 10/2009 | Alexandrov et al. |
| 2013/0333068 A1 | 12/2013 | Coffin |
| 2016/0122783 A1 | 5/2016 | Coffin |

FOREIGN PATENT DOCUMENTS

| | | | |
|---|---|---|---|
| EP | 1033405 A2 * | 9/2000 | ........... C07K 14/415 |
| EP | 1586645 A2 | 10/2005 | |
| WO | WO-9964451 | 12/1999 | |
| WO | WO-9964451 A2 | 12/1999 | |
| WO | WO-1999064451 A2 | 12/1999 | |
| WO | WO-0210210 A2 | 2/2002 | |
| WO | WO-0216655 A2 | 2/2002 | |
| WO | WO-2002016655 A2 | 2/2002 | |
| WO | WO-03070901 A2 | 8/2003 | |
| WO | WO-2003070901 A | 8/2003 | |
| WO | WO-2005019425 A | 3/2005 | |
| WO | WO-2006076423 A | 7/2006 | |
| WO | WO-2006076423 A2 | 7/2006 | |
| WO | WO-2006081029 A2 | 8/2006 | |
| WO | WO-2007138070 | 12/2007 | |
| WO | WO-2007138070 A2 | 12/2007 | |
| WO | WO 2009009142 A2 | 1/2009 | |
| WO | WO-09134339 A2 | 11/2009 | |
| WO | WO-2009134339 A8 | 11/2009 | |
| WO | WO-2009134339 A3 | 3/2010 | |
| WO | WO-2010099083 A1 | 9/2010 | |

OTHER PUBLICATIONS

Petrasek et al 2006 (Science 312: p. 914-919).*
Penaloza-Vasquez 1995 (Plant Cell Reports 14: p. 482-487).*
"U.S. Appl. No. 12/386,976, Examiner Interview Summary dated Aug. 11, 2014", 2 pgs.
"U.S. Appl. No. 12/386,976, Final Office Action dated Aug. 11, 2014", 16 pgs.
"U.S. Appl. No. 12/386,976, Non Final Office Action dated Apr. 2, 2017", 15 pgs.
"U.S. Appl. No. 12/386,976, Response filed Feb. 10, 2014 to Restriction Requirement dated Dec. 17, 2013", 14 pgs.
"U.S. Appl. No. 12/386,976, Response filed Jul. 2, 2014 to Non Final Office Action dated Apr. 2, 2014", 10 pgs.
"U.S. Appl. No. 12/386,976, Restriction Requirement dated Dec. 17, 2013", 11 pgs.
"U.S. Appl. No. 14/544,230, Final Office Action dated Sep. 29, 2017", 11 pgs.

(Continued)

*Primary Examiner* — Matthew R Keogh
(74) *Attorney, Agent, or Firm* — Schwegman Lundberg & Woessner, P.A.

(57) ABSTRACT

Transgenic seed for crops with enhanced agronomic traits are provided by trait-improving recombinant DNA in the nucleus of cells of the seed where plants grown from such transgenic seed exhibit one or more enhanced traits as compared to a control plant. Of particular interest are transgenic plants that have increased yield. The present invention also provides recombinant DNA molecules for expression of a protein, and recombinant DNA molecules for suppression of a protein.

4 Claims, 13 Drawing Sheets
Specification includes a Sequence Listing.

(56) References Cited

OTHER PUBLICATIONS

"U.S. Appl. No. 14/544,230, Non Final Office Action dated Jun. 22, 2017", 17 pgs.
"U.S. Appl. No. 14/544,230, Response filed Mar. 26, 2015 to Non Final Office Action dated Jan. 26, 2015", 5 pgs.
"U.S. Appl. No. 14/544,230, Response filed May 25, 2017 to Restriction Requirement dated Apr. 5, 2017", 12 pgs.
"U.S. Appl. No. 14/544,230, Response filed Sep. 21, 2017 to Non Final Office Action dated Jun. 22, 2017", 7 pgs.
"U.S. Appl. No. 14/544,230, Restriction Requirement dated Apr. 5, 2017", 6 pgs.
"Brazil Application Serial No. PI 0911501-3, Office Action dated Apr. 4, 2018", with English translation, 4 pgs.
"Brazil Application Serial No. PI 0911501-3, Office Action dated Sep. 5, 2018", w/ English translation, 4 pgs.
"Brazil Application Serial No. PI 0911501-3, Response filed Jun. 8, 2018", with machine translation, 18 pgs.
"Brazil Application Serial No. PI 0911501-3, Voluntary Amendment filed Jun. 13, 2012", with machine translation, 11 pgs.
"European Application Serial No. 12166547.5, Partial Search Report dated Nov. 22, 2012", pgs.
"European Application Serial No. 09739142.9, Office Action dated Dec. 7, 2010", 2 pgs.
"European Application Serial No. 12166547.5, European Search Report dated Mar. 11, 2013", 2 pgs.
"European Application Serial No. 12166547.5, Office Action dated May 21, 2012", 1 pg.
"European Application Serial No. 12166547.5, Response filed Jul. 5, 2012 to Office Action dated May 21, 2012", 6 pgs.
"European Application Serial No. 13187670.8, Extended European Search Report dated Jun. 3, 2014", 9 pgs.
"European Application Serial No. 11150290.2, Partial European Search Report dated Jun. 24, 2011", 6 pgs.
"European Application Serial No. 11150290.2,Extended European Search Report dated Oct. 10, 2011", 8 pgs.
"F7H2.18 protein—WD40 domain-containing protein", EBI Database UNIPROT Q9LMQ0, (Oct. 1, 2000), 1 pg.
"Friedberg", Briefings in Bioinformatics 7:3, (2006), 225-242.
"International Application Serial No. PCT/US2009/002547, International Report on Patentability dated Nov. 11, 2010", (dated Nov. 11, 2010), 9 pgs.
"International Application Serial No. PCT/US2009/002547, Written Opinion dated Jan. 21, 2010", 8 pgs.
"Internnational Application Serial No. PCT/US2009/002547, International Search Report and Written Opinion dated Jan. 21, 2010", 7 pgs.
"SubName: Full=Centromere protein 0; SubName: Full=Putative uncharacterized protein At5g10710", DATABASE UniProt [Online], XP002719741, retrieved from EBI accession No. UNIPROT: Q8GUP4, (Mar. 1, 2003), 4 pgs.
Eddy, Sean R, "Profile Hidden Markov models.", Bioinformatics, 14(9), (1998), 755-763.
Hanke, Guy Thomas, et al., "A Post Genomic Characterization of *Arabidopsis* Ferredoxins", Plant Physiology, vol. 134, (Jan. 2004), 255-264.
Hori, Tetsuya, et al., "CENP-O Class Proteins Form a Stable Complex and Are Required for Proper Kinetochore Function", Molecular Biology of the Cell, vol. 19, 843-854, Mar. 2008, (Mar. 2008), 843-854.
U.S. Appl. No. 12/386,976, filed Apr. 24, 2009, Genes and Uses for Plant Enhancement.
U.S. Appl. No. 14/544,230, filed Dec. 10, 2014, Genes and Uses for Plant Enhancement.

\* cited by examiner

FIG. #1
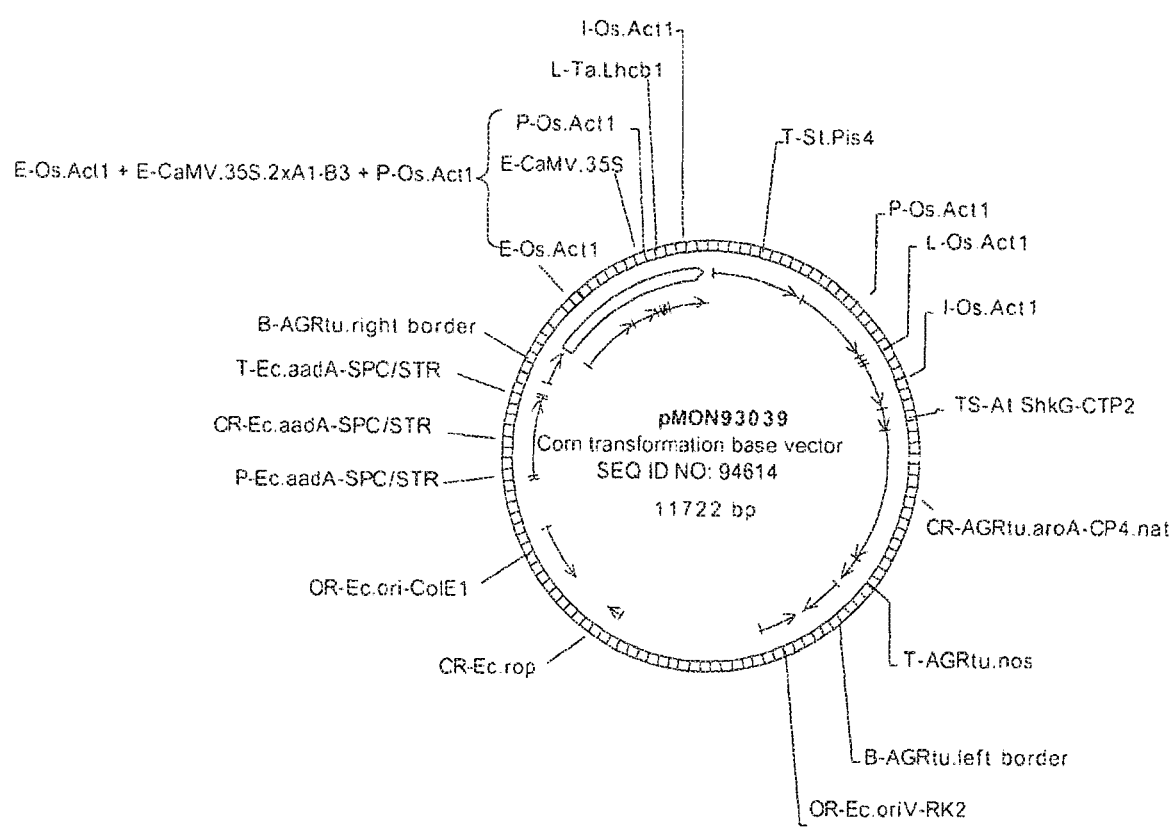

FIG. #2
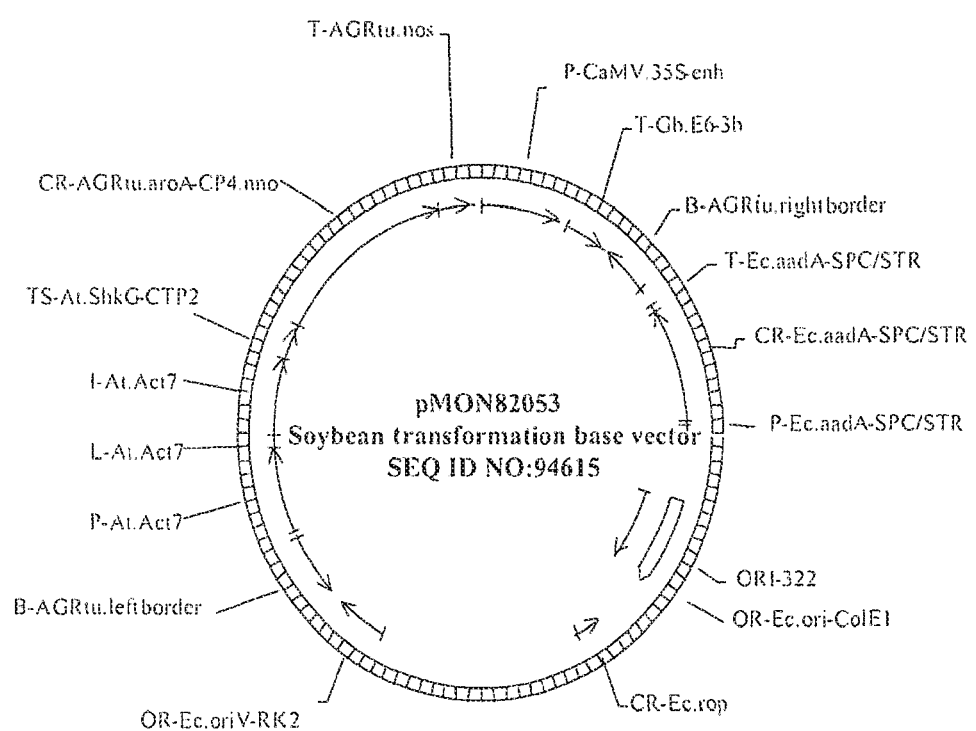

FIG. #3
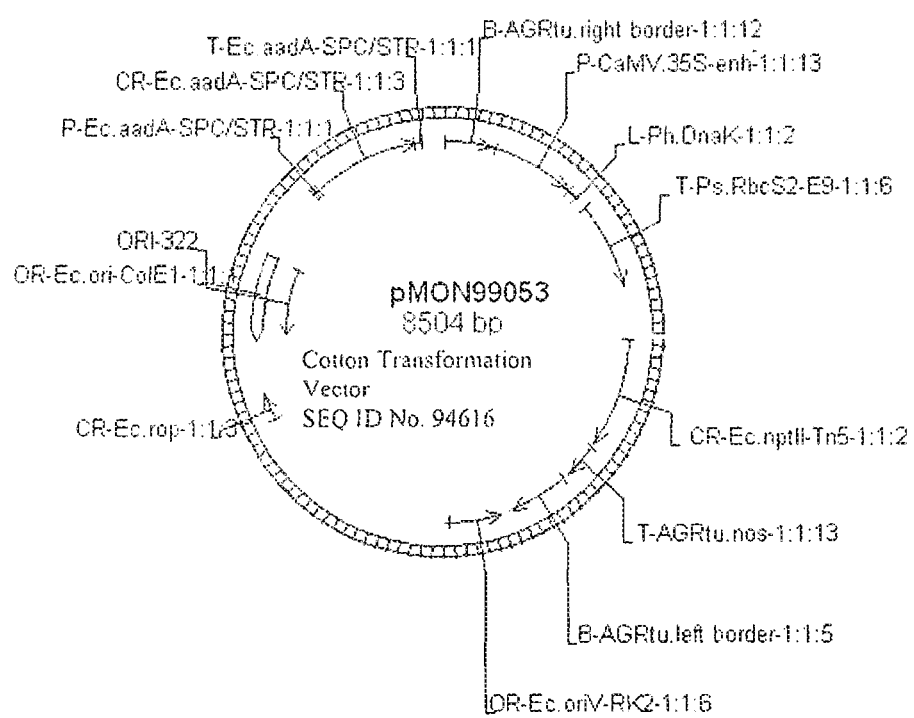

```
SEQ ID No 35795----------------------------------------------------------------MS--
SEQ ID No 59830--------------------------------------------------------------MSKN
SEQ ID No 23175--------------------------------------------------------------MSKN
SEQ ID No 93133--------------------------------------------------------------MSKN
SEQ ID No 19860----------------------------------------------------------------
SEQ ID No 57392----------------------------------------------------------------
SEQ ID No 91490----------------------------------------------------------------
SEQ ID No 20139MLSVKPKKWLNRFNWSTGCARPIEDRLREAKKFLSLPVASSSRSRLNLNRLRSSQDLSRS
SEQ ID No 88784----------------------------------------------------------------
SEQ ID No 17591----------------------------------------------------------------
SEQ ID No 43370----------------------------------------------------------------
SEQ ID No 60203----------------------------------------------------------------
SEQ ID No  1325----------------------------------------------------------------
SEQ ID No 21321----------------------------------------------------------------
SEQ ID No 45211-----------------MAVTTLRKKSASQGMLRTPSCPYPISSAASSSSASMHGSFSSP
SEQ ID No 50671-----------------------------MTQTPTP-------------------------
SEQ ID No 78019-----------------------------MALSPTP-------------------------
SEQ ID No 45047----------------------------------------------------------------
SEQ ID No 69645----------------------------------------------------------------
SEQ ID No 13488----------------------------------------------------------------
SEQ ID No 83296----------------------------------------------------------------
SEQ ID No 58057----------------------------------------------------------------
SEQ ID No 25554----------------------------------------------------------------
SEQ ID No  4744----------------------------------------------------------------
SEQ ID No 80927----------------------------------------------------------------
SEQ ID No 68166----------------------------------------------------------------
SEQ ID No 31956----------------------------------------------------------------
SEQ ID No 29566----------------------------------------------------------------
SEQ ID No 67810----------------------------------------------------------------
SEQ ID No 36150----------------------------------------------------------------
SEQ ID No 94673----------------------------------------------------------------
```

FIG. 4A

```
----------NGA---------GEFELPQEMLAVLPSDPY----------EQLDVARRITAM
ESSYAGV-VGNGG--------GEFELPQEVFSVLPSDPY----------EQLDVARRITAM
GSLYAGS-MGNG---------GEFELPQEVLSVLPSDPY----------EQLDVARRITAM
RGFNAGSSMGNGG--------GEFEISQELLSVLPSDPY----------EQLEVARRITGM
----------MGNG-------GEFELSQEVLAVLPSDPY----------EQLDVARRITAM
----------MGNG-------GEFELSQEVVSVLPSDPY----------EQIDIASRITAM
----------MGSG-------GQGELPQDLVSVLPSDPY----------EQLDVARRITAM
GCRLRPNGMSQNSN-YNSGSGPDFNITDDILAVIPTDPY----------DQLDLARKITSM
--------MSQLT----TG-GTDFSLPDEILAVIPMDPY----------DQLDLARKITSM
---------MSSQG----TGSVVDFDLPDEILSVIPTDPY---------QQLDLARKITSM
---------MAHGG-----GGAPDFDLPDEILSVMPTDPY---------DQLDLARKITSM
---------MGDDQ--------LDFELPEEVLSVIPMDPF---------EQLDLARKITSM
---------MGDDQ--------LDFELPEEVLSVIPMDPF---------EQLDLARKITSM
---------MGDDR--------LDLELSDEVLSVIPMDPF---------EQLDLARKITSM
TGTRNLVAASPPPP---PLFPTSTGTYPAFISATTPDECPAAALVMLPGKLEVARKITAV
--------AAAAPAP---AVAVSEAGLPDAIAAALPPDPY---------EQLEVARKITAV
----TAVAAPPPEPGPEPAPSAELPLPDAIAAALPPDPY----------EQLEVARKITAV
----------MPLAEG--------EFALPDEVLAVMPRDPY--------EQLDLARRITAL
----------MPLAEG--------EFALPDEVLAVMPRDPY--------EQLDLARRITAL
----------MPLAEG--------EFALPDEVLAVMPRDPY--------EQLDLARRITAL
--------MPPAEGAAAGLGVSEFALPDGVLAVLPRDPY----------EQLDLARRITAL
----------MPLGD-----DAAADFALPDELLAALPRDPY--------EQLDLARRITAL
----------MPLGD-----DAAADFALPDELLAALPRDPY--------EQLDLARRITAL
----------MPLGDG----AEAADFVLPDELLAALPRDPY--------EQLDLARRITAL
---------MARHEAA---AGVVDFHLPDEILAVIPTDPY---------EQLDVARKITSM
---------MARHEAA---AGVVDFHLPDEILAVIPTDPY---------EQLDVARKITSM
---------MARQEAVG-AATGVDFHLPDEILAVIPTDPY---------EQLDVARKITSM
---------MSKGANYG-PDNASDFELPEELLGILPTDPY---------EQLELARRITSI
----------MSKAG----------EMQLADGILMNLPEHPD-------QQLEIAQQITRF
-------------------------------------------------------------
----------mxxxxx-----xxxxxfxlpxexlxvxpxdpy-------eqldxarxitxx
```

FIG. 4B

```
AVAARVSKLESETGKLRQKLAEKEHLTYGLQERVVEAENTL-QETSSRLSHALDEQ----
AVAARVSKLESETGKLRQKLTEKERLISGLQERASEAEGTL-QETSARLSHALDEQ----
AVAARVSKLESETGKLRQKLSEKEHVIYGLQDRVVEAENTL-QETSARLSHALDEQ----
AVAARVSKLEGETVKLRQKLTEKEHLIYGLQERIGEAQSTL-QETSARLSVALDVQ----
AISTRMSKLESETGKLRQRLAEKEHVILGLQERVAEAQSTL-QETNSKITQSMDEQ----
AVSTRVSKLETEAGKLRQKMTEKEHVIHGLQERISKATGAL-QEQSAKLSHSEAEQ----
AVATSMSKLESETGKLRQKLTEKEQVIHGLQGRVLEAEAAL-QVLNAKLSQSEAEQ----
AIASRVSKLESEVGRLRQMMYEKDRVAFDLEEKVSQLERAY-QESESRLKMVIDEN----
AIASRVSYLESERGRMKQRMFDKDRIIFELREKLGHLQRVC-QESESKLSLALDEN----
AIASRVSSLESDASRLRQKLLEKDRIILDLEDRLSSLTRAS-HQTDSTLNTALNEN----
AIASRVTKLETEAGTLRQRLREKDELIQELEDKVSQLDGAH-QDAELRLKILREDN----
AIASRVSNLDSEVVELRQKLLGKESVVRELEEKASRLERDC-READSRLKVVLEDNIQDF
AIASRVSNLDSEVVELRQKLLGKESVVRELEEKASRLERDC-READSRLKVVLEDN----
AIASRVSNLDSEVVELRQKLQGKETVVRELVDKASRLEKDR-READSRLKTVLEEN----
AVAARASRLELEAARLRQKLADKDRLAAELADRAASLEQAL-RDSDARLRAALDDN----
AVAARASRLELEAARLRQKLADKDRLAAELADRAASLEQAL-RDSDARLRAALDDN----
AVASRASRLELEAARLRQRLADRDRLAAELADRAAKLEQAL-RDADARLRSALDDN----
AVAGRVTGLEREAARLRESAADKDRENGELRERVALLDRAL-QETNSRLRAALEDN----
AVAGRVTGLEREAARLRESAADKDRENGELRERVALLDRALXQETNSRLRAALEDN----
AVAGRVTGLEREAARLRESAADKDRENGELRERVALLDRAL-QETNSRLRAALEDN----
AVAGRVTGLEREAARLREGAAERDRENAELRDRVALLDRAL-QETNARLRAALEDN----
AVAGRVSGLEREAGRLRAEAAGKDRESAELRERVALLDAAL-QETNARLRAALEDN----
AVAGRVSGLEREAGRLRAEAAGKDRESAELRERVALLDAAL-QETNARLRAALEDN----
AVSGRVSGLEREAGRLRAEAAGKDRENAELRERVVLLDTAL-QETNARLRAALEDN----
AIASRVSRLEADAARLRRDLADRDRAEADLRARLA--------DSDARLLAALDEN----
AIASRVSRLEADAARLRRDLADRDRAEADLRARLA--------DSDARLLAALDEN----
AIASRVSRLEADVARLRRDLADRDRGEADLRARLA--------DSDARLLAALDEN----
AVGSRVSKLEAEASKFKIKITEKDQRIYELEEKINQLEKAL-NETDERLSHSLEEQ----
AVSGRVANLEGELDCLTLKLVEKAAIVEDLQARVSAVESML-GGITAKLAVALQDQ----
MLERRVSTLELELQDMAAKS---------------------KQAVEEA--------
axaxrvsxLexexxxlrxxxxxkxxxxxxlxxrxxxxxxxx-xxxxxrlxxalxxx----
```

FIG. 4C

```
--------TKLANEKNALAAQVKKLMRDVAKLETFKRTLMQSLQEDDDHPYVK--------
--------AKLANEKNALAAQVKKLMRDVAKLETFKRTLMQSLQEDDDNPKAEGGDKRGV
--------NKLANDKNMLAAQVKKLMRDVAKLETFKRTLMNSLQEDDENPNGEG-ERRGV
--------NKLASEKNALVAQVKKLTRDVAKLETFKRTLMNSLQEDDESPNGEG-GKRGV
--------AKLATEKNSLALQVKKLMRDVAKLETFKRTLMQSLQEEDDKHGGEGGNNRGE
--------VKLVNEKNALATQVKNLLRDVAKLETFKRALMKSLEQEDENP----------
--------TKLVDEKNSLALQVKGLLRDVAKLETFKRTLMHSLEQEEDDN---------L
--------TRLSKERDSLAMTAKKMGRDLAK--------------------------QTE
--------VKLSKEKDSLAMTAKKLGRDLAKLETFKRQLMQSLSDDNS-S-------QAE
--------IKLSKERDQLAATVKKLSRDFAKLETFKKQLMQSLTDDNA-S-------HAE
--------MKLLKERDSLALTANKLNRDLAKLEAFKRQLMQSLNEENSKQ-------QTE
LGVTGYLRMNLTKEKDSLAMTVTKLTRDLAKLETFKRQLIKSLSDESGP--------QTE
--------MNLTKEKDSLAMTVTKLTRDLAKLETFKRQLIKSLSDESGP--------QTE
--------MILTKEKDSLAMTVTKLTRDLAKLETFKRQLIKSLSDESAPP-------QTE
--------AKLAKERDSLAHTSKKLARDLAKLETFKRHLMQSLGDDNPPI-------QE
--------AKLAKERDSLAHTSKKLARDLAKLETFKRHLMQSLGDDNPP----------E
--------AKLAKERDSLAQTSKKLARDLAKLETFKRHLMQSLGDDNSQTH------HQE
--------IKLSKERDSLAQTSKKLARDLQKLESFKRHLMQSLRDDSPSP--------QE
--------IKLSKERDSLAQTSKKLARDLQKLESFKRHLMQSLRDDSPSP--------QE
--------IKLSKERDSLAQTSKKLARDLQKLESFKRHLMQSLRDDSPS-----------
--------IQLSKERDSLAQTSKKQARDLHKLESFKRHLMQSLRDDSTSP--------QE
--------IKLSKERDSLAQTSKKLARDLHKLESFKRHLMQSLRDDSSST--------QE
--------IKLSKERDSLAQTSKKLARDLHKLESFKRHLMQSLRDDSSST--------QE
--------IKLSXERDSLAQTSXKLARDLQKLESFXRHLMXSLRDDXXSP--------QE
--------AKLAKERDSLASTAKKMARNLAKLEAFKKQLMKSLSEDNLLQ-------LSE
--------AKLAKERDSLASTAKKMARNLAKLEAFKKQLMKSLSEDNLLQ-------LSE
--------AKLVKERDTLALTAKKLSRNLAKLEAFKKQLMKSLSEDNLLQ-------LSE
--------AKLNHDKSVLAATVKKLNRDVAKLETFKKTLMQSLQEEDEAAQ------ADV
--------AKLAEVKDALADQMKTLMCQVSVLDDFKKAVVRSLGPNSDFD--------D
--------HRLQSEKSLLAETVKRLHKEVARLDAFKKNLLNHLNSEDEPG----------
--------xkLxxexdxLaxtxkklxrdxaklexfkrxlmxslxxxxxxx-------xxx
```

FIG. 4D

```
----------AESTVSRAQ--LLDDDGQSAK-SFSTSSSGTTEERGYREGAALKPPTRYQS
SSNLAIRRASQAESSLSR--ALDDDGQSTK-SFSTSSSVNTEERGFREGGASKPPTSYQT
NSSLAIIRASQAESTVSRSPILDDDHQPGKLSYESDSSVITEERGYRQGAVLKPPTSHQG
NPSLAIKRASQAESTVSRTPVSDDDYQSEKSSYDTDSSLTSEERGYQH--ASRPPTSYQN
PQSLALYKATQAETLSKAQI-FEDDGRYARASFSANPPQYHDDADSKS----ATPTSQSA
PANSAMWKASRGTTR---------------------------------------PKSQSA
APNSAIWKASQAESAVVKAQNFEDHGRYAKTSSRPDPPKYQGDLDAVSDGRTTPPKSRNG
TVDIGTCDQS---IPKAYPD---IDDGTNGYVVNQPLSGFTEYRNSTDEASRLAVQRFSV
TVDIGTCDQS---VPRAYSE---KDEGMNVYVAHHNFNGSTDMGN-TDEAPRHAGQRYSI
TIDIGTCDQS---VPKAYPD---KDDDGSGYMVHHSYNGPADVGKTNDEASRYSGQRFSL
TVDIGTYDQT---VPKAYYT---GDE-PNGYTKHHSYSGSTESASLNDDVSKQTGQKHSI
PVDIRTCDQP-----GSYPG---KDGRINAHSIKQAYSGSTDTNNPVVEASKYTGNKFSM
PVDIRTCDQP-----GSYPG---KDGRINAHSIKQAYSGSTDTNNPVVEASKYTGNKFSM
PVDIKACDQSSIGSTGSYTG---KDERTTVHSTHRSYSGSSDMNNPIVEASKYAGNKFSM
TVDIRTCEQSVA-KASSWKDGVAHSRHHHPVSSLADGSTEIES-VNQEVA-RPFEQKLSV
TVDIRTCEQSVA-KASSWKDGVAHSRHHHPVSSLADGSTEIES-VNQEVA-RPFEQKLSV
TVDIRTYEQSVA-KANSWKDGLEKN--SHPVSSLSDESVEADS-VNQEVTTRPFEQKLTI
TVDITTCDQSISSKASSCGD---GDSITHTTTNLLSTSLDVGSTVQE--VSKPPIQKYAL
TVDITTCDQSISSKASSCGD---GDSITHTTTNLLSTSLDVGSTVQEGTVXKPPIQKYAL
--KMSGTNLSLIFSLN-IAD---GDSITHTTTNLLSTSLDVGSTVQEGTVSKPPIQKYAL
TVDITTCDQSVSSKTSSCGD---G-SISHTAANLLNGSGDLGSTTRE--AARTPVQKYAL
TVDITTCDQPVASKASSSAD---GGSVSNPATNIFTESLDVGSTNRDGAAARPPIQKYSL
TVDITTCDQPVASKASSSAGYRYGGSVSNPATNIFTESLDVGSTNRDGTAARPPIQKYSL
TVDITTCDQSVATKASSSGD---GGSGSHPTTNIFSESLDAGSTNRDGTASRPPIQKYAP
IGDDRDFDAN----NNLTAR------VPSWEDEVSSSRTSADSSSRSTMTESAQEHQFSV
IGDDRDFDAN----NNLTAR------VPSWK----------------------EHQFSV
TGEDRDVDAE----NNGTAR------IPSWKDEVSSSHTSSNTSSRSTITESAQGYQFSI
TQNTATRRVTSAKLSFSLSS-RDDSNVPIGETNQVSSAVSETSNSTLDGDNQASRHGKSK
NFGDATYAYAPEASASTYCS---------SEKSLLQLPLIMSKSTEPPTPTKRKQQGQYSC
------------------------------LEPSVAAADVAGERLVSEVLSSISKPPPPQMGV
xxxxxxxxxxxxxxxxxxx-xxxxxxxxxxxxxxxxxxxxxxxxxxxxxxxxxxx
```

FIG. 4E

```
---------SAHNSARG---TPHLSPKLTP--SGSP-RGSGRTSPRRSMSLTDNSHRISLPS
---------SAHNSAQG--TPHLSPKLTS--SG------SGRASPRRSMSLTDNSHRISLPS
---------SAHNSARG---TPHLSPRLTP--SGSPKRQSARTSPRRSMSSSENSHRISLPS
---------SAQNSARG--TPRLSPRLTP--SVSPKQQSARGSPQRSMSLTENSHRISLPS
RNSPKQIIRGTSSARG--TPSLTPRLTP--TGSPKPQPKKGSPLPSS-YTLDSQHIQIPT
HTSPKQIMRGIDSARGSMTPRLTPLHTS--MTSPQPKPKK-EALPR------ASVTQIPS
RTVPKQIVGGSTTLRP------SSQLIP--IGSRLPKNVD-SPLNS---------MIQLPS
TPYITPR-FTPSGTPKIFSTGGSPRGYS-AVASPNKTSGATSPTKSQYDGRGALSSWYPS
TPYITPR-LTPSGTPKIISTSASPKGYS-AAGSPQKTSGATSPTKPQYDGRASLSSWYPS
TPYITPR-LTPTGTPKVISTAGSPREYS-AAGSPKKTSGATSPTKLPYDGRTSLSSWYSS
TPYISPR-LTPTGTPKVISTSVSPRRYS-AAGSPQKTSGITSPTR--HEGRGSLSSWYPS
TSYISPR-LTPTATPKIISTSVSPRGYS-AAGSPKRTSGAVSPTK--------ATLWYPS
TSYISPR-LTPTATPKIISTSVSPRGYS-AAGSPKRTSGAVSPTK--------ATLWYPS
TPY----------------------------------------------------------
T-HISPR-LTSDPAAKTRTAATSPRRYS-TAVSPKLAASATSP----R-------------
T-HISPR-LTSDPAAKTRTAATSPRRYS-TAVSPKLAASATSP---RLEGHMAMQPWLPS
T-HITPR-LTSDPAPKLRTAATSPRRYS-TAVSPKLASGATSP---RLEGHMAMSPWLPS
SSHITPR-LTPEATPKIMSTSASPRRMS-TTATPKLMSGTTSPSKTRIEGYMSMTPWYPS
SSHITPR-LTPEATPKIMSTSASPRRMS-TTATPKLMSGTTSPSKTRIEGYMSMTPWYPS
SSHITPR-LTPEATPKIMSTSASPRRMS-TTATPKLMSGTTSPSKTRIEGYMSMTPWYPS
SPHINQR-LTPEATPNIMSTSASPRGMS-TTATPKLVSGATSPSRTRIEGHMSMTPWY-S
TTHITPR-LTPEATPKVMSTSASPRRMS-TTGTPKLMSGSTSPSKTRIESHMSMTPWYPS
TTHITPR-LTPEATPKIMSTSASPRRMS-TTGTPKLMSGSTSPSKTRIEAHMSMTPWYPS
SSHITPW-LTPKATPKIMSTSASPRQIS-TTATPKLMSGATSPTKSRMEAHMSMTPWYPS
TPYTAPK-LTPG-------------------STPKFLSGPTSPTKSLSEVHSTFSSWHGS
TPYTAPK-LTPG-------------------STPKFLSGPTSPTKSLSEVHSTFSSWHGS
TPYVAPQ-ITPGSTPIISSSSGSPLAYSTGPSTPKFYSGPTSPTRSRSEDQSAFSSWNGS
GIPLTPHNNTPPELTPKLTPNGSPKRLS-PPQSPRRHSASMSPTRHQFEGRLSSYSSLPA
MMLTSQD---------------SPRDSAKGEESGKAMEDDKWTDNYKSAGAISEKSQWEC
GGAYGLRGMATAAATPAFPSTSGRPLYGASTPQAGQPPAASGPPYAAMTGMGMPAQAPPP
xxxxxxx-xxxxxxxxxxxxxxspxxxx-xxxpxxsxxxspxxxxxxxxxxxxxxps
```

FIG. 4F

```
SKPTSQSTTAPNSPPSHGSDPS---------------------RTPRVDGKDFFR-----Q
SKPTSQSTTAPNSPPSHGSAPS---------------------RTPRVDGKDFFR-----Q
SKPTSQSTTAPNSPPSGSMPS----------------------RTPRVDGKDFFR-----Q
SKATSQSTTAPNSPPSSGSMPS---------------------RTPRVDGKDFFR-----Q
SQPTSRSS----SPPSSGSGQS---------------------RTTRLDGKEFFR-----Q
SLPTSGSS----SPNSGHETLQGFHDNRSAFMNARVSVFIAARTARLDGKEFFR-----Q
SQPTSGAS----SPPSHGSGQS---------------------RSTRLDGKEFFR-----Q
S----QQSSAANSPPRARPLPG-----------------------------------S
S----QQSSAANSPPRGHPIPG---------------------RAPRVDGKEFFR-----Q
S----QQSSAANSPPWGRSLPV---------------------RTPKIDGKEFFR-----Q
S----QQSSAANSPPRARPLPA---------------------RAPGIDGKEFFR-----Q
S----QQSSAANSPPRNRTLPA---------------------RTPRMDGKEFFR-----Q
S----QQSSAANSPPRNRTLPA---------------------RTPRMDGKEFFR-----Q
--------------------------------------------RTTRVDGKEFFR-----Q
S----KMSSAANSPPRAHSISG---------------------RTTRVDGKEFFR-----Q
S----KMSSAANSPPRGQSISG---------------------RGTRVDGKEFFR-----Q
S----KQSSAANSPPRGRPNPG---------------------RTPRIDGKEFFR-----Q
S----KQSSAANSPPRGRPNPG---------------------RTPRIDGKEFFR-----Q
S----KQSSAANSPPRGRPNPG---------------------RTPRIDGKEFFR-----Q
S----KQSSAANSPPRGRPNPG---------------------RTPRIDGKEFFR-----Q
S----KQSSAANSPPRGRSNPG---------------------RTPRIDGKEFFR-----Q
S----KQSSAANSPPRGRSNPG---------------------RTPRIDGKEFFR-----Q
S----KQSSAASSPPRGGSNPG---------------------RTPRVDGKEFFR-----Q
SS---HQYSAPTSPPQHRSFAG---------------------R-PRIDGKEFFR-----Q
SS---HQYSAPTSPPQHRSFAG---------------------R-PRIDGKEFFR-----Q
S----HQYSAPVSP-QRRSFAG---------------------R-PRIDGKEFFR-----Q
S----HQATAPTSPPHSR--AQ---------------------AHVRIDGKEFFR-----Q
P-------LTPRLPSDTGPAKS---------------------RRIDGKEVFRRASQIQ
S------TYATPHPHAQYGAAPG--------------------SPPRVDGKEFFR------
s----xxxxaxxsppxxxxxxx---------------------rxxrxdgkeffr-----q
```

FIG. 4G

```
ARNRLSYEQFSAFLANIKELNAHRQTREETLRKAEETFGPENKDLYAAFDGLLSRHLPS-
ARNRLSYEQFSAFLANIKELNAHRQTREETLRKAEETFGPDNKDLYAAFDGLLSRHLPF-
ARNRLSYEQFSAFLANIKELNAHRQTREETLQKAQETFGPDNKDLYSAFEGLLSRHLPS-
ARNRLSYEQFSAFLANIKELNAHRQTREETLRKAQETFGPDNKDLYSAFEGLLSRHLPS-
ARARLSYEQFSSFLANIKELNAHRQTREETLANAEDIFGPENRDLYAAFEGILSRHLPS-
ARSRLSYEKFSSFLANIKELNAHRQTREETLAKAEDIFGPEHMDLHSAFEEVLSRHLSA-
ARSRLSYEQFSSFLANIKELNAHRQTREDTLGQAERIFGPENRDLSIAFEAILSRHLPS-
EKSRLSYEQFSAFLANIKELNAQKQSREETLRKAEEIFGTDNKDLYLSFQGLLNRNPH--
ARSRLSYEQFSAFLANIKKLNGQEQTREETLRKAEEIFGTDNKDLYFSFRGLLNRNIH--
ARSRLSYEQFSAFLANIKELNAQKQTREETLRKADEIFGSDNKDLYLSFQGLLNRNAR--
ARSRLSLEQFGSFLANVKELNAQRQSREETLRKAEEIFGMDNKDLYISFQGLLNRNIH--
ARSRLSYEQFSSFLANIKELNAQKQTREETLRKADEIFGEENKDLYLSFQGLLNRNMR--
ARSRLSYEQFSSFLANIKELNAQKQTREETLRKADEIFGEENKDLYLSFQGLLNRNMR--
------------------------------------------------------------
ARNRLSYEQFAAFLANIKELNAHRQSREETLQKADEIFGSENKDLFMSFQSLLSRSLSSG
ARNRLSYEQFAAFLANIKELNAHRQSREETLQKADEIFGSENKDLFMSFQSLLSRSLS--
ARHRLSYEQFAAFLSNIKELNAHRQSREETLRKADEIFGAENMDLFRSFQGLLSRSLS--
ARSRLSYEQFGAFLANIKELNAHKQSREDTLKKAEEIFGPDNKDLYLSFQGLLNRSLP--
ARSRLSYEQFGAFLANIKELNAHKQSREDTLKKAEEIFGPDNKDLYLSFQGLLNRSLP--
ARSRLSYEQFGAFLANIKELNAHKQSREDTLKKAEEIFGPDNKDLYLSFQGLLNRSLP--
ARSRLSYEQFGAFLANIKELNAHKQSREETLKKAEEIFGPDSKDLYLSFQGLLNLSLP--
ARSRLSYEQFGAFLANIKELNAHKQSREETLKKAEEIFGPDNKDLYLSFQGLLNRSMVA-
ARSRLSYEQFGAFLANIKELNAHKQSREETLKKAEEIFGPDNKDLYLSFQGLLNRSMVA-
ARSRLSYEQFGAFLANIKELNAHKQSREETLKKAEEIFGPENKDLYLSFRGLLNRSMP--
ARTRLSYEQFGAFLANIKEFNAQKQSREDTLSKAEEIFGTEHKDLYISFQNMLNRNHS--
ARTRLSYEQFGAFLANIKEFNAQKQSREDTLSKAEEIFGTEHKDLYISFQNMLNRNHS--
ARTRLSYEQFGAFLANIKEFNAQKQSREDTLSKAEEIFGTEHKDLYISFQNMLNRNQS--
ARNRLSFEQFSAFLANIKELNSHRQTREETLHKADEIFGSDNKDLYVIFDSLLHRHLS--
SRARWTCEQFSDFLNNIREVNALRRAEEFLVCASSRAAYAYNVVPQCQLYGLNPPNWNCP
-----QARYLSVYKENLH------------------------------------------
arxrlsyeqfxaflanikelnaxxqxrextlxkaxeifgxxnkdlyxxfxxllxrxxxx-
```

FIG. 4H

```
VKVYQMMDLSTTSVVAAKAYKYRAESLVKDYLLADCYVSYTAVLGGILMCKMVYDITHLI
```

```
PANCRVYTR
```

FIG. 4I

SSLYYKGYGSLTKIQKLEWNNRGMSTVHAMFITLMSVYLVFFSNLFSDELDGPVTVRSSN

FIG. 4J

GENES AND USES FOR PLANT ENHANCEMENT

CROSS REFERENCE TO RELATED APPLICATIONS

This application is a continuation of U.S. application Ser. No. 14/544,230 filed Dec. 10, 2014, which application is a continuation of U.S. application Ser. No. 12/386,976, filed Apr. 24, 2009, which applications claims the benefit and priority under 35 U.S.C. § 119(c) of U.S. Provisional Application Ser. No. 61/125,908 filed on Apr. 29, 2008 which are each incorporated herein by reference in their entirety.

INCORPORATION OF SEQUENCE LISTING

Two copies of the sequence listing (Copy 1 and Copy 2) and a computer readable form (CRF) of the sequence listing, all on CD-Rs, each containing the file named 38-21_54976_0001_seqListing.txt, which is 319,330,304 bytes (measured in MS-WINDOWS) and was created on Apr. 15, 2019, are incorporated herein by reference in their entirety.

INCORPORATION OF COMPUTER PROGRAM LISTING

A Computer Program Listing folder named "3126008US2 prgmlisting" containing folders "hmmer-2.3.2" and "495pfamdir" is contained on a CD-R and is incorporated herein by reference in their entirety. Folder hmmer-2.3.2 contains the source code and other associated file for implementing the HMMer software for Pfam analysis. Folder 495pfamdir contains 495 profile Hidden Markov Models. Both folders were created on the disk on Dec. 22, 2017 having a total size of 40,880,128 bytes when measured in MS-WINDOWS® operating system.

INCORPORATION OF TABLES

Two copies of Table 19 (Copy 1 and Copy 2) and a computer readable form (CRF), all on CD-Rs, each containing the file named 38-21_54976_0001_table19.txt, which is 886,784 bytes (measured in MS-WINDOWS), were created on the disk on Dec. 8, 2014, and comprise 417 pages when viewed in MS Word, are herein incorporated by reference.

FIELD OF THE INVENTION

Disclosed herein are recombinant DNA for providing enhanced traits to transgenic plants, seeds, pollen, plant cells and plant nuclei of such transgenic plants, methods of making and using such recombinant DNA, plants, seeds, pollen, plant cells and plant nuclei. Also disclosed are methods of producing hybrid seed comprising such recombinant DNA.

SUMMARY OF THE INVENTION

This invention provides recombinant DNA comprising polynucleotides characterized by SEQ ID NO: 1-803 and the cognate amino acid sequences of SEQ ID NO: 804-1606. The recombinant DNA is used for providing enhanced traits when stably integrated into the chromosomes and expressed in the nuclei of transgenic plants cells. In some aspects the recombinant DNA encodes a protein; in other aspects the recombinant DNA is transcribed to RNA that suppresses the expression of a native gene.

Such recombinant DNA in a plant cell nucleus of this invention is provided in as a construct comprising a promoter that is functional in plant cells and that is operably linked to DNA that encodes a protein or to DNA that results in gene suppression. Such DNA in the construct is sometimes defined by protein domains of an encoded protein targeted for production or suppression e.g. a "Pfam domain module" (as defined herein below) from the group of Pfam domain modules identified in Table 20. Alternatively, e.g. where a Pfam domain module is not available, such DNA in the construct is defined a consensus amino acid sequence of an encoded protein that is targeted for production e.g. a protein having amino acid sequence with at least 90% identity to a consensus amino acid sequence in the group of SEQ ID NO: 94617 through SEQ ID NO: 94734. In a particular aspect of the invention the recombinant DNA is characterized by its cognate amino acid sequence that has at least 70% identity to any of SEQ ID NO: 804-1606.

This invention also provides transgenic plant cell nuclei comprising the recombinant DNA of the invention, transgenic plant cells comprising such nuclei, transgenic plants comprising a plurality of such transgenic plant cells, and transgenic seeds and transgenic pollen of such plants. Such transgenic plants are selected from a population of transgenic plants regenerated from plant cells transformed with recombinant DNA by screening transgenic plants for an enhanced trait as compared to control plants. The enhanced trait is one or more of enhanced water use efficiency, enhanced cold tolerance, increased yield, enhanced nitrogen use efficiency, enhanced heat tolerance, enhanced shade tolerance, enhanced high salinity tolerance, enhanced seed protein and enhanced seed oil. Such recombinant DNA in a plant cell nucleus of this invention is provided in as a construct comprising a promoter that is functional in plant cells and that is operably linked to DNA that encodes a protein or to DNA that results in gene suppression. Such DNA in the construct is sometimes defined by protein domains of an encoded protein targeted for production or suppression, e.g. a "Pfam domain module" (as defined herein below) from the group of Pfam domain nodules identified in Table 20. Alternatively, e.g. where a Pfam domain module is not available, such DNA in the construct is defined a consensus amino acid sequence of an encoded protein that is targeted for production e.g. a protein having amino acid sequence with at least 90% identity to a consensus amino acid sequence in the group of SEQ ID NO: 94617 through SEQ ID NO: 94734.

In another aspect of the invention the plant cell nuclei, cells, plants, seeds, and pollen further comprise DNA expressing a protein that provides tolerance from exposure to an herbicide applied at levels that are lethal to a wild type plant cell.

This invention also provides methods for manufacturing non-natural, transgenic seed that can be used to produce a crop of transgenic plants with an enhanced trait resulting from expression of stably-integrated, recombinant DNA in the nucleus of the plant cells. More specifically the method comprises (a) screening a population of plants for an enhanced trait and recombinant DNA, where individual plants in the population can exhibit the trait at a level less than, essentially the same as or greater than the level that the trait is exhibited in control plants which do not express the recombinant DNA; (b) selecting from the population one or more plants that exhibit the trait at a level greater than the level that said trait is exhibited in control plants and (c) collecting seed from a selected plant. Such method further comprises steps (a) verifying that the recombinant DNA is stably integrated in said selected plants; and (b) analyzing tissue of a selected plant to determine the production of a protein having the function of a protein encoded by a recombinant DNA with a sequence of one of SEQ ID NO: 1-803; in one aspect of the invention the plants in the population further comprise DNA expressing a protein that provides tolerance to exposure to an herbicide applied at levels that are lethal to wild type plant cells and where the selecting is effected by treating the population with the herbicide, e.g. a glyphosate, dicamba, or glufosinate compound. In another aspect of the invention the plants are selected by identifying plants with the enhanced trait. The methods are used for manufacturing corn, soybean, cotton, canola, alfalfa, wheat, rice seed or any combinations thereof selected as having one of the enhanced traits described above.

Another aspect of the invention provides a method of producing hybrid corn seed comprising acquiring hybrid corn seed from a herbicide tolerant corn plant which also has a nucleus of this invention with stably-integrated, recombinant DNA. The method further comprises producing corn plants from said hybrid corn seed, where a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Still other aspects of this invention relate to transgenic plants with enhanced water use efficiency or enhanced nitrogen use efficiency. For instance, this invention provides methods of growing a corn, cotton, soybean, or canola crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton, soybean or canola crop without added nitrogen fertilizer comprising planting seed having plant cells of the invention which are selected for enhanced nitrogen use efficiency.

BRIEF DESCRIPTION OF THE DRAWINGS

FIGS. 1, 2 and 3 illustrate plasmid maps.
FIGS. 4A-4J illustrate a consensus amino acid sequence of SEQ ID NO: 1325 and its homologs.

DETAILED DESCRIPTION OF THE INVENTION

In the attached sequence listing:
SEQ ID NO: 1-803 are nucleotide sequences of the coding strand of DNA for "genes" used in the recombinant DNA imparting an enhanced trait in plant cells, where each represents a coding sequence for a protein;

SEQ ID NO: 804-1606 are amino acid sequences of the cognate protein of the "genes" with nucleotide coding sequence 1-803;

SEQ ID NO: 1607-94613 are amino acid sequences of homologous proteins; SEQ ID NO: 94614 is a nucleotide sequence of a plasmid base vector for corn transformation; and SEQ ID NO: 94615 is a DNA sequence of a plasmid base vector for soybean transformation.

SEQ ID NO: 94616 is a DNA sequence of a plasmid base vector for cotton transformation.

SEQ ID NO: 94617-94734 are consensus sequences.

Table 1 lists the protein SEQ ID NOs and their corresponding consensus SEQ ID NOs.

TABLE 1

| NUC SEQ ID NO | PEP SEQ ID NO | GENE ID | CONSENSUS SEQ ID NO |
|---|---|---|---|
| 5 | 808 | CGPG1067 | 94617 |
| 6 | 809 | CGPG1095 | 94618 |
| 7 | 810 | CGPG1101 | 94619 |
| 8 | 811 | CGPG1109 | 94620 |
| 10 | 813 | CGPG1155 | 94621 |
| 12 | 815 | CGPG1171 | 94622 |
| 13 | 816 | CGPG1177 | 94623 |
| 19 | 822 | CGPG1279 | 94624 |
| 20 | 823 | CGPG1304 | 94625 |
| 22 | 825 | CGPG1327 | 94626 |
| 57 | 860 | CGPG1723 | 94627 |
| 78 | 881 | CGPG1972 | 94628 |
| 88 | 891 | CGPG2041 | 94629 |
| 90 | 893 | CGPG2070 | 94630 |
| 98 | 901 | CGPG2126 | 94631 |
| 99 | 902 | CGPG213 | 94632 |
| 106 | 909 | CGPG2193 | 94633 |
| 108 | 911 | CGPG2224 | 94634 |
| 118 | 921 | CGPG2319 | 94635 |
| 121 | 924 | CGPG2359 | 94636 |
| 130 | 933 | CGPG2408 | 94637 |
| 133 | 936 | CGPG2414 | 94638 |
| 156 | 959 | CGPG2863 | 94639 |
| 172 | 975 | CGPG3183 | 94640 |
| 180 | 983 | CGPG3280 | 94641 |
| 191 | 994 | CGPG3405 | 94642 |
| 200 | 1003 | CGPG3598 | 94643 |
| 202 | 1005 | CGPG3606 | 94644 |
| 203 | 1006 | CGPG3610 | 94645 |
| 204 | 1007 | CGPG3620 | 94646 |
| 222 | 1025 | CGPG3820 | 94647 |
| 226 | 1029 | CGPG3958 | 94648 |
| 227 | 1030 | CGPG3981 | 94649 |
| 236 | 1039 | CGPG4083 | 94650 |
| 256 | 1059 | CGPG4347 | 94651 |
| 257 | 1060 | CGPG4354 | 94652 |
| 273 | 1076 | CGPG4559 | 94653 |
| 294 | 1097 | CGPG4802 | 94654 |
| 295 | 1098 | CGPG4822 | 94655 |
| 296 | 1099 | CGPG4826 | 94656 |
| 297 | 1100 | CGPG4833 | 94657 |
| 298 | 1101 | CGPG4841 | 94658 |
| 332 | 1135 | CGPG5208 | 94659 |
| 393 | 1196 | CGPG5750 | 94660 |
| 394 | 1197 | CGPG5751 | 94661 |
| 413 | 1216 | CGPG5922 | 94662 |
| 415 | 1218 | CGPG5964 | 94663 |
| 432 | 1235 | CGPG6137 | 94664 |
| 456 | 1259 | CGPG6358 | 94665 |
| 501 | 1304 | CGPG6803 | 94666 |
| 504 | 1307 | CGPG6812 | 94667 |
| 506 | 1309 | CGPG6827 | 94668 |
| 509 | 1312 | CGPG6859 | 94669 |
| 514 | 1317 | CGPG6886 | 94670 |
| 518 | 1321 | CGPG6903 | 94671 |
| 520 | 1323 | CGPG6933 | 94672 |
| 522 | 1325 | CGPG6944 | 94673 |
| 523 | 1326 | CGPG6949 | 94674 |

TABLE 1-continued

| NUC SEQ ID NO | PEP SEQ ID NO | GENE ID | CONSENSUS SEQ ID NO |
|---|---|---|---|
| 525 | 1328 | CGPG6989 | 94675 |
| 527 | 1330 | CGPG7003 | 94676 |
| 528 | 1331 | CGPG7009 | 94677 |
| 531 | 1334 | CGPG7062 | 94678 |
| 532 | 1335 | CGPG7064 | 94679 |
| 534 | 1337 | CGPG7109 | 94680 |
| 535 | 1338 | CGPG7123 | 94681 |
| 538 | 1341 | CGPG7159 | 94682 |
| 541 | 1344 | CGPG7224 | 94683 |
| 569 | 1372 | CGPG7505 | 94684 |
| 576 | 1379 | CGPG7540 | 94685 |
| 582 | 1385 | CGPG7568 | 94686 |
| 583 | 1386 | CGPG7571 | 94687 |
| 584 | 1387 | CGPG7587 | 94688 |
| 585 | 1388 | CGPG7591 | 94689 |
| 588 | 1391 | CGPG7633 | 94690 |
| 601 | 1404 | CGPG7774 | 94691 |
| 602 | 1405 | CGPG7777 | 94692 |
| 606 | 1409 | CGPG7792 | 94693 |
| 613 | 1416 | CGPG7851 | 94694 |
| 616 | 1419 | CGPG7865 | 94695 |
| 622 | 1425 | CGPG7934 | 94696 |
| 623 | 1426 | CGPG7949 | 94697 |
| 624 | 1427 | CGPG7954 | 94698 |
| 627 | 1430 | CGPG7969 | 94699 |
| 641 | 1444 | CGPG8072 | 94700 |
| 642 | 1445 | CGPG8075 | 94701 |
| 644 | 1447 | CGPG8100 | 94702 |
| 645 | 1448 | CGPG8101 | 94703 |
| 646 | 1449 | CGPG8104 | 94704 |
| 647 | 1450 | CGPG8108 | 94705 |
| 648 | 1451 | CGPG8116 | 94706 |
| 651 | 1454 | CGPG8138 | 94707 |
| 654 | 1457 | CGPG8163 | 94708 |
| 659 | 1462 | CGPG8204 | 94709 |
| 662 | 1465 | CGPG8234 | 94710 |
| 671 | 1474 | CGPG8345 | 94711 |
| 686 | 1489 | CGPG8515 | 94712 |
| 688 | 1491 | CGPG8518 | 94713 |
| 690 | 1493 | CGPG8523 | 94714 |
| 691 | 1494 | CGPG8528 | 94715 |
| 693 | 1496 | CGPG8553 | 94716 |
| 694 | 1497 | CGPG8562 | 94717 |
| 697 | 1500 | CGPG8589 | 94718 |
| 699 | 1502 | CGPG8592 | 94719 |
| 703 | 1506 | CGPG8648 | 94720 |
| 706 | 1509 | CGPG8678 | 94721 |
| 707 | 1510 | CGPG8694 | 94722 |
| 709 | 1512 | CGPG8737 | 94723 |
| 710 | 1513 | CGPG8745 | 94724 |
| 712 | 1515 | CGPG8749 | 94725 |
| 715 | 1518 | CGPG8781 | 94726 |
| 760 | 1563 | CGPG9075 | 94727 |
| 762 | 1565 | CGPG9094 | 94728 |
| 769 | 1572 | CGPG9136 | 94729 |
| 770 | 1573 | CGPG9156 | 94730 |
| 773 | 1576 | CGPG9173 | 94731 |
| 781 | 1584 | CGPG921 | 94732 |
| 788 | 1591 | CGPG9281 | 94733 |
| 792 | 1595 | CGPG9304 | 94734 |

The nuclei of this invention are identified by screening transgenic plants for one or more traits including enhanced drought stress tolerance, enhanced heat stress tolerance, enhanced cold stress tolerance, enhanced high salinity stress tolerance, enhanced low nitrogen availability stress tolerance, enhanced shade stress tolerance, enhanced plant growth and development at the stages of seed imbibition through early vegetative phase, and enhanced plant growth and development at the stages of leaf development, flower production and seed maturity.

"As used herein a "plant cell" means a plant cell that is transformed with stably-integrated, non-natural, recombinant DNA, e.g. by Agrobacterium-mediated transformation or by bombardment using microparticles coated with recombinant DNA or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

As used herein "recombinant DNA" means DNA which has been a genetically engineered and constructed outside of a cell including DNA containing naturally occurring DNA or cDNA or synthetic DNA.

As used herein a "homolog" means a protein in a group of proteins that perform the same biological function, e.g. proteins that belong to the same Pfam protein family and that provide a common enhanced trait in transgenic plants of this invention. Homologs are expressed by homologous genes. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. Hence, a polynucleotide in the present invention can have any base sequence that has been changed from SEQ ID NO:1 through SEQ ID NO: 303 through substitution in accordance with degeneracy of the genetic code. Homologs are proteins that, when optimally aligned, have at least about 60% identity, about 70% or higher, at least about 80% and at least about 90% identity over the full length of a protein identified as being associated with imparting an enhanced trait when expressed in plant cells. Homologs include proteins with an amino acid sequence that has at least about 90% identity to a consensus amino acid sequence of proteins and homologs disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. As a protein hit with the best E-value for a particular organism could be an ortholog or the only ortholog, a reciprocal query is used in the present invention to filter hit sequences with significant E-values for ortholog identification. The reciprocal query entails search of the significant hits against a database of amino acid sequences from the base organism that are similar to the sequence of the query protein. A hit can be identified as an ortholog, when the reciprocal query's best hit is the query protein itself or a protein encoded by a duplicated gene after speculation. A further aspect of the homologs encoded by DNA in the transgenic plants of the invention are those proteins that differ from a disclosed protein as the result of deletion or insertion of one or more amino acids in a native sequence.

Homologous genes are genes which encode proteins with the same or similar biological function to the protein encoded by the second gene. Homologous genes can be generated by the event of speciation (see ortholog) or by the event of genetic duplication (sec paralog). "Onhologs" refer to a set of homologous genes in different species that evolved from a common ancestral gene by specification. Normally, orthologs retain the same function in the course of evolution; and "paralogs" refer to a set of homologous genes in the same species that have diverged from each other as a consequence of genetic duplication. Thus, homologous genes can be from the same or a different organism. As used herein, "homolog" means a protein that performs the same biological function as a second protein including those identified by sequence identity search.

As used herein, "percent identity" means the extent to which two optimally aligned DNA or protein segments are invariant throughout a window of alignment of components, for example nucleotide sequence or amino acid sequence. An "identity fraction" for aligned segments of a test sequence and a reference sequence is the number of identical components that are shared by sequences of the two aligned segments divided by the total number of sequence components in the reference segment over a window of alignment which is the smaller of the full test sequence or the full reference sequence. "Percent identity" ("% identity") is the identity fraction times 100. Such optimal alignment is understood to be deemed as local alignment of DNA sequences. For protein alignment, a local alignment of protein sequences should allow introduction of gaps to achieve optimal alignment. Percent identity is calculated over the aligned length not including the gaps introduced by the alignment per se.

As used herein, "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that can effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein, "operably linked" refers to the association of two or more nucleic acid elements in a recombinant DNA construct, e.g. as when a promoter is operably linked with DNA that is transcribed to RNA whether for expressing or suppressing a protein. Recombinant DNA constructs can be designed to express a protein which can be an endogenous protein, an exogenous homologue of an endogenous protein or an exogenous protein with no native homologue. Alternatively, recombinant DNA constructs can be designed to suppress the level of an endogenous protein, e.g. by suppression of the native gene. Such gene suppression can be effectively employed through a native RNA interference (RNAi) mechanism in which recombinant DNA comprises both sense and anti-sense oriented DNA matched to the gene targeted for suppression where the recombinant DNA is transcribed into RNA that can form a double-strand to initiate an RNAi mechanism. Gene suppression can also be effected by recombinant DNA that comprises anti-sense oriented DNA matched to the gene targeted for suppression. Gene suppression can also be effected by recombinant DNA that comprises DNA that is transcribed to a microRNA matched to the gene targeted for suppression. In the examples illustrating the invention recombinant DNA for effecting gene suppression that imparts is identified by the term "antisense". It will be understood by a person of ordinary skill in the art that any of the ways of effecting gene suppression are contemplated and enabled by a showing of one approach to gene suppression.

As used herein "expressed" means produced, e.g. a protein is expressed in a plant cell when its cognate DNA is transcribed to mRNA that is translated to the protein.

As used herein "suppressed" means decreased, e.g. a protein is suppressed in a plant cell when there is a decrease in the amount and/or activity of the protein in the plant cell. The presence or activity of the protein can be decreased by any amount up to and including a total loss of protein expression and/or activity.

As used herein a "control plant" means a plant that does not contain the recombinant DNA that expressed a protein that imparts an enhanced trait. A control plant is to identify and select a transgenic plant that has an enhance trait. A suitable control plant can be a non-transgenic plant of the parental line used to generate a transgenic plant, e.g. devoid of recombinant DNA. A suitable control plant can in some cases be a progeny of a hemizygous transgenic plant line that is does not contain the recombinant DNA, known as a negative sergeant.

"Trait enhancement" means a detectable and desirable difference in a characteristic in a transgenic plant relative to a control plant or a reference. In some cases, the trait enhancement can be measured quantitatively. For example, the trait enhancement can entail at least about 2% deterrence in an observed trait, at least about 5% desirable difference, at least about 10% difference, at least about 20% difference, at least about 30% difference, at least about 40%, at least about 50% difference, at least about 60%, at least about 70% difference, at least about 80% difference, at least about 90% difference, or at least about a 100% difference, or an even greater difference. In other cases, the trait enhancement is only measured qualitatively. It is known that there can be a natural variation in a trait. Therefore, the trait enhancement observed entails a change of the normal distribution of the trait in the transgenic plant compared with the trait distribution observed in a control plant or a reference, which is evaluated by statistical methods provided herein. Trait enhancement includes, but is not limited to, yield increase, including increased yield under non-stress conditions and increased yield under environmental stress conditions. Stress conditions can include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability, high plant density, or any combinations thereof.

"Yield" can be affected by many properties including without limitation, plant height, pod number, pod position on the plant, number of intermodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (e.g. seeds, or weight of seeds, per acre), bushels per acre, tonnes per acre, tons per acre, kilo per hectare. For example, maize yield can be measured as production of shelled corn kernels per unit of production area, for example in bushels per acre or metric tons per hectare, often reported on a moisture adjusted basis, for example at 15.5 percent moisture. Increased yield can result from improved utilization of key biochemical compounds, such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that could correspond to an increase in overall plant yield. Such properties include enhancements in seed oil, seed molecules such as tocopherol, protein and starch, or oil particular oil components as can be manifest by alterations in the ratios of seed components.

"Stress condition" means a condition unfavorable for a plant, which adversely affect plant metabolism, growth and/or development. A plant under the stress condition typically shows reduced germination rate, retarded growth and development, reduced photosynthesis rate, and eventually leading to reduction in yield. Specifically, "water deficit stress" used herein refers to the sub-optimal conditions for water and humidity needed for normal growth of natural plants. Relative water content (RWC) can be used as a physiological measure of plant water deficit. It measures the effect of osmotic adjustment in plant water status, when a plant is under stressed conditions. Conditions which can result in water deficit stress include, but are not limited to, heat, drought, high salinity and PEG induced osmotic stress.

"Cold stress" means the exposure of a plant to a temperatures below (two or more degrees Celsius below) those normal for a particular species or particular strain of plant.

"Nitrogen nutrient" means any one or any mix of the nitrate salts commonly used as plant nitrogen fertilizer, including, but not limited to, potassium nitrate, calcium nitrate, sodium nitrate, ammonium nitrate. The term ammonium as used herein means any one or any mix of the ammonium salts commonly used as plant nitrogen fertilizer, e.g., ammonium nitrate, ammonium chloride, ammonium sulfate, etc.

"Low nitrogen availability stress" means a plant growth condition that does not contain sufficient nitrogen nutrient to maintain a healthy plant growth and/or for a plant to reach its typical yield under a sufficient nitrogen growth condition. For example, a limiting nitrogen condition can refers to a growth condition with 50% or less of the conventional nitrogen inputs. "Sufficient nitrogen growth condition" means a growth condition where the soil or growth medium contains or receives optimal amounts of nitrogen nutrient to sustain a healthy plant growth and/or for a plant to reach its typical yield for a particular plant species or a particular strain. One skilled in the art would recognize what constitute such soil, media and fertilizer inputs for most plant species.

"Shade stress" means a growth condition that has limited light availability that triggers the shade avoidance response in plant. Plants are subject to shade stress when localized at lower part of the canopy, or in close proximity of neighboring vegetation. Shade stress can become exacerbated when the planting density exceeds the average prevailing density for a particular plant species.

In some embodiments of the invention a constitutively active mutant, is constructed to achieve the desired effect. In other embodiments of the invention, a dominant negative gene is constructed to adversely affect the normal, wild-type gene product within the same cell.

DNA constructs are assembled using methods well known to persons of ordinary skill in the art and typically comprise a promoter operably linked to DNA, the expression of which provides the enhanced agronomic trait. Other construct components can include additional regulatory elements, such as 5' leaders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens* and the CaMV35S promoters from the cauliflower mosaic virus as disclosed in U.S. Pat. Nos. 5,164,316 and 5,322,938. Promoters derived from plant genes are found in U.S. Pat. No. 5,641,876, which discloses a rice actin promoter, U.S. Pat. No. 7,151,204, which discloses a maize chloroplast aldolase promoter and a maize aldolase (FDA) promoter, and U.S. Patent Application Publication 2003/0131377 A1, which discloses a maize nicotianamine synthase promoter, all of which are incorporated herein by reference. These and numerous other promoters that function in plant cells are known to those skilled in the art and available for use in recombinant polynucleotides of the present invention to provide for expression of desired genes in transgenic plant cells.

In other aspects of the invention, preferential expression in plant green tissues is desired. Promoters of interest for such uses include those from genes such as *Arabidopsis thaliana* ribulose-1,5-bisphosphate carboxylase (Rubisco) small subunit (Fischhoff et al. (1992) *Plant Mol Biol.* 20:81-93), aldolase and pyruvate orthophosphate dikinase (PPDK) (Taniguchi et al. (2000) *Plant Cell Physiol.* 41(1): 42-48).

Furthermore, the promoters can be altered to contain multiple "enhancer sequences" to assist in elevating gene expression. Such enhancers are known in the art. By including an enhancer sequence with such constructs, the expression of the selected protein can be enhanced. These enhancers often are found 5' to the start of transcription in a promoter that functions in eukaryotic cells, but can often be inserted upstream (5') or downstream (3') to the coding sequence. In some instances, these 5' enhancing elements are introns. In one embodiment, enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

In other aspects of the invention, sufficient expression in plant seed tissues is desired to affect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell e al. (1997) *Transgenic Res.* 6(2):157-166), globulin 1 (Belanger et al (1991) *Genetics* 129:863-872), glutelin 1 (Russell (1997) supra), and peroxiredoxin antioxidant (Per1) (Stacy et al. (1996) *Plant Mol Biol.* 31(6):1205-1216).

Recombinant DNA constructs prepared in accordance with the invention will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627, incorporated herein by reference; 3' elements from plant genes such as wheat (*Triticum asevitum*) heat shock protein 17 (Hsp17 3'), a wheat ubiquitin gene, a wheat fructose-1, 6-biphosphatase gene, a rice glutelin gene, a rice lactate dehydrogenase gene and a rice beta-tubulin gene, all of which are disclosed in U.S. published patent application 2002/0192813 A1, incorporated herein by reference; and the pea (*Pisum sativum*) ribulose biphosphate carboxylase gene (rbs 3), and 3' elements from the genes within the host plant.

Constructs and vectors can also include a transit peptide for targeting of a gene to a plant organelle, particularly to a chloroplast, leucoplast or other plastid organelle. For descriptions of the use of chloroplast transit peptides see U.S. Pat. Nos. 5,188,642 and 5,728,925, incorporated herein by reference. For description of the transit peptide region of an *Arabidopsis* EPSPS gene can be in the present invention, see Klee, H. J. et al (*MGG* (1987) 210:437-442).

Gene suppression includes any of the well-known methods for suppressing transcription of a gene or the accumulation of the mRNA corresponding to that gene thereby preventing translation of the transcript into protein. Post-transcriptional gene suppression is mediated by transcription of RNA that forms double-stranded RNA (dsRNA) having homology to a gene targeted for suppression. Suppression can also be achieved by insertion mutations created by transposable elements can also prevent gene function. For example, in many dicot plants, transformation with the T-DNA of *Agrobacterium* can be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants can be screened with polynucleotides encoding the polypeptide of interest to detect mutated plants having an insertion in the gene encoding the polypeptide of interest.

Transgenic plants comprising or derived from plant cells of this invention transformed with recombinant DNA can be further enhanced with stacked traits, e.g. a crop plant having an enhanced trait resulting from expression of DNA disclosed herein in combination with herbicide and/or pest resistance traits. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norfurazon herbicides. Polynucleotide molecules encoding proteins involved in herbicide tolerance are well-known in the art and include, but are not limited to, a polynucleotide molecule encoding 5-enolpyruvylshikimote-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Patent Application publication 2003/0083480 A1 also for imparting glyphosate tolerance; dicamba monooxygenase disclosed in U.S. Patent Application publication 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytogene desaturase (crI) described in Misawa et al, (1993) *Plant J.* 4:833-840 and in Misawa et al, (1994) *Plant J.* 6:481-489 for norflurozon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and hialaphos tolerance; polynucleotide molecules disclosed in U.S. Patent Application Publication 2003/010609 A1 for imparting N-amino methyl phosphonic acid tolerance; polynucleotide molecules disclosed in U.S. Pat. No. 6,107,549 for imparting pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication 2002/0112260, all of said U.S. Patents and Patent Application Publications are incorporated herein by reference. Molecules and methods for imparting insect/nematode/virus resistance are disclosed in U.S. Pat. Nos. 5,250,515; 5,880,275; 6,506,599; 5,986,175 and U.S. Patent Application Publication 2003/0150017 A1, all of which are incorporated herein by reference.

A "consensus amino acid sequence" means an artificial, amino acid sequence indicating conserved amino acids in the sequence of homologous proteins as determined by statistical analysis of an optimal alignment, e.g. CLUSTALW, of amino acid sequence of homolog proteins. The consensus sequences listed in the sequence listing were created by identifying the most frequent amino acid at each position in a set of aligned protein sequences. When there was 100% identity in an alignment the amino acid is indicated by a capital letter. When the occurrence of an amino acid is at least about 70% in an alignment, the amino acid is indicated by a lower case letter. When there is no amino acid occurrence of at least about 70%, e.g. due to diversity or gaps, the amino acid is indicated by an "x". When used to defined embodiments of the invention, a consensus amino acid sequence will be aligned with a query protein amino acid sequence in an optimal alignment; e.g. CLUSTALW. An embodiment of the invention will have identity to the conserved amino acids indicated in the consensus amino acid sequence.

"*Arabidopsis*" means plants of *Arabidopsis thaliana*.

"Pfam" database is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", Bioinformatics 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments can be used for automatically recognizing that a new protein belongs to an existing protein family even if the homology by alignment appears to be low.

A "Pfam domain module" is a representation of Pfam domains in a protein, in order from N terminus to C terminus. In a Pfam domain module individual Pfam domains are separated by double colons "::". The order and copy number of the Pfam domains from N to C terminus are attributes of a Pfam domain module. Although the copy number of repetitive domains is important, varying copy number often enables a similar function. Thus, a Pfam domain module with multiple copies of a domain should define an equivalent Pfam domain module with variance in the number of multiple copies. A Pfam domain module is not specific for distance between adjacent domains, but contemplates natural distances and variations in distance that provide equivalent function. The Pfam database contains both narrowly- and broadly-defined domains, leading to identification of overlapping domains on some proteins. A Pfam domain module is characterized by non-overlapping domains. Where there is overlap, the domain having a function that is more closely associated with the function of the protein (based on the E value of the Pfam match) is selected.

Once one DNA is identified as encoding a protein which imparts an enhanced trait when expressed in transgenic plants, other DNA encoding proteins with the same Pfam domain module are identified by querying the amino acid sequence of protein encoded by candidate DNA against the Hidden Markov Models which characterizes the Pfam domains using HMMER software, a current version of which is provided in the appended computer listing. Candidate proteins meeting the same Pfam domain module are in the protein family and have cognate DNA that is used in constructing recombinant DNA for the use in the plant cells of this invention. Hidden Markov Model databases for use with HMMER software in identifying DNA expressing protein with a common Pfam domain module for recombinant DNA in the plant cells of this invention are also included in the appended computer listing.

Version 19.0 of the HMMER software and Pfam databases were used to identify known domains in the proteins corresponding to amino acid sequence of SEQ ID NO: 804 through SEQ ID NO:1606. All DNA encoding proteins that have scores higher than the gathering cutoff disclosed in Table 19 by Pfam analysis disclosed herein can be used in, recombinant DNA of the plant cells of this invention, e.g. for selecting transgenic plants having enhanced agronomic traits. The relevant Pfam modules for use in this invention, as more specifically disclosed below, are Syntaxin::SNARE, Pro_isomerase, Pkinase, ATP-synt_G, Carboxyl_trans, CDC50, GATase::GMP_synt_C, F-box::WD40::WD40:: WD40, dsrm::dsrm, Pyr_redox_2::Pyr_redox_dim, WAK:: Pkinase, Pkinase_Tyr, PTPA, Biotin_lipoyl::E3_binding::2-oxoacid_dh, AAA, LRRNT_2::LRR_1::LRR_1::LRR_1, PRA1, TIM, YTH, ThiF, Hep_59, Pkinase, PALP::Thr_dehydrat_C::Thr_dehydrat_C, zf-Tim10_DDP, CAF1, Pkinase, Pyr_redox_2::Pyr_redox_dim, Response_reg, YIF1, NPH3, LRRNT_2::LRR_1::LRR_1::LRR_1::LRR_::Pkinase_Tyr, NOI, Fer2, AA_permease, Caleosin, IF4E, Pkinase, Ribul_P_3_epim, F-box::WD40::WD40::WD40:: WD40::WD40::WD40, MIP, p450, Ribosomal_S5:: Ribosomal_S5_C; Hpt, TBC, Acyltransferase. Epimerase, Pkinase, Dus, SelR, PH, Tyr-DNA_phospho, RRM_1, Pkinase, ECH, SRPRB, DUF599, Pkinase::efhand::efhand:: efhand::efhand, ORC2, PME1, p450, GLIP, Suc_Fer-like, CBS::CBS, ADH_N::ADH_zinc_N, LRRNT_2::LRR_1:: LRR_1::LRR_1::Pkinase, F-box, adh_short, polyprenyl_synt, GHMP_kinases_N::GHMP_kinases_C, PsbW, Na_H_Exchanger::TrkA_C, Ribosomal_L12, CDC50, DCP1, Pyr_redox_2::Pyr_redox_dim, Steroid_dh, tRNA-syn_1c::tRNA-synt_1c_C, Cupin_1::Cupin_1, peroxidase; Sugar_tr, Pro_isonmerase. Iso_dh, PTS_2-RNA, Aminotran_5, ENOD93, KH_1::KH_1::KH_1::KH_1:: KH_1, Mito_carr::Mito_carr::Mito_carr, DUF569:: DUF569, C1_2::C1_2::C1_3::C1_2::C1_3::C1_2, DnaJ::zf-C2H2, Aldedh, AAA::Rep_fac_C, DUF641, Aminotran_1_2, TB2_DP1_HVA22, zf-C3HC4, RRM_1:: RRM_2, Pkinase, PPR::PPR::PPR::PPR::PPR::PPR::PPR:: PPR::PPR::PPR::PPR, Pyr_redox_2, 1Q::1Q, SMP::SMP:: SMP, AWPM-19, CLP_protease, Pkiniase::NAF, PRMT5, PPR::PPR::PPR::PPR::PPR::PPR, Aldedh, ATP-synt_C:: ATP-synt_C, adh_short, RCC1::RCC1::RCC1::RCC1:: FYVE::DZC, p450, PfkB, PB1, Hexapep::Hexapep::Hexapep::Hexapep, Aminotran_1_2, DUFS62, Aldedh, ADH_N:: ADH_zinc_N, CDC48_N::AAA::AAA, AA_permease, UQ_con, Mem_trans, GFA, OPT, DUF887, Di19, (U-box:: Arm::Arm, DAO, G-alpha, Amnaotran_3, 2OG-FeII_Oxy, Lectin_legB::Pkinase, NAC::UBA, efhand_like::PI-PLC-X::PI-PLC-Y::C2, TLC, ATP-grasp_2::Ligase_CoA, Pkinase, PRC::PRC, MFS_1::Sugar_tr, Copine::zf-C3HC4, RRM_1::RRM_1::RRM_1, Pribosyltran, AA_kinase, PhzC-PhzF, Gp_dh_N::Gp_dh_C, Sugar_tr, Pr-e-SET::SET, Alpha-amylase::Alpha-amyl_C2, Cyclin_N, FAE1_CUT1_RppA::ACP_syn_HI_C, RPE65, efhand_like::PI-PLC-X::PI-PLC-Y::C2, Mito_carr::Mito_carr::Mito_carr, Invertase_neut, DSPc, LANC_like, Aminotran_5, Glutaminase, PPR::PPR::PPR::PPR::PPR:: PPRPPR::PPR, PG1, SSB, p450, La::RRM_1::RRM_3, tehyltransf_11, SBF, NTP_transferase::Hexapep::Hexapep:: Hexapep, Mov34, Hydrolase, AAA, RRM_1::RRM_1, Pkinase::NAF, F-box::FBA_1, p450, F-box::LRR_2, zf-DHHC, TBP::TBP, DUF607, FMO-like, adh_short, ATP-synt_ab_N::ATP-synt_ab, RNase_PH, PP2C, UQ_con, Arninotran_1_2, p450, FMO-like, Gp_dh_N::Gp_dh_C, Mito_carr::Mito_carr::Mito_carr, zf-CCCH::zf-CCCH::zff-CCCH::zf-CCCH::zf-CCCH, GST_C, GH3, PAP_fibrillin, ThiF, Ribul_P_3_epim, DUF26, p450, MACPF, Steroid_dh, Response_reg, Carb_anhydrase, Aldedh, Pkinase, Methyltransf_11, PK::PK_C, Pkinase, DEK_C::SWIB::SWIB, TATA_RF, Tryp_alpha_amyl, Y_phospliatase2, TATA_RF, NitU_N, ENT, Pkinase, F-box::Kelch_2::Kelch_2, WD40:: WD40, MtN3_slv::MtN3_slv, TB2_DP1_HVA22, Pkinase, Aldedh, AAA, Pyridoxal_deC, zf-CCHC::zf-CCHC::zf-CCHC::zf-CCHC, Peptidase_M24, LRRNT_2::LRR_1:: LRR_1::LRR_1::LRR_1::Pkinase, Arf, DUF1279, UPF0185, Rhodanese, adh_short, Tryp_alpha_amyl, Pkinase, UPF0139, CBS, Glyco_transf_29, iPGM_N::Mctalloenzyme, Proteasome, Pkinase, UBX, ELFV_dehydrog_N::ELFV_c dehydrog, p450, ADH_N::ADH_zinc_N, zf-C3HC4, NDK, NAD_Gly3P_dh_N:: NAD_Gly3P_dh_C, GlutR_N::Shikimate_DH::GlutR_dimer, p450, SNF5, p450, Pribosyltran, AIG1, Response_reg:: CCT, mTERF, DUF220, Pkinase::NAF, zf-CCCH::zf-CCCH, Pkinase, Pkinase, MATH::MATH, Asparaginase, Pkinase, Gp_dh_N::Gp_dh_C, Pkinase, KH_1, Fcf1, PK:: PK_C::PEP-utilizers, CRAL_TR1O_N::CRAL_TR1O, Raffinose_syn, DUF584, BT1, Aminotran_1_2, C1_2::

C1_3::C1_3::C1_2::C1_3::C1_3::C1_2, FMO-like, PLAC8, F-box::Kelch_2::Kelch_1::Kelch_2, XS::XH, STT3, ABC_tran::ABC_tran, Aldo_ket_red, NTF2::RRM_1, DUF594, Biotin_lipoyl::2-oxoacid_dh, RRM_1, FHA, Mov34, MT-A70, Brix, X8, Auxin_inducible, Peptidase_M18, Sec61_beta, F-box::Kelch_1::Kelch_1, Brix, TIM, CTP_transf_1, Tetraspannin, PALP, DUF822, Pkinase, B3::B3, MFS 1, SFT2, F-box::Kelch_1::Kelch_1, DUF588, Thioredoxin, Alba, Ion_trans_2::Ion_trans_2, Peptidase_C48, YDG_SRA::Pre-SET::SET, Aldedh, Abhydrolase_3, p450, U-box::Arm::Arm::Arm::Arm, AApelmease, LAG1, peroxidase, PAD_porph, Pkinase, F-box, AIG2, p450, AARP2CN::DUF663, UPF0153, NAD_binding_2::6PGD, Pkinase, B_lectin::S_locus_glycop::PAN_1::Pkinase, EMP24_GP25L, DUF6::DUF6, DUF163, Sina, adh_short, Rho_GDI, zf-CCHC::zfCCHC::zf-CCHC::zf-CCHC::zf-CCHC::zf-CCHC, VHS::GAT, Pyrophosphatase, DMRL_synthase, Cyclin_N::Cyclin_C, NDK, TPP_enzyme_N::TPP_enzyme_M::TPP_enzyme_C, SH3_1, UDPG_MGDP_dh_N::UDPG_MGDP_dh::UDPG_MGDP_dh_C, UIM::efhand, DUF579, Pkinase, DHBP_synthase::GTP_cyclohydro2, Peptidase_C14, Glycolytic, Pkinase, Lipase_3, LRRNT_2::LRR_1::LRR_1::LRR_1::LRR_1, Snf7, BT1, PPDK_N::PEP-utilizers::PEP-utilizers_C, V-ATPase_G, RNA_pol_I_A49, Zip, WD40::WD40::WD40, Branch, RCC1::RCC1::RCC1::RCC1, TF11D-18 kDa, Pkinase, Cullin, TF11D-3 kDa, Asp, Pkinase, Ubie_methyltran, PPR::PPR, PPR::PPR::PPR::PPR::PPR::PPR::PPR, Fructosamin_kin, PPR::PPR::PPR::PPR::PPR, Pkinase_Tyr, p450, AA_permease, Glycos_transf_1, ECH::3HCDH_N::3HCDH, MIP, ADH_N::ADH_zinc_N, Aa_trans, DUF1517, Redoxin, RRS1, Pribosyltran, Sulfate_transp::STAS, DUF167, MMR_HSR1::DUF933, Aminotran_1_2, AA_permease, DUF620, Aldedh, Aminotran_1_2, LRR_1, CDP-OH_P_transf, DHBP_synthase::GTP_cyclohydro2, NHL::NHL, WD40::U3_snoRNA_C, Na_sulph_symp, adh_short, Thioredoxin, Ribosomal_L7Ae, OTCace_N::OTCacc, Mito_carr::Mito_carr::Mito_carr, Pescadillo_N::BRCT, PPR::PPR::PPR::PPR::PPR::PPR::PPR::PPR::PPR::PPR, mTERF, Chalcone, Per1, PPR::PPR, Na_H_Exdhangeri:TrkA_N, DEAD::Helicase_C, Cyclin_N::Cyclin_C, PP-binding, SRF-TF, SATase_N::Hexapep::Hexapep::Hexapep, PK::PK_C, adh_short, DUF6::DUF6, Pyr_redox_2, G-patch, WD40::WD40::WD4::WD40, G-alpha, VQ, WD40::WD40::WD40::WD40::WD40, Aminotran_3, Pribosyltran, LRRNT_2::LRR_1::LRR_::LRR_1::LRR_1::LRR_1, eIF3_subunit, H_PPase, Nodulin-like, Whi5, Tryp_alpha_amyl, NIR_SIR_fen-::NIR_SIR::NIR_SIR_fen, RRM_1::RRM_1, Band_7, Asp, MFS_1, F420_oxidored, Pkinase, PRK, Na_Ca_ex::Na_Ca_ex, Bombesin, Pkinase, Epimerase, Pkinase, Inositol_P, Arm::Arm::Arm::Arm, PB1, Hin1, p450, RNA_pol_Rph5_N_RNA_pol_Rpb5_C, Adap_comp_sub, Peptidase_M16::Peptidase_M16_C, Pkinase, PGK, Biotin lipoyl::E3_binding::2-oxoacid_dh, Alg6_Alg8, F-box, MMR_HSR1, G6PD_N::G6PD_C, DAD, malic::Malic_M::PTA_PTB, ADH_N::ADH_zinc_N, LRR_1::LRR_1::LRR_1::LRR_::LRR_1::LRR_1::LRR_1, PfkB, PA, Pyr_redox_2::Pyr_redox_dim, SIP1, PP2C, BT1, AhpC-TSA, GASA, Amninotran_3, Sad1_UNC, Pkinase, zf-MYND::PDCD2_C, Pkinase, PGK, ArfGap, GATase::GMP_synt_C, p450, DUF1637, 2OG-FeII_Oxy, Aldedh, DUF231, Glyco_transf_8, Sec1, DUF1475, Cellulose_synt, RRM_1::RRM_1::RRM_1, Usp, AA_permease, Acetyltransf_1::Bromodomain, Glyco_tran_28_C, RNA_pol_N, NTP_transferase, malic::Malic_M, Histone, Epimerase, UPF0060, ClpS, LEA_5, Auxin_inducible, PAP_fibrillin, Aldo_ket_red, Gln-synt_C, DREPP, p450, SFT2, eIF2A, Cenp-O, CPSasc_sm_chain::GATase, WD40::WD40::WD40, Pkinase, Porin_3, Pkinase, Aminotran_1_2, GST_N::GST_C, F-box::Kelch_1::Kelch_11, IU_nuc_hydro, SYF2, PDT, Subtilisin_N::PA, Sugar_tr, WD40::WD40, p450, DUFS29, Pyr_redox_2::Pyr_redox_dim, Aminotran_1_2, Cyclin_N::Cyclin_C, YgbB, Sugar_tr, SRF-TF, DUF231, DUF584, BT1, zf-C3HC4, Metallophos, FA_hydroxylase, p450, ACBP::Ank::Ank, LSM, SAM_1, LRR_1::LRR_1::Pkinase, Cullin, F-box::FBA_1, peroxidase, Rib_5-P_isom_A, zf-A20::zf-AN1, Dimerisation::Methyltransf_2, PGAM, PTR2, Copine, PALP, Exo_endo_phos, G6PD_N::G6PD_C, PLAC8, Aldo_kel_red, Ank::Ank, FBPase, zf-C3HC4, ACT::ACT, Suc_Fer-like, Pkinase Tyr, G-alpha, RAMP4, Glutaredoxin, RRM_1::RRM_1, MT-A70, Response_reg::CCT, Arf, AP2, DUF177, 2OG-FeII_Oxy, LRRNT_2::LRR_1::LRR_1::LRR_1::LRR_::LRR_1, LRR_1, Aldedh, DUF1350, FAE1_CUT1_RppA::ACP_syn_III_C, Sybindin, zf-C3HC4, Nfu_N::NitU, Rho_GDI, PK::PK_C, NOSIC::Nop, PK::PK_C, PRK::Pribosyltran, PfkB, p450, DUF231, TFIID_30 kDa, Aldedh, zf-AN1, GHMP_kinases_N::GHMP_kinases_C, DUF423, Pkinase, Cu-oxidase_3::Cu-oxidase::Cu-oxidase_2, PCI, RNase_PH::RNase_PH_C, DUF59, NTP_transferase, CH::EB1, Pkinase::Pkinase_C, DUFS66, SMP::SMP::SMP, Aminotran_3, Transket_pyr::Transketolase_C, Copine, His_biosynth, Tbf5, DUF543, p450, C2, DUF616, Gp_dh_N::Gp_dh_C, Smg4_UPF3, DUF231, DUF89, WD40::WD40, Aldedh, ACT::ACT::ACT::ACT, Pkinase, Pyridoxal_deC, Skp1_POZ::Skp1, NAP, FolB, p450, Pentapeptide::Pentapeptide, NTP_transferase::MannoseP_isomer, SQS_PSY, Cyclase, GASA, Rick_17 kDa_Anti, FMO-like, B_lectin::S_locus_glycop::PAN_2, Peptidase_C12. Ribosomal_S6e, Glyoxalase, Response_reg::CCT, PHD::SET, Redoxin, G_glu_transpept, Synaptobrevin, p450, RALF, PALP, Branch, DUF579, Aminotran_3, Nramp, Enolase_N::Enolase_C, Str_synth, FAD_binding_3, MOSC_N::MOSC, Spc97_Spc98, Glycolytic, F-box::WD40::WD40::WD40::WD40, AA_kinase::ACT::ACT, RALF, and ATP_bind_1.

Plant Cell Transformation Methods

Numerous methods for transforming chromosomes in a plant cell nucleus with recombinant DNA are known in the art and are used in methods of preparing a transgenic plant cell nucleus cell, and plant. Two effective methods for such transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn) U.S. Pat. No. 5,914,451 (soybean); U.S. Pat. No. 6,160,208 (corn); U.S. Pat. No. 6,399,861 (corn); U.S. Pat. No. 6,153,812 (wheat) and U.S. Pat. No. 6,365,807 (rice) and *Agrobacterium*-mediated transformation is described in U.S. Pat. No. 5,159,135 (cotton); U.S. Pat. No. 5,824,877 (soybean); U.S. Pat. No. 5,463,174 (canola, also known as rapeseed); U.S. Pat. No. 5,591,616 (corn); U.S. Pat. No. 6,384,301 (soybean), U.S. Pat. No. 7,026,528 (wheat) and U.S. Pat. No. 6,329,571 (rice), all of which are incorporated herein by reference for enabling the production of transgenic plants. Transformation of plant material is practiced in tissue culture on a nutrient media, e.g. a mixture of nutrients that will allow cells to grow in vitro. Recipient cell targets include, but are not limited to, meristem cells, hypocotyls, calli, immature embryos and gametic cells such as nicrospores, pollen, sperm and egg cells. Callus can be initiated from tissue sources including, but not limited to, immature embryos, hypocotyls, seedling apical meristems, microspores and the like. Cells containing a transgenic nucleus are grown into transgenic plants.

In addition to direct transformation of a plant material with a recombinant DNA, a transgenic plant cell nucleus can be prepared by crossing a first plant having cells with a transgenic nucleus with recombinant DNA with a second plant lacking the trangenci nucleus. For example, recombinant DNA can be introduced into a nucleus from a first plant line that is amenable to transformation to transgenic nucleus in cells that are grown into a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line In practice, DNA is introduced into only a small percentage of target cell nuclei. Marker genes are used to provide an efficient system for identification of those cells with nuclei that are stably transformed by receiving and integrating a recombinant DNA molecule into their genomes. Some marker genes provide selective markers that confer resistance to a selective agent, such as an antibiotic or herbicide. Potentially transformed cells with a nucleus of the invention are exposed to the selective agent. In the population of surviving cells will be those cells where, generally, the resistance-conferring gene has been integrated and expressed at sufficient levels to permit cell survival. Cells can be tested further to confirm stable integration of the exogenous DNA in the nucleus. Explementary selective marker genes include those conferring resistance to antibiotics such as kanamycin (nptII), hygromycin B (aph IV), spectinomycin (aadA) and gentamycin (aac3 and aacC4) or resistance to herbicides such as glufosinate (bar or pat), dicamba (DMO) and glyphosate (EPSPS). Examples of such selectable markers are illustrated in U.S. Pat. Nos. 5,550,318; 5,633,435; 5,780,708 and 6,118,047, all of which are incorporated herein by reference. Screenable markers which provide an ability to visually identify transformants can also be employed, e.g., a gene expressing a colored or fluorescent protein such as a luciferase or green fluorescent protein (GFP) or a gene expressing a beta-glucuronidase or uidA gene (GUS) for which various chromogenic substrates are known. It is also contemplated that combinations of screenable and selectable markers can be used for identification of transformed cells. See PCT publication WO 99/61129 (herein incorporated by reference) which discloses use of a gene fusion between a selectable marker gene and a screenable marker gene, e.g., an NPTII gene and a GFP gene.

Plant cells that survive exposure to the selective agent, or plant cells that have been scored positive in a screening assay, can be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}$ $s^{-1}$ of light, prior to transfer to a greenhouse or growth chamber for maturation. Plants are regenerated from about 6 weeks to 10 months after a transformant is identified, depending on the initial tissue, and plant species. Plants can be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of enhanced agronomic trait.

Transgenic Plants and Seeds

Transgenic plants derived from transgenic plant cells having a transgenic nucleus of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil.

To identify nuclei with recombinant DNA that confer enhanced traits to plants, *Arabidopsis thaliana* was transformed with a candidate recombinant DNA construct and screened for an enhanced trait.

*Arabidopsis thaliana* is used a model for genetics and metabolism in plants. A two-step screening process was employed which included two passes of trait characterization to ensure that the trait modification was dependent on expression of the recombinant DNA, but not due to the chromosomal location of the integration of the transgene. Twelve independent transgenic lines for each recombinant DNA construct were established and assayed for the transgene expression levels. Five transgenic lines with high transgene expression levels were used in the first pass screen to evaluate the transgene's function in T2 transgenic plants. Subsequently, three transgenic events, which had been shown to have one or more enhanced traits, were further evaluated in the second pass screen to confirm the transgene's ability to impart an enhanced trail. The following Table 3 summarizes the enhanced trails that have been confirmed as provided by a recombinant DNA construct.

Table 2 provides a list of protein encoding DNA ("genes") as recombinant DNA for production of transgenic plants with enhanced agronomic trait, the elements of Table 2 are described by reference to:

PEP SEQ ID NO" identifies an amino acid sequence from SEQ ID NO: 804 to 1606.

"NUC SEQ ID NO" identifies a DNA sequence from SEQ ID NO:1 to 803

"construct_id" refers to an arbitrary number used to identify a particular recombinant DNA construct comprising the particular DNA.

"Gene ID" refers to an arbitrary name used to identify the particular DNA. "orientation" refers to the orientation of the particular DNA in a recombinant DNA construct relative to the promoter.

TABLE 2

| NUC SEQ ID NO | PEP SEQ ID NO | Gene ID | Construct ID | Orientation |
|---|---|---|---|---|
| 1 | 804 | CGPG10 | 70244 | SENSE |
| 2 | 805 | CGPG1008 | 71108 | SENSE |
| 3 | 806 | CGPG1023 | 12816 | SENSE |
| 4 | 807 | CGPG1038 | 12650 | ANTI-SENSE |
| 5 | 808 | CGPG1067 | 12031 | SENSE |
| 6 | 809 | CGPG1095 | 12217 | SENSE |
| 7 | 810 | CGPG1101 | 12043 | SENSE |
| 8 | 811 | CGPG1109 | 12147 | ANTI-SENSE |
| 9 | 812 | CGPG1113 | 13638 | ANTI-SENSE |
| 10 | 813 | CGPG1155 | 11860 | ANTI-SENSE |
| 11 | 814 | CGPG1163 | 72361 | SENSE |
| 12 | 815 | CGPG1171 | 12230 | SENSE |
| 13 | 816 | CGPG1177 | 71626 | SENSE |
| 14 | 817 | CGPG1205 | 13454 | ANTI-SENSE |
| 15 | 818 | CGPG1207 | 12173 | ANTI-SENSE |
| 16 | 819 | CGPG1215 | 17806 | ANTI-SENSE |
| 17 | 820 | CGPG1223 | 12011 | ANTI-SENSE |
| 18 | 821 | CGPG1250 | 72915 | SENSE |
| 19 | 822 | CGPG1279 | 13231 | SENSE |
| 20 | 823 | CGPG1304 | 13913 | SENSE |
| 21 | 824 | CGPG1319 | 12749 | ANTI-SENSE |
| 22 | 825 | CGPG1327 | 78901 | SENSE |
| 23 | 826 | CGPG1329 | 75969 | SENSE |
| 24 | 827 | CGPG133 | 15606 | SENSE |
| 25 | 828 | CGPG1332 | 75946 | SENSE |
| 26 | 829 | CGPG1343 | 13050 | ANTI-SENSE |
| 27 | 830 | CGPG1348 | 75958 | SENSE |
| 28 | 831 | CGPG1349 | 17333 | SENSE |
| 29 | 832 | CGPG1373 | 76002 | SENSE |
| 30 | 833 | CGPG1377 | 78735 | SENSE |
| 31 | 834 | CGPG1412 | 13914 | SENSE |
| 32 | 835 | CGPG1421 | 14405 | SENSE |
| 33 | 836 | CGPG1426 | 75983 | SENSE |
| 34 | 837 | CGPG1433 | 70721 | ANTI-SENSE |
| 35 | 838 | CGPG1453 | 13811 | SENSE |
| 35 | 838 | CGPG1453 | 13828 | ANTI-SENSE |
| 36 | 839 | CGPG1454 | 13614 | SENSE |
| 37 | 840 | CGPG1463 | 76050 | SENSE |
| 38 | 841 | CGPG1464 | 13038 | ANTI-SENSE |
| 39 | 842 | CGPG1471 | 13040 | ANTI-SENSE |
| 40 | 843 | CGPG1481 | 70716 | ANTI-SENSE |
| 40 | 843 | CGPG1481 | 76039 | SENSE |
| 41 | 844 | CGPG1499 | 71611 | SENSE |
| 42 | 845 | CGPG150 | 70253 | SENSE |
| 43 | 846 | CGPG1536 | 14415 | SENSE |
| 44 | 847 | CGPG1539 | 13718 | ANTI-SENSE |
| 45 | 848 | CGPG155 | 10706 | ANTI-SENSE |
| 45 | 848 | CGPG155 | 10709 | ANTI-SENSE |
| 46 | 849 | CGPG1583 | 14340 | ANTI-SENSE |
| 47 | 850 | CGPG1588 | 13471 | ANTI-SENSE |
| 48 | 851 | CGPG16 | 18304 | SENSE |
| 49 | 852 | CGPG1609 | 13623 | SENSE |
| 50 | 853 | CGPG1629 | 18302 | SENSE |
| 51 | 854 | CGPG1637 | 15053 | ANTI-SENSE |
| 52 | 855 | CGPG1653 | 15624 | SENSE |
| 53 | 856 | CGPG1658 | 70412 | SENSE |
| 54 | 857 | CGPG1663 | 17902 | SENSE |
| 55 | 858 | CGPG1682 | 14272 | ANTI-SENSE |
| 56 | 859 | CGPG1701 | 15122 | SENSE |
| 56 | 859 | CGPG1701 | 70723 | ANTI-SENSE |
| 57 | 860 | CGPG1723 | 14248 | SENSE |
| 58 | 861 | CGPG1724 | 13965 | ANTI-SENSE |
| 59 | 862 | CGPG1726 | 75912 | SENSE |
| 60 | 863 | CGPG1736 | 14344 | ANTI-SENSE |
| 61 | 864 | CGPG1741 | 14807 | ANTI-SENSE |
| 62 | 865 | CGPG1783 | 17307 | SENSE |
| 63 | 866 | CGPG1790 | 16431 | ANTI-SENSE |
| 64 | 867 | CGPG1797 | 73075 | SENSE |
| 65 | 868 | CGPG1845 | 16323 | SENSE |
| 66 | 869 | CGPG1855 | 14833 | ANTI-SENSE |
| 67 | 870 | CGPG1870 | 17030 | ANTI-SENSE |
| 68 | 871 | CGPG1879 | 76414 | SENSE |
| 69 | 872 | CGPG1886 | 16021 | SENSE |
| 70 | 873 | CGPG1903 | 78701 | SENSE |
| 71 | 874 | CGPG1905 | 78702 | SENSE |
| 72 | 875 | CGPG1914 | 15220 | ANTI-SENSE |
| 73 | 876 | CGPG193 | 15623 | SENSE |
| 74 | 877 | CGPG1939 | 19402 | SENSE |
| 75 | 878 | CGPG1949 | 70559 | SENSE |
| 76 | 879 | CGPG1959 | 15111 | ANTI-SENSE |
| 77 | 880 | CGPG197 | 70832 | SENSE |
| 78 | 881 | CGPG1972 | 15129 | SENSE |
| 79 | 882 | CGPG1981 | 76086 | SENSE |
| 80 | 883 | CGPG1999 | 15203 | ANTI-SENSE |
| 81 | 884 | CGPG2 | 70216 | SENSE |
| 82 | 885 | CGPG2006 | 14910 | ANTI-SENSE |
| 83 | 886 | CGPG2010 | 70318 | SENSE |
| 84 | 887 | CGPG2011 | 15207 | ANTI-SENSE |
| 85 | 888 | CGPG2014 | 14915 | ANTI-SENSE |
| 86 | 889 | CGPG2023 | 15132 | SENSE |
| 87 | 890 | CGPG2026 | 16229 | SENSE |
| 88 | 891 | CGPG2041 | 14932 | ANTI-SENSE |
| 89 | 892 | CGPG2064 | 76017 | SENSE |
| 90 | 893 | CGPG2070 | 15964 | ANTI-SENSE |
| 91 | 894 | CGPG2077 | 17227 | SENSE |
| 92 | 895 | CGPG2095 | 72952 | SENSE |
| 93 | 896 | CGPG2105 | 73706 | SENSE |
| 94 | 897 | CGPG2108 | 18203 | SENSE |
| 95 | 898 | CGPG2111 | 16309 | SENSE |
| 96 | 899 | CGPG2124 | 15986 | ANTI-SENSE |
| 97 | 900 | CGPG2125 | 15987 | ANTI-SENSE |
| 98 | 901 | CGPG2126 | 16204 | SENSE |
| 99 | 902 | CGPG213 | 11133 | SENSE |
| 100 | 903 | CGPG2134 | 73977 | SENSE |
| 101 | 904 | CGPG2139 | 15995 | ANTI-SENSE |
| 101 | 904 | CGPG2139 | 18201 | SENSE |
| 102 | 905 | CGPG2140 | 16887 | SENSE |
| 103 | 906 | CGPG2153 | 16213 | SENSE |
| 104 | 907 | CGPG2163 | 15507 | ANTI-SENSE |
| 105 | 908 | CGPG2165 | 15508 | ANTI-SENSE |
| 106 | 909 | CGPG2193 | 15959 | ANTI-SENSE |
| 107 | 910 | CGPG2218 | 72427 | ANTI-SENSE |
| 108 | 911 | CGPG2224 | 19041 | ANTI-SENSE |
| 109 | 912 | CGPG2225 | 17802 | SENSE |
| 110 | 913 | CGPG2229 | 19042 | ANTI-SENSE |
| 111 | 914 | CGPG2243 | 76053 | SENSE |
| 112 | 915 | CGPG2254 | 16120 | SENSE |
| 113 | 916 | CGPG2268 | 15424 | ANTI-SENSE |
| 114 | 917 | CGPG227 | 16401 | SENSE |
| 115 | 918 | CGPG2312 | 72417 | SENSE |
| 116 | 919 | CGPG2315 | 73702 | SENSE |
| 117 | 920 | CGPG2316 | 70706 | ANTI-SENSE |
| 118 | 921 | CGPG2319 | 71145 | SENSE |
| 119 | 922 | CGPG235 | 11609 | ANTI-SENSE |
| 120 | 923 | CGPG2358 | 71706 | SENSE |
| 121 | 924 | CGPG2359 | 17325 | SENSE |
| 122 | 925 | CGPG2361 | 70102 | SENSE |
| 123 | 926 | CGPG2365 | 70106 | SENSE |
| 124 | 927 | CGPG2372 | 70113 | SENSE |
| 125 | 928 | CGPG2374 | 70115 | SENSE |
| 126 | 929 | CGPG2377 | 70118 | SENSE |
| 127 | 930 | CGPG2387 | 70128 | SENSE |
| 128 | 931 | CGPG2389 | 70130 | SENSE |
| 129 | 932 | CGPG2395 | 17103 | ANTI-SENSE |
| 130 | 933 | CGPG2408 | 72748 | SENSE |
| 131 | 934 | CGPG2409 | 17502 | SENSE |
| 132 | 935 | CGPG2410 | 17503 | SENSE |
| 133 | 936 | CGPG2414 | 78708 | SENSE |
| 134 | 937 | CGPG2416 | 17504 | SENSE |

TABLE 2-continued

| NUC SEQ ID NO | PEP SEQ ID NO | Gene ID | Construct ID | Orientation |
|---|---|---|---|---|
| 135 | 938 | CGPG2441 | 17132 | ANTI-SENSE |
| 136 | 939 | CGPG2450 | 72965 | SENSE |
| 137 | 940 | CGPG2451 | 72796 | SENSE |
| 138 | 941 | CGPG2492 | 16617 | SENSE |
| 139 | 942 | CGPG2495 | 16640 | SENSE |
| 140 | 943 | CGPG2506 | 16603 | SENSE |
| 141 | 944 | CGPG2515 | 16612 | SENSE |
| 142 | 945 | CGPG2531 | 16614 | SENSE |
| 143 | 946 | CGPG2581 | 78354 | SENSE |
| 144 | 947 | CGPG2584 | 17818 | SENSE |
| 145 | 948 | CGPG2592 | 78370 | SENSE |
| 146 | 949 | CGPG2612 | 70411 | SENSE |
| 147 | 950 | CGPG2660 | 19154 | SENSE |
| 148 | 951 | CGPG2663 | 19155 | SENSE |
| 149 | 952 | CGPG2679 | 18307 | SENSE |
| 150 | 953 | CGPG2696 | 72030 | SENSE |
| 151 | 954 | CGPG2772 | 17916 | SENSE |
| 152 | 955 | CGPG2773 | 17917 | SENSE |
| 153 | 956 | CGPG281 | 17334 | SENSE |
| 154 | 957 | CGPG2846 | 71531 | SENSE |
| 155 | 958 | CGPG2852 | 18441 | SENSE |
| 156 | 959 | CGPG2863 | 19162 | SENSE |
| 157 | 960 | CGPG2870 | 73205 | SENSE |
| 158 | 961 | CGPG2877 | 18306 | SENSE |
| 159 | 962 | CGPG289 | 70808 | SENSE |
| 160 | 963 | CGPG2924 | 17653 | SENSE |
| 161 | 964 | CGPG2947 | 19535 | SENSE |
| 162 | 965 | CGPG2963 | 71719 | SENSE |
| 163 | 966 | CGPG2987 | 18546 | SENSE |
| 164 | 967 | CGPG3033 | 19534 | SENSE |
| 165 | 968 | CGPG3045 | 18421 | SENSE |
| 166 | 969 | CGPG3046 | 18422 | SENSE |
| 167 | 970 | CGPG3060 | 19539 | SENSE |
| 168 | 971 | CGPG3075 | 19244 | SENSE |
| 169 | 972 | CGPG310 | 15803 | SENSE |
| 170 | 973 | CGPG3103 | 19545 | SENSE |
| 171 | 974 | CGPG315 | 10222 | ANTI-SENSE |
| 171 | 974 | CGPG315 | 72356 | SENSE |
| 172 | 975 | CGPG3183 | 70425 | SENSE |
| 173 | 976 | CGPG3189 | 19237 | SENSE |
| 174 | 977 | CGPG3204 | 71303 | SENSE |
| 175 | 978 | CGPG3208 | 19240 | SENSE |
| 176 | 979 | CGPG3219 | 18535 | SENSE |
| 177 | 980 | CGPG3233 | 19450 | SENSE |
| 178 | 981 | CGPG3263 | 18221 | SENSE |
| 179 | 982 | CGPG3276 | 18233 | SENSE |
| 180 | 983 | CGPG3280 | 18236 | SENSE |
| 181 | 984 | CGPG3282 | 18238 | SENSE |
| 182 | 985 | CGPG3300 | 18309 | SENSE |
| 183 | 986 | CGPG3318 | 70337 | SENSE |
| 184 | 987 | CGPG3319 | 18319 | SENSE |
| 185 | 988 | CGPG3326 | 70338 | SENSE |
| 186 | 989 | CGPG333 | 10471 | SENSE |
| 187 | 990 | CGPG3338 | 18331 | SENSE |
| 188 | 991 | CGPG334 | 10228 | ANTI-SENSE |
| 188 | 991 | CGPG334 | 10473 | SENSE |
| 189 | 992 | CGPG3374 | 18261 | SENSE |
| 190 | 993 | CGPG3402 | 18848 | SENSE |
| 191 | 994 | CGPG3405 | 18268 | SENSE |
| 192 | 995 | CGPG3413 | 18345 | SENSE |
| 193 | 996 | CGPG3422 | 73607 | SENSE |
| 194 | 997 | CGPG3436 | 18352 | SENSE |
| 195 | 998 | CGPG3539 | 18357 | SENSE |
| 196 | 999 | CGPG3550 | 19423 | SENSE |
| 197 | 1000 | CGPG3551 | 78373 | SENSE |
| 198 | 1001 | CGPG3552 | 70603 | SENSE |
| 199 | 1002 | CGPG3572 | 19616 | SENSE |
| 200 | 1003 | CGPG3598 | 19425 | SENSE |
| 201 | 1004 | CGPG3599 | 19426 | SENSE |
| 202 | 1005 | CGPG3606 | 18382 | SENSE |
| 203 | 1006 | CGPG3610 | 71536 | SENSE |
| 204 | 1007 | CGPG3620 | 70419 | SENSE |
| 205 | 1008 | CGPG364 | 70827 | SENSE |
| 206 | 1009 | CGPG3676 | 19311 | SENSE |
| 207 | 1010 | CGPG3679 | 19323 | SENSE |
| 208 | 1011 | CGPG3686 | 19320 | SENSE |
| 209 | 1012 | CGPG3694 | 73613 | SENSE |
| 210 | 1013 | CGPG3696 | 70432 | SENSE |
| 211 | 1014 | CGPG3698 | 70433 | SENSE |
| 212 | 1015 | CGPG3699 | 70434 | SENSE |
| 213 | 1016 | CGPG3702 | 72614 | SENSE |
| 214 | 1017 | CGPG3703 | 70436 | SENSE |
| 215 | 1018 | CGPG3707 | 74226 | SENSE |
| 216 | 1019 | CGPG3710 | 70439 | SENSE |
| 217 | 1020 | CGPG3730 | 70446 | SENSE |
| 218 | 1021 | CGPG3731 | 70613 | SENSE |
| 219 | 1022 | CGPG3734 | 70447 | SENSE |
| 220 | 1023 | CGPG3745 | 71725 | SENSE |
| 221 | 1024 | CGPG3764 | 70462 | SENSE |
| 222 | 1025 | CGPG3820 | 70545 | SENSE |
| 223 | 1026 | CGPG3851 | 70741 | SENSE |
| 224 | 1027 | CGPG3911 | 19702 | SENSE |
| 225 | 1028 | CGPG3948 | 19985 | SENSE |
| 226 | 1029 | CGPG3958 | 19775 | SENSE |
| 227 | 1030 | CGPG3981 | 19829 | SENSE |
| 228 | 1031 | CGPG3996 | 19982 | SENSE |
| 229 | 1032 | CGPG4006 | 19755 | SENSE |
| 230 | 1033 | CGPG4025 | 19732 | SENSE |
| 231 | 1034 | CGPG4028 | 70365 | SENSE |
| 232 | 1035 | CGPG403 | 10476 | SENSE |
| 233 | 1036 | CGPG4041 | 19987 | SENSE |
| 234 | 1037 | CGPG4078 | 19893 | SENSE |
| 235 | 1038 | CGPG4079 | 19983 | SENSE |
| 236 | 1039 | CGPG4083 | 19825 | SENSE |
| 237 | 1040 | CGPG4092 | 19919 | SENSE |
| 238 | 1041 | CGPG4104 | 19979 | SENSE |
| 239 | 1042 | CGPG4127 | 19786 | SENSE |
| 240 | 1043 | CGPG4135 | 70903 | SENSE |
| 241 | 1044 | CGPG4161 | 70970 | SENSE |
| 242 | 1045 | CGPG4180 | 70980 | SENSE |
| 243 | 1046 | CGPG4191 | 70936 | SENSE |
| 244 | 1047 | CGPG4199 | 71425 | SENSE |
| 245 | 1048 | CGPG4241 | 78666 | SENSE |
| 246 | 1049 | CGPG427 | 71202 | SENSE |
| 247 | 1050 | CGPG4273 | 78973 | SENSE |
| 248 | 1051 | CGPG4301 | 76411 | SENSE |
| 249 | 1052 | CGPG4303 | 70635 | SENSE |
| 250 | 1053 | CGPG4313 | 73715 | SENSE |
| 251 | 1054 | CGPG4314 | 70638 | SENSE |
| 252 | 1055 | CGPG4329 | 70642 | SENSE |
| 253 | 1056 | CGPG4330 | 70643 | SENSE |
| 254 | 1057 | CGPG4338 | 71564 | SENSE |
| 255 | 1058 | CGPG4341 | 75039 | SENSE |
| 256 | 1059 | CGPG4347 | 70653 | SENSE |
| 257 | 1060 | CGPG4354 | 70655 | SENSE |
| 258 | 1061 | CGPG4386 | 78321 | SENSE |
| 259 | 1062 | CGPG4394 | 78307 | SENSE |
| 260 | 1063 | CGPG4396 | 71808 | SENSE |
| 261 | 1064 | CGPG4400 | 71810 | SENSE |
| 262 | 1065 | CGPG4401 | 71313 | SENSE |
| 263 | 1066 | CGPG441 | 72349 | SENSE |
| 264 | 1067 | CGPG4413 | 71318 | SENSE |
| 265 | 1068 | CGPG4427 | 71812 | SENSE |
| 266 | 1069 | CGPG4446 | 74060 | SENSE |
| 267 | 1070 | CGPG4448 | 71816 | SENSE |
| 268 | 1071 | CGPG4474 | 71569 | SENSE |
| 269 | 1072 | CGPG4482 | 70672 | SENSE |
| 270 | 1073 | CGPG4511 | 71336 | SENSE |
| 271 | 1074 | CGPG4517 | 71337 | SENSE |
| 272 | 1075 | CGPG4551 | 71339 | SENSE |
| 273 | 1076 | CGPG4559 | 71825 | SENSE |
| 274 | 1077 | CGPG4567 | 73696 | SENSE |
| 275 | 1078 | CGPG4586 | 70682 | SENSE |
| 276 | 1079 | CGPG4600 | 70686 | SENSE |
| 277 | 1080 | CGPG4631 | 78316 | SENSE |
| 278 | 1081 | CGPG4642 | 71667 | SENSE |
| 279 | 1082 | CGPG4645 | 71695 | SENSE |
| 280 | 1083 | CGPG4646 | 71696 | SENSE |
| 281 | 1084 | CGPG4649 | 72475 | SENSE |
| 282 | 1085 | CGPG4653 | 71677 | SENSE |
| 283 | 1086 | CGPG4656 | 71691 | SENSE |
| 284 | 1087 | CGPG4668 | 72476 | SENSE |
| 285 | 1088 | CGPG469 | 70803 | SENSE |
| 286 | 1089 | CGPG4708 | 71612 | SENSE |

TABLE 2-continued

| NUC SEQ ID NO | PEP SEQ ID NO | Gene ID | Construct ID | Orientation |
|---|---|---|---|---|
| 287 | 1090 | CGPG4712 | 71637 | SENSE |
| 288 | 1091 | CGPG4714 | 71629 | SENSE |
| 289 | 1092 | CGPG4719 | 71622 | SENSE |
| 290 | 1093 | CGPG473 | 70810 | SENSE |
| 291 | 1094 | CGPG4734 | 72452 | SENSE |
| 292 | 1095 | CGPG4736 | 74071 | SENSE |
| 293 | 1096 | CGPG474 | 11042 | SENSE |
| 294 | 1097 | CGPG4802 | 72510 | SENSE |
| 295 | 1098 | CGPG4822 | 72537 | SENSE |
| 296 | 1099 | CGPG4826 | 72541 | SENSE |
| 297 | 1100 | CGPG4833 | 72617 | SENSE |
| 298 | 1101 | CGPG4841 | 73755 | SENSE |
| 299 | 1102 | CGPG4850 | 72630 | SENSE |
| 300 | 1103 | CGPG4868 | 72645 | SENSE |
| 301 | 1104 | CGPG4871 | 72647 | SENSE |
| 302 | 1105 | CGPG488 | 14316 | SENSE |
| 303 | 1106 | CGPG4908 | 73689 | SENSE |
| 304 | 1107 | CGPG4913 | 73345 | SENSE |
| 305 | 1108 | CGPG4921 | 73347 | SENSE |
| 306 | 1109 | CGPG4954 | 73231 | SENSE |
| 307 | 1110 | CGPG4956 | 78325 | SENSE |
| 308 | 1111 | CGPG4959 | 72658 | SENSE |
| 309 | 1112 | CGPG4965 | 72660 | SENSE |
| 310 | 1113 | CGPG4970 | 72662 | SENSE |
| 311 | 1114 | CGPG4980 | 73352 | SENSE |
| 312 | 1115 | CGPG4982 | 72814 | SENSE |
| 313 | 1116 | CGPG4985 | 72816 | SENSE |
| 314 | 1117 | CGPG4990 | 72820 | SENSE |
| 315 | 1118 | CGPG4991 | 73353 | SENSE |
| 316 | 1119 | CGPG5007 | 75066 | SENSE |
| 317 | 1120 | CGPG5015 | 78337 | SENSE |
| 318 | 1121 | CGPG5026 | 73317 | SENSE |
| 319 | 1122 | CGPG5029 | 73318 | SENSE |
| 320 | 1123 | CGPG5046 | 73749 | SENSE |
| 321 | 1124 | CGPG508 | 18704 | SENSE |
| 322 | 1125 | CGPG5103 | 73221 | SENSE |
| 323 | 1126 | CGPG511 | 71125 | SENSE |
| 324 | 1127 | CGPG5121 | 76203 | SENSE |
| 325 | 1128 | CGPG5126 | 75067 | SENSE |
| 326 | 1129 | CGPG5136 | 73729 | SENSE |
| 327 | 1130 | CGPG5146 | 75206 | SENSE |
| 328 | 1131 | CGPG5149 | 73248 | SENSE |
| 329 | 1132 | CGPG5181 | 73738 | SENSE |
| 330 | 1133 | CGPG52 | 73332 | SENSE |
| 331 | 1134 | CGPG5206 | 78335 | SENSE |
| 332 | 1135 | CGPG5208 | 75821 | SENSE |
| 333 | 1136 | CGPG5232 | 72038 | SENSE |
| 334 | 1137 | CGPG5239 | 72027 | SENSE |
| 335 | 1138 | CGPG5246 | 72016 | SENSE |
| 336 | 1139 | CGPG525 | 70835 | SENSE |
| 337 | 1140 | CGPG5268 | 72044 | SENSE |
| 338 | 1141 | CGPG5272 | 72092 | SENSE |
| 339 | 1142 | CGPG5333 | 72124 | SENSE |
| 340 | 1143 | CGPG5338 | 72110 | SENSE |
| 341 | 1144 | CGPG5341 | 73916 | SENSE |
| 342 | 1145 | CGPG5369 | 74268 | SENSE |
| 343 | 1146 | CGPG5372 | 74269 | SENSE |
| 344 | 1147 | CGPG5380 | 77902 | SENSE |
| 345 | 1148 | CGPG5386 | 74273 | SENSE |
| 346 | 1149 | CGPG5396 | 74280 | SENSE |
| 347 | 1150 | CGPG5397 | 74281 | SENSE |
| 348 | 1151 | CGPG5421 | 74287 | SENSE |
| 349 | 1152 | CGPG5433 | 73767 | SENSE |
| 350 | 1153 | CGPG5439 | 77304 | SENSE |
| 351 | 1154 | CGPG5453 | 73761 | SENSE |
| 352 | 1155 | CGPG5456 | 74721 | SENSE |
| 353 | 1156 | CGPG5483 | 74719 | SENSE |
| 354 | 1157 | CGPG5492 | 74257 | SENSE |
| 355 | 1158 | CGPG5508 | 72749 | SENSE |
| 356 | 1159 | CGPG5520 | 72703 | SENSE |
| 357 | 1160 | CGPG5525 | 72763 | SENSE |
| 358 | 1161 | CGPG5526 | 72775 | SENSE |
| 359 | 1162 | CGPG5530 | 72728 | SENSE |
| 360 | 1163 | CGPG5534 | 72776 | SENSE |
| 361 | 1164 | CGPG5537 | 72717 | SENSE |
| 362 | 1165 | CGPG5545 | 72718 | SENSE |
| 363 | 1166 | CGPG555 | 11715 | SENSE |
| 364 | 1167 | CGPG5558 | 72779 | SENSE |
| 365 | 1168 | CGPG5559 | 72791 | SENSE |
| 366 | 1169 | CGPG5562 | 72732 | SENSE |
| 367 | 1170 | CGPG5592 | 73027 | SENSE |
| 368 | 1171 | CGPG5625 | 73058 | SENSE |
| 369 | 1172 | CGPG5631 | 73126 | SENSE |
| 370 | 1173 | CGPG5632 | 73138 | SENSE |
| 371 | 1174 | CGPG5636 | 73174 | SENSE |
| 372 | 1175 | CGPG5637 | 73186 | SENSE |
| 373 | 1176 | CGPG564 | 11141 | SENSE |
| 374 | 1177 | CGPG5641 | 73139 | SENSE |
| 375 | 1178 | CGPG5650 | 73128 | SENSE |
| 376 | 1179 | CGPG5653 | 73164 | SENSE |
| 377 | 1180 | CGPG5657 | 73117 | SENSE |
| 378 | 1181 | CGPG5671 | 73142 | SENSE |
| 379 | 1182 | CGPG5672 | 73990 | SENSE |
| 380 | 1183 | CGPG5677 | 73166 | SENSE |
| 381 | 1184 | CGPG5678 | 73178 | SENSE |
| 382 | 1185 | CGPG5679 | 73190 | SENSE |
| 383 | 1186 | CGPG5682 | 73131 | SENSE |
| 384 | 1187 | CGPG5691 | 73108 | SENSE |
| 385 | 1188 | CGPG5699 | 73074 | SENSE |
| 386 | 1189 | CGPG5705 | 73132 | SENSE |
| 387 | 1190 | CGPG5722 | 73146 | SENSE |
| 388 | 1191 | CGPG5734 | 73147 | SENSE |
| 389 | 1192 | CGPG5736 | 73080 | SENSE |
| 390 | 1193 | CGPG5744 | 73077 | SENSE |
| 391 | 1194 | CGPG5747 | 73183 | SENSE |
| 392 | 1195 | CGPG5748 | 73018 | SENSE |
| 393 | 1196 | CGPG5750 | 73112 | SENSE |
| 394 | 1197 | CGPG5751 | 73988 | SENSE |
| 395 | 1198 | CGPG577 | 10908 | ANTI-SENSE |
| 395 | 1198 | CGPG577 | 11147 | SENSE |
| 396 | 1199 | CGPG5780 | 72909 | SENSE |
| 397 | 1200 | CGPG5793 | 73987 | SENSE |
| 398 | 1201 | CGPG5795 | 72922 | SENSE |
| / | / | / | / | / |
| 399 | 1202 | CGPG5796 | 73036 | SENSE |
| 400 | 1203 | CGPG5800 | 72958 | SENSE |
| 401 | 1204 | CGPG5812 | 77006 | SENSE |
| 402 | 1205 | CGPG5815 | 74732 | SENSE |
| 403 | 1206 | CGPG5838 | 74333 | SENSE |
| 404 | 1207 | CGPG5844 | 74735 | SENSE |
| 405 | 1208 | CGPG5846 | 74736 | SENSE |
| 406 | 1209 | CGPG5851 | 74737 | SENSE |
| 407 | 1210 | CGPG5857 | 76657 | SENSE |
| 408 | 1211 | CGPG5862 | 76113 | SENSE |
| 409 | 1212 | CGPG5863 | 74747 | SENSE |
| 410 | 1213 | CGPG5867 | 77309 | SENSE |
| 411 | 1214 | CGPG5872 | 74322 | SENSE |
| 412 | 1215 | CGPG5913 | 76212 | SENSE |
| 413 | 1216 | CGPG5922 | 76514 | SENSE |
| 414 | 1217 | CGPG5961 | 75242 | SENSE |
| 415 | 1218 | CGPG5964 | 77324 | SENSE |
| 416 | 1219 | CGPG5968 | 74350 | SENSE |
| 417 | 1220 | CGPG5984 | 77606 | SENSE |
| 418 | 1221 | CGPG5991 | 76530 | SENSE |
| 419 | 1222 | CGPG6006 | 76716 | SENSE |
| 420 | 1223 | CGPG6015 | 77328 | SENSE |
| 421 | 1224 | CGPG603 | 12204 | SENSE |
| 422 | 1225 | CGPG6046 | 77011 | SENSE |
| 423 | 1226 | CGPG6063 | 77607 | SENSE |
| 424 | 1227 | CGPG6083 | 74612 | SENSE |
| 425 | 1228 | CGPG6092 | 76126 | SENSE |
| 426 | 1229 | CGPG6104 | 74376 | SENSE |
| 427 | 1230 | CGPG6106 | 74377 | SENSE |
| 428 | 1231 | CGPG6111 | 74381 | SENSE |
| 429 | 1232 | CGPG6113 | 78364 | SENSE |
| 430 | 1233 | CGPG6125 | 74623 | SENSE |
| 431 | 1234 | CGPG6132 | 74668 | SENSE |
| 432 | 1235 | CGPG6137 | 74629 | SENSE |
| 433 | 1236 | CGPG6147 | 74635 | SENSE |
| 434 | 1237 | CGPG6152 | 74638 | SENSE |
| 435 | 1238 | CGPG6154 | 76721 | SENSE |
| 436 | 1239 | CGPG6170 | 78365 | SENSE |
| 437 | 1240 | CGPG6171 | 74655 | SENSE |
| 438 | 1241 | CGPG6177 | 74660 | SENSE |

TABLE 2-continued

| NUC SEQ ID NO | PEP SEQ ID NO | Gene ID | Construct ID | Orientation |
|---|---|---|---|---|
| 439 | 1242 | CGPG6181 | 74661 | SENSE |
| 440 | 1243 | CGPG6188 | 75259 | SENSE |
| 441 | 1244 | CGPG6202 | 75282 | SENSE |
| 442 | 1245 | CGPG6217 | 76724 | SENSE |
| 443 | 1246 | CGPG623 | 12350 | ANTI-SENSE |
| 444 | 1247 | CGPG6239 | 76522 | SENSE |
| 445 | 1248 | CGPG6244 | 77903 | SENSE |
| 446 | 1249 | CGPG6254 | 76653 | SENSE |
| 447 | 1250 | CGPG6266 | 76524 | SENSE |
| 448 | 1251 | CGPG627 | 11356 | SENSE |
| 449 | 1252 | CGPG6271 | 75275 | SENSE |
| 450 | 1253 | CGPG6278 | 76225 | SENSE |
| 451 | 1254 | CGPG6288 | 75281 | SENSE |
| 452 | 1255 | CGPG6309 | 74384 | SENSE |
| 453 | 1256 | CGPG633 | 71238 | SENSE |
| 454 | 1257 | CGPG635 | 12354 | ANTI-SENSE |
| 455 | 1258 | CGPG6350 | 76236 | SENSE |
| 456 | 1259 | CGPG6358 | 74682 | SENSE |
| 457 | 1260 | CGPG6365 | 73425 | SENSE |
| 458 | 1261 | CGPG6374 | 73438 | SENSE |
| 459 | 1262 | CGPG6377 | 73474 | SENSE |
| 460 | 1263 | CGPG638 | 70850 | SENSE |
| 461 | 1264 | CGPG6397 | 73429 | SENSE |
| 462 | 1265 | CGPG6398 | 73441 | SENSE |
| 463 | 1266 | CGPG6408 | 73466 | SENSE |
| 464 | 1267 | CGPG6415 | 73455 | SENSE |
| 465 | 1268 | CGPG6421 | 73432 | SENSE |
| 466 | 1269 | CGPG6442 | 73435 | SENSE |
| 467 | 1270 | CGPG6443 | 77726 | SENSE |
| 468 | 1271 | CGPG6446 | 73483 | SENSE |
| 469 | 1272 | CGPG6453 | 73472 | SENSE |
| 470 | 1273 | CGPG6466 | 73526 | SENSE |
| 471 | 1274 | CGPG6467 | 73538 | SENSE |
| 472 | 1275 | CGPG6470 | 73574 | SENSE |
| 473 | 1276 | CGPG6475 | 73539 | SENSE |
| 474 | 1277 | CGPG6477 | 73563 | SENSE |
| 475 | 1278 | CGPG6478 | 73575 | SENSE |
| 476 | 1279 | CGPG6493 | 73565 | SENSE |
| 477 | 1280 | CGPG6506 | 73531 | SENSE |
| 478 | 1281 | CGPG6518 | 73592 | SENSE |
| 479 | 1282 | CGPG6546 | 74149 | SENSE |
| 480 | 1283 | CGPG6556 | 74174 | SENSE |
| 481 | 1284 | CGPG6562 | 74151 | SENSE |
| 482 | 1285 | CGPG6566 | 74104 | SENSE |
| 483 | 1286 | CGPG6571 | 74164 | SENSE |
| 484 | 1287 | CGPG6576 | 74129 | SENSE |
| 485 | 1288 | CGPG659 | 72340 | SENSE |
| 486 | 1289 | CGPG6594 | 74155 | SENSE |
| 487 | 1290 | CGPG6603 | 74168 | SENSE |
| 488 | 1291 | CGPG6608 | 74133 | SENSE |
| 489 | 1292 | CGPG6634 | 74160 | SENSE |
| 490 | 1293 | CGPG6662 | 74485 | SENSE |
| 491 | 1294 | CGPG6667 | 74450 | SENSE |
| 492 | 1295 | CGPG6678 | 74487 | SENSE |
| 493 | 1296 | CGPG6695 | 74406 | SENSE |
| 494 | 1297 | CGPG6699 | 74454 | SENSE |
| 495 | 1298 | CGPG670 | 11361 | SENSE |
| 496 | 1299 | CGPG6705 | 74431 | SENSE |
| 497 | 1300 | CGPG6735 | 74411 | SENSE |
| 498 | 1301 | CGPG6744 | 74424 | SENSE |
| 499 | 1302 | CGPG6753 | 74525 | SENSE |
| 500 | 1303 | CGPG6757 | 74573 | SENSE |
| 501 | 1304 | CGPG6803 | 75827 | SENSE |
| 502 | 1305 | CGPG6806 | 77329 | SENSE |
| 503 | 1306 | CGPG6811 | 77330 | SENSE |
| 504 | 1307 | CGPG6812 | 75830 | SENSE |
| 505 | 1308 | CGPG6815 | 75832 | SENSE |
| 506 | 1309 | CGPG6827 | 75836 | SENSE |
| 507 | 1310 | CGPG6830 | 77034 | SENSE |
| 508 | 1311 | CGPG6839 | 76255 | SENSE |
| 509 | 1312 | CGPG6859 | 76542 | SENSE |
| 510 | 1313 | CGPG6864 | 77511 | SENSE |
| 511 | 1314 | CGPG6877 | 76261 | SENSE |
| 512 | 1315 | CGPG6878 | 78456 | SENSE |
| 513 | 1316 | CGPG6880 | 77041 | SENSE |
| 514 | 1317 | CGPG6886 | 76546 | SENSE |
| 515 | 1318 | CGPG6887 | 75848 | SENSE |
| 516 | 1319 | CGPG6895 | 77515 | SENSE |
| 517 | 1320 | CGPG6896 | 76266 | SENSE |
| 518 | 1321 | CGPG6903 | 75852 | SENSE |
| 519 | 1322 | CGPG6912 | 76556 | SENSE |
| 520 | 1323 | CGPG6933 | 77523 | SENSE |
| 521 | 1324 | CGPG6942 | 75863 | SENSE |
| 522 | 1325 | CGPG6944 | 77052 | SENSE |
| 523 | 1326 | CGPG6949 | 75865 | SENSE |
| 524 | 1327 | CGPG6969 | 76551 | SENSE |
| 525 | 1328 | CGPG6989 | 76280 | SENSE |
| 526 | 1329 | CGPG6991 | 75874 | SENSE |
| 527 | 1330 | CGPG7003 | 75879 | SENSE |
| 528 | 1331 | CGPG7009 | 75880 | SENSE |
| 529 | 1332 | CGPG7037 | 77519 | SENSE |
| 530 | 1333 | CGPG7051 | 76745 | SENSE |
| 531 | 1334 | CGPG7062 | 76554 | SENSE |
| 532 | 1335 | CGPG7064 | 76746 | SENSE |
| 533 | 1336 | CGPG7086 | 76750 | SENSE |
| 534 | 1337 | CGPG7109 | 76621 | SENSE |
| 535 | 1338 | CGPG7123 | 76623 | SENSE |
| 536 | 1339 | CGPG7136 | 76461 | SENSE |
| 537 | 1340 | CGPG7147 | 76462 | SENSE |
| 538 | 1341 | CGPG7159 | 78987 | SENSE |
| 539 | 1342 | CGPG7186 | 76568 | SENSE |
| 540 | 1343 | CGPG7222 | 76176 | SENSE |
| 541 | 1344 | CGPG7224 | 76177 | SENSE |
| 542 | 1345 | CGPG7233 | 78380 | SENSE |
| 543 | 1346 | CGPG7238 | 76629 | SENSE |
| 544 | 1347 | CGPG7253 | 76189 | SENSE |
| 545 | 1348 | CGPG7255 | 76761 | SENSE |
| 546 | 1349 | CGPG7286 | 78608 | SENSE |
| 547 | 1350 | CGPG7292 | 78115 | SENSE |
| 548 | 1351 | CGPG7301 | 74873 | SENSE |
| 549 | 1352 | CGPG7305 | 74826 | SENSE |
| 550 | 1353 | CGPG7307 | 74850 | SENSE |
| 551 | 1354 | CGPG7318 | 74887 | SENSE |
| 552 | 1355 | CGPG7319 | 74804 | SENSE |
| 553 | 1356 | CGPG7345 | 74831 | SENSE |
| 554 | 1357 | CGPG7368 | 74822 | SENSE |
| 555 | 1358 | CGPG7385 | 74836 | SENSE |
| 556 | 1359 | CGPG7391 | 74901 | SENSE |
| 557 | 1360 | CGPG7405 | 74974 | SENSE |
| 558 | 1361 | CGPG7415 | 74904 | SENSE |
| 559 | 1362 | CGPG7416 | 74916 | SENSE |
| 560 | 1363 | CGPG7420 | 74964 | SENSE |
| 561 | 1364 | CGPG7432 | 74918 | SENSE |
| 562 | 1365 | CGPG7436 | 74966 | SENSE |
| 563 | 1366 | CGPG7445 | 74979 | SENSE |
| 564 | 1367 | CGPG7465 | 74934 | SENSE |
| 565 | 1368 | CGPG7473 | 77814 | SENSE |
| 566 | 1369 | CGPG7489 | 75387 | SENSE |
| 567 | 1370 | CGPG7492 | 75328 | SENSE |
| 568 | 1371 | CGPG7499 | 77808 | SENSE |
| 569 | 1372 | CGPG7505 | 75389 | SENSE |
| 570 | 1373 | CGPG7507 | 75318 | SENSE |
| 571 | 1374 | CGPG7508 | 75330 | SENSE |
| 572 | 1375 | CGPG7509 | 75342 | SENSE |
| 573 | 1376 | CGPG7511 | 75366 | SENSE |
| 574 | 1377 | CGPG7515 | 75319 | SENSE |
| 575 | 1378 | CGPG7521 | 75391 | SENSE |
| 576 | 1379 | CGPG7540 | 75334 | SENSE |
| 577 | 1380 | CGPG7547 | 75323 | SENSE |
| 578 | 1381 | CGPG7561 | 75396 | SENSE |
| 579 | 1382 | CGPG7562 | 75401 | SENSE |
| 580 | 1383 | CGPG7563 | 75413 | SENSE |
| 581 | 1384 | CGPG7567 | 75461 | SENSE |
| 582 | 1385 | CGPG7568 | 75473 | SENSE |
| 583 | 1386 | CGPG7571 | 77817 | SENSE |
| 584 | 1387 | CGPG7587 | 75416 | SENSE |
| 585 | 1388 | CGPG7591 | 75464 | SENSE |
| 586 | 1389 | CGPG7597 | 75441 | SENSE |
| 587 | 1390 | CGPG7606 | 75454 | SENSE |
| 588 | 1391 | CGPG7633 | 75493 | SENSE |
| 589 | 1392 | CGPG7637 | 75446 | SENSE |
| 590 | 1393 | CGPG7649 | 75495 | SENSE |
| 591 | 1394 | CGPG7658 | 75705 | SENSE |
| 592 | 1395 | CGPG7664 | 77818 | SENSE |

TABLE 2-continued

| NUC SEQ ID NO | PEP SEQ ID NO | Gene ID | Construct ID | Orientation |
|---|---|---|---|---|
| 593 | 1396 | CGPG7666 | 75525 | SENSE |
| 594 | 1397 | CGPG7668 | 75549 | SENSE |
| 595 | 1398 | CGPG7742 | 75582 | SENSE |
| 596 | 1399 | CGPG7746 | 75535 | SENSE |
| 597 | 1400 | CGPG7747 | 75547 | SENSE |
| 598 | 1401 | CGPG7752 | 75512 | SENSE |
| 599 | 1402 | CGPG7766 | 75673 | SENSE |
| 600 | 1403 | CGPG7770 | 75626 | SENSE |
| 601 | 1404 | CGPG7774 | 75674 | SENSE |
| 602 | 1405 | CGPG7777 | 75615 | SENSE |
| 603 | 1406 | CGPG7778 | 75627 | SENSE |
| 604 | 1407 | CGPG7786 | 75628 | SENSE |
| 605 | 1408 | CGPG7788 | 75652 | SENSE |
| 606 | 1409 | CGPG7792 | 75605 | SENSE |
| 607 | 1410 | CGPG78 | 70228 | SENSE |
| 608 | 1411 | CGPG783 | 13302 | ANTI-SENSE |
| 609 | 1412 | CGPG7832 | 75610 | SENSE |
| 610 | 1413 | CGPG7841 | 75623 | SENSE |
| 611 | 1414 | CGPG7845 | 75671 | SENSE |
| 612 | 1415 | CGPG7847 | 75695 | SENSE |
| 613 | 1416 | CGPG7851 | 75648 | SENSE |
| 614 | 1417 | CGPG7853 | 75672 | SENSE |
| 615 | 1418 | CGPG7857 | 75713 | SENSE |
| 616 | 1419 | CGPG7865 | 75714 | SENSE |
| 617 | 1420 | CGPG7869 | 75762 | SENSE |
| 618 | 1421 | CGPG7891 | 77954 | SENSE |
| 619 | 1422 | CGPG7892 | 77955 | SENSE |
| 620 | 1423 | CGPG7906 | 77541 | SENSE |
| 621 | 1424 | CGPG7924 | 78131 | SENSE |
| 622 | 1425 | CGPG7934 | 78134 | SENSE |
| 623 | 1426 | CGPG7949 | 77554 | SENSE |
| 624 | 1427 | CGPG7954 | 78992 | SENSE |
| 625 | 1428 | CGPG7964 | 77557 | SENSE |
| 626 | 1429 | CGPG7968 | 78128 | SENSE |
| 627 | 1430 | CGPG7969 | 77560 | SENSE |
| 628 | 1431 | CGPG7972 | 77561 | SENSE |
| 629 | 1432 | CGPG7982 | 77958 | SENSE |
| 630 | 1433 | CGPG7985 | 77563 | SENSE |
| 631 | 1434 | CGPG7993 | 78994 | SENSE |
| 632 | 1435 | CGPG8 | 74508 | SENSE |
| 633 | 1436 | CGPG80 | 70229 | SENSE |
| 634 | 1437 | CGPG8001 | 77959 | SENSE |
| 635 | 1438 | CGPG8009 | 77567 | SENSE |
| 636 | 1439 | CGPG802 | 11749 | ANTI-SENSE |
| 637 | 1440 | CGPG8049 | 77578 | SENSE |
| 638 | 1441 | CGPG806 | 11751 | ANTI-SENSE |
| 639 | 1442 | CGPG8060 | 77963 | SENSE |
| 640 | 1443 | CGPG8068 | 77925 | SENSE |
| 641 | 1444 | CGPG8072 | 77927 | SENSE |
| 642 | 1445 | CGPG8075 | 77345 | SENSE |
| 643 | 1446 | CGPG81 | 70230 | SENSE |
| 644 | 1447 | CGPG8100 | 77353 | SENSE |
| 645 | 1448 | CGPG8101 | 77354 | SENSE |
| 646 | 1449 | CGPG8104 | 77355 | SENSE |
| 647 | 1450 | CGPG8108 | 77588 | SENSE |
| 648 | 1451 | CGPG8116 | 77591 | SENSE |
| 649 | 1452 | CGPG8125 | 77594 | SENSE |
| 650 | 1453 | CGPG8134 | 77595 | SENSE |
| 651 | 1454 | CGPG8138 | 77364 | SENSE |
| 652 | 1455 | CGPG8156 | 78904 | SENSE |
| 653 | 1456 | CGPG8159 | 77937 | SENSE |
| 654 | 1457 | CGPG8163 | 77369 | SENSE |
| 655 | 1458 | CGPG8179 | 77940 | SENSE |
| 656 | 1459 | CGPG8193 | 78746 | SENSE |
| 657 | 1460 | CGPG8197 | 77372 | SENSE |
| 658 | 1461 | CGPG8198 | 78126 | SENSE |
| 659 | 1462 | CGPG8204 | 77951 | SENSE |
| 660 | 1463 | CGPG8211 | 75901 | SENSE |
| 661 | 1464 | CGPG823 | 12123 | ANTI-SENSE |
| 662 | 1465 | CGPG8234 | 75987 | SENSE |
| 663 | 1466 | CGPG8238 | 75940 | SENSE |
| 664 | 1467 | CGPG8260 | 75919 | SENSE |
| 665 | 1468 | CGPG8267 | 75908 | SENSE |
| 666 | 1469 | CGPG8268 | 75920 | SENSE |
| 667 | 1470 | CGPG8274 | 75992 | SENSE |
| 668 | 1471 | CGPG8277 | 75933 | SENSE |
| 669 | 1472 | CGPG8279 | 77965 | SENSE |
| 670 | 1473 | CGPG8284 | 77966 | SENSE |
| 671 | 1474 | CGPG8345 | 77972 | SENSE |
| 672 | 1475 | CGPG8408 | 78522 | SENSE |
| 673 | 1476 | CGPG842 | 12194 | ANTI-SENSE |
| 674 | 1477 | CGPG8421 | 78525 | SENSE |
| 675 | 1478 | CGPG8435 | 78527 | SENSE |
| 676 | 1479 | CGPG8440 | 78917 | SENSE |
| 677 | 1480 | CGPG8453 | 78920 | SENSE |
| 678 | 1481 | CGPG8470 | 78535 | SENSE |
| 679 | 1482 | CGPG8479 | 78538 | SENSE |
| 680 | 1483 | CGPG8489 | 78922 | SENSE |
| 681 | 1484 | CGPG8498 | 77984 | SENSE |
| 682 | 1485 | CGPG85 | 73938 | SENSE |
| 683 | 1486 | CGPG8501 | 78621 | SENSE |
| 684 | 1487 | CGPG8507 | 77990 | SENSE |
| 685 | 1488 | CGPG8509 | 78386 | SENSE |
| 686 | 1489 | CGPG8515 | 78001 | SENSE |
| 687 | 1490 | CGPG8517 | 78543 | SENSE |
| 688 | 1491 | CGPG8518 | 78002 | SENSE |
| 689 | 1492 | CGPG852 | 12259 | SENSE |
| 690 | 1493 | CGPG8523 | 78005 | SENSE |
| 691 | 1494 | CGPG8528 | 78008 | SENSE |
| 692 | 1495 | CGPG8552 | 78019 | SENSE |
| 693 | 1496 | CGPG8553 | 78020 | SENSE |
| 694 | 1497 | CGPG8562 | 78023 | SENSE |
| 695 | 1498 | CGPG8567 | 78548 | SENSE |
| 696 | 1499 | CGPG8580 | 78161 | SENSE |
| 697 | 1500 | CGPG8589 | 78162 | SENSE |
| 698 | 1501 | CGPG8590 | 78033 | SENSE |
| 699 | 1502 | CGPG8592 | 78622 | SENSE |
| 700 | 1503 | CGPG8594 | 78036 | SENSE |
| 701 | 1504 | CGPG8606 | 78043 | SENSE |
| 702 | 1505 | CGPG8628 | 78165 | SENSE |
| 703 | 1506 | CGPG8648 | 78066 | SENSE |
| 704 | 1507 | CGPG8654 | 78069 | SENSE |
| 705 | 1508 | CGPG8668 | 78183 | SENSE |
| 706 | 1509 | CGPG8678 | 78170 | SENSE |
| 707 | 1510 | CGPG8694 | 78953 | SENSE |
| 708 | 1511 | CGPG8702 | 78929 | SENSE |
| 709 | 1512 | CGPG8737 | 78564 | SENSE |
| 710 | 1513 | CGPG8745 | 78566 | SENSE |
| 711 | 1514 | CGPG8748 | 78591 | SENSE |
| 712 | 1515 | CGPG8749 | 78181 | SENSE |
| 713 | 1516 | CGPG8770 | 78190 | SENSE |
| 714 | 1517 | CGPG8777 | 78571 | SENSE |
| 715 | 1518 | CGPG8781 | 78933 | SENSE |
| 716 | 1519 | CGPG8786 | 78573 | SENSE |
| 717 | 1520 | CGPG8792 | 78632 | SENSE |
| 718 | 1521 | CGPG8801 | 78959 | SENSE |
| 719 | 1522 | CGPG8809 | 78191 | SENSE |
| 720 | 1523 | CGPG8840 | 78595 | SENSE |
| 721 | 1524 | CGPG8850 | 78646 | SENSE |
| 722 | 1525 | CGPG8870 | 76325 | SENSE |
| 723 | 1526 | CGPG8871 | 76337 | SENSE |
| 724 | 1527 | CGPG8872 | 76349 | SENSE |
| 725 | 1528 | CGPG8876 | 76302 | SENSE |
| 726 | 1529 | CGPG8902 | 76329 | SENSE |
| 727 | 1530 | CGPG8904 | 76353 | SENSE |
| 728 | 1531 | CGPG8907 | 76389 | SENSE |
| 729 | 1532 | CGPG8914 | 76378 | SENSE |
| 730 | 1533 | CGPG8931 | 76392 | SENSE |
| 731 | 1534 | CGPG8933 | 76321 | SENSE |
| 732 | 1535 | CGPG8935 | 76345 | SENSE |
| 733 | 1536 | CGPG8938 | 76381 | SENSE |
| 734 | 1537 | CGPG8944 | 76358 | SENSE |
| 735 | 1538 | CGPG895 | 12629 | SENSE |
| 736 | 1539 | CGPG8950 | 76335 | SENSE |
| 737 | 1540 | CGPG8961 | 76372 | SENSE |
| 738 | 1541 | CGPG8963 | 76396 | SENSE |
| 739 | 1542 | CGPG898 | 72314 | SENSE |
| 740 | 1543 | CGPG8993 | 77840 | SENSE |
| 741 | 1544 | CGPG8994 | 76886 | SENSE |
| 742 | 1545 | CGPG8995 | 76803 | SENSE |
| 743 | 1546 | CGPG90 | 10302 | ANTI-SENSE |
| 744 | 1547 | CGPG900 | 71107 | SENSE |
| 745 | 1548 | CGPG9002 | 76887 | SENSE |
| 746 | 1549 | CGPG9009 | 77842 | SENSE |

TABLE 2-continued

| NUC SEQ ID NO | PEP SEQ ID NO | Gene ID | Construct ID | Orientation |
|---|---|---|---|---|
| 747 | 1550 | CGPG9011 | 76805 | SENSE |
| 748 | 1551 | CGPG9012 | 76817 | SENSE |
| 749 | 1552 | CGPG9017 | 77843 | SENSE |
| 750 | 1553 | CGPG9025 | 77844 | SENSE |
| 751 | 1554 | CGPG9026 | 76890 | SENSE |
| 752 | 1555 | CGPG9032 | 77839 | SENSE |
| 753 | 1556 | CGPG9040 | 76868 | SENSE |
| 754 | 1557 | CGPG9044 | 76821 | SENSE |
| 755 | 1558 | CGPG9048 | 76869 | SENSE |
| 756 | 1559 | CGPG9049 | 76881 | SENSE |
| 757 | 1560 | CGPG9058 | 76894 | SENSE |
| 758 | 1561 | CGPG906 | 11930 | ANTI-SENSE |
| 759 | 1562 | CGPG9070 | 76848 | SENSE |
| 760 | 1563 | CGPG9075 | 76901 | SENSE |
| 761 | 1564 | CGPG9084 | 76914 | SENSE |
| 762 | 1565 | CGPG9094 | 76939 | SENSE |
| 763 | 1566 | CGPG9098 | 76987 | SENSE |
| 764 | 1567 | CGPG9099 | 76904 | SENSE |
| 765 | 1568 | CGPG9110 | 76941 | SENSE |
| 766 | 1569 | CGPG9119 | 77113 | SENSE |
| 767 | 1570 | CGPG9125 | 77185 | SENSE |
| 768 | 1571 | CGPG913 | 12911 | SENSE |
| 769 | 1572 | CGPG9136 | 77127 | SENSE |
| 770 | 1573 | CGPG9156 | 77177 | SENSE |
| 771 | 1574 | CGPG9164 | 77178 | SENSE |
| 772 | 1575 | CGPG9172 | 77179 | SENSE |
| 773 | 1576 | CGPG9173 | 77191 | SENSE |
| 774 | 1577 | CGPG9185 | 77145 | SENSE |
| 775 | 1578 | CGPG9187 | 77169 | SENSE |
| 776 | 1579 | CGPG9190 | 77110 | SENSE |
| 777 | 1580 | CGPG9193 | 77146 | SENSE |
| 778 | 1581 | CGPG9195 | 77170 | SENSE |
| 779 | 1582 | CGPG9203 | 77171 | SENSE |
| 780 | 1583 | CGPG9209 | 77148 | SENSE |
| 781 | 1584 | CGPG921 | 11933 | ANTI-SENSE |
| 782 | 1585 | CGPG9210 | 77160 | SENSE |
| 783 | 1586 | CGPG9211 | 77172 | SENSE |
| 784 | 1587 | CGPG9212 | 77184 | SENSE |
| 785 | 1588 | CGPG9216 | 77225 | SENSE |
| 786 | 1589 | CGPG9226 | 77250 | SENSE |
| 787 | 1590 | CGPG9252 | 77277 | SENSE |
| 788 | 1591 | CGPG9281 | 77245 | SENSE |
| 789 | 1592 | CGPG9289 | 77246 | SENSE |
| 790 | 1593 | CGPG9298 | 77462 | SENSE |
| 791 | 1594 | CGPG9299 | 77414 | SENSE |
| 792 | 1595 | CGPG9304 | 77439 | SENSE |
| 793 | 1596 | CGPG9310 | 77463 | SENSE |
| 794 | 1597 | CGPG9316 | 77488 | SENSE |
| 795 | 1598 | CGPG9317 | 77441 | SENSE |
| 796 | 1599 | CGPG9318 | 77464 | SENSE |
| 797 | 1600 | CGPG9324 | 77442 | SENSE |
| 798 | 1601 | CGPG9357 | 77419 | SENSE |
| 799 | 1602 | CGPG965 | 12444 | SENSE |
| 800 | 1603 | CGPG970 | 11791 | ANTI-SENSE |
| 800 | 1603 | CGPG970 | 12445 | SENSE |
| 801 | 1604 | CGPG982 | 71249 | SENSE |
| 802 | 1605 | CGPG994 | 71237 | SENSE |
| 803 | 1606 | CGPG996 | 12315 | ANTI-SENSE |
| 803 | 1606 | CGPG996 | 12366 | SENSE |

Recombinant DNA

DNA for use in the present invention to improve traits in plants have a nucleotide sequence of SEQ ID NO:1 through SEQ ID NO:803, as well as the homologs of such DNA molecules. A subset of the DNA for gene suppression aspects of the invention includes fragments of the disclosed full polynucleotides consisting of oligonucleotides of 21 or more consecutive nucleotides. In some embodiments, the nucleotides for gene suppression can be 18, 19, 20, 22, 23, 24, 25, 26, 27, 28, 29, 30 or more consecutive nucleotides. Oligonucleotides having a sequence selected from the group consisting of SEQ ID NO: 1 through SEQ ID NO: 803 can be as probes and primers for detection of the polynucleotides used in the invention. Other embodiments this invention are variants of the DNA. Such variants can be naturally occurring, including DNA from homologous genes from the same or a different species, or can be non-natural variants, for example DNA synthesized using chemical synthesis methods, or generated using recombinant DNA techniques. Degeneracy of the genetic code provides the possibility to substitute at least one base of the protein encoding sequence of a gene with a different base without causing the amino acid sequence of the polypeptide produced from the gene to be changed. Hence, a DNA in the present invention can have any base sequence that has been changed from the sequences provided herein by substitution in accordance with degeneracy of the genetic code.

Homologs of the genes providing DNA demonstrated uses in improving traits in model plants disclosed herein will generally have significant identity with the DNA disclosed herein. DNA is substantially identical to a reference DNA if, when the sequences of the polynucleotides are optimally aligned there is about 60% nucleotide equivalence; about 70% equivalence; about 80% equivalence; about 85% equivalence; about 90%; about 95%; about 98%, about 99% equivalence or about 99.5 equivalence over a comparison window. A comparison window can be at least 50-100 nucleotides or the entire length of the polynucleotide provided herein. Optimal alignment of sequences for aligning a comparison window can be conducted by algorithms; for example by computerized implementations of these algorithms (such as, the Wisconsin Genetics Software Package Release 7.0-10.0, Genetics Computer Group, 575 Science Dr., Madison, Wis.). The reference polynucleotide can be a full-length molecule or a portion of a longer molecule. In one embodiment, the window of comparison for determining polynucleotide identity of protein encoding sequences is the entire coding region.

Proteins used for imparting enhanced traits are entire proteins or at least a sufficient portion of the entire protein to impart the relevant biological activity of the protein. Proteins used for generation of transgenic plants having enhanced traits include the proteins with an amino acid sequence provided herein as SEQ ID NO: 804 through SEQ ID NO: 1606, as well as homologs of such proteins.

Homologs of the proteins in the invention are identified by comparison of the amino acid sequence of the protein to amino acid sequences of proteins from the same or different plant sources, e.g., manually or by using known homology-based search algorithms such as those commonly known and referred to as BLAST, FASTA, and Smith-Waterman. As used herein, a homolog is a protein from the same or a different organism that performs the same biological function as the polypeptide to which it is compared. An orthologous relation between two organisms is not necessarily manifest as a one-to-one correspondence between two genes, because a gene can be duplicated or deleted after organism phylogenetic separation, such as speciation. For a given protein, there can be no ortholog or more than one ortholog. Other complicating factors include alternatively spliced transcripts from the same gene, limited gene identification, redundant copies of the same gene with different sequence lengths or corrected sequence. A local sequence alignment program, e.g., BLAST, can be used to search a database of sequences to find similar sequences, and the summary Expectation value (E-value) used to measure the sequence base similarity. As a protein hit with the best E-value for a particular organism could be an ortholog or the only ortholog, a reciprocal BLAST search is used in the present invention to filter hit sequences with significant E-values for ortholog identification. The reciprocal BLAST entails search of the significant hits against a database of amino acid sequences from the base organism that are similar to the sequence of the query protein. A hit is a likely ortholog, when the reciprocal BLAST's best hit is the query protein itself or a protein encoded by a duplicated gene after speciation. Thus, homolog is used herein to describe proteins that are assumed to have functional similarity by inference from sequence base similarity. The relationship of homologs with amino acid sequences of SEQ ID NO: 1607 to SEQ ID NO: 94613 to the proteins with amino acid sequences of SEQ ID NO: 804 to SEQ ID NO: 1606 are found in the listing of Table 19.

Other functional homolog proteins differ in one or more amino acids from those of a trait-improving protein disclosed herein as the result of one or more of the well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosile asparagine, and glutamine; and (4) neutral nonpolar (hydrophobic) amino acids such as alanilne, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention comprises proteins that differ in one or more amino acids from those of a described protein sequence as the result of deletion or insertion of one or more amino acids in a native sequence.

Homologs of the trait-improving proteins provided herein will generally demonstrate significant sequence identity. Of particular interest are proteins having at least about 50% sequence identity, at least about 70% sequence identity or higher, e.g., at least about 80% sequence identity with an amino acid sequence of SEQ ID NO: 804 to SEQ ID NO: 1606. Additional embodiments also include those with higher identity, e.g., about 90%, about 92.5%, about 95%, about 98%, about 99%, or to about 99.5% identity. Identity of protein homologs is determined by optimally aligning the amino acid sequence of a putative protein homolog with a defined amino acid sequence and by calculating the percentage of identical and conservatively substituted amino acids over the window of comparison. The window of comparison for determining identity can be the entire amino acid sequence disclosed herein, e.g., the full sequence of any of SEQ ID NO: 804 to SEQ ID NO: 1606. Genes that are homologous to each other can be grouped into families and included in multiple sequence alignments. Then a consensus sequence for each group can be derived. This analysis enables the derivation of conserved and class- (family) specific residues or motifs that are functionally important. These conserved residues and motifs can be further validated with 3D protein structure if available. The consensus sequence can be used to define the full scope of the invention, e.g., to identify proteins with a homolog relationship. Thus, the present invention contemplates that protein homologs include proteins with an amino acid sequence that has at least 90% identity to such a consensus amino acid sequence sequences.

Discovery of Trait-Improving Recombinant DNA

To identify nuclei with recombinant DNA that confer enhanced traits to plants, *Arabidopsis thaliana* was transformed with a candidate recombinant DNA construct and screened for an enhanced trait.

*Arabidopsis thaliana* is used a model for genetics and metabolism in plants. *Arabidopsis* has a small genome, and well-documented studies are available. It is easy to grow in large numbers and mutants defining important genetically controlled mechanisms are either available, or can readily be obtained. Various methods to introduce and express isolated homologous genes are available (see Koncz, et al., Methods in *Arabidopsis* Research et al., (1992), World Scientific, New Jersey, New Jersey, in "Preface").

A two-step screening process was employed which comprised two passes of trait characterization to ensure that the trait modification was dependent on expression of the recombinant DNA, but not due to the chromosomal location of the integration of the transgene. Twelve independent transgenic lines for each recombinant DNA construct were established and assayed for the transgene expression levels. Five transgenic lines with high transgene expression levels were used in the first pass screen to evaluate the transgene's function in T2 transgenic plants. Subsequently, three transgenic events, which had been shown to have one or more enhanced traits, were further evaluated in the second pass screen to confirm the transgene's ability to impart an enhanced trait. The following Table 3 summarizes the enhanced traits that have been confirmed as provided by a recombinant DNA construct.

In particular, Table 3 reports:

"PEP SEQ ID" which is the amino acid sequence of the protein cognate to the DNA in the recombinant DNA construct corresponding to a protein sequence of a SEQ ID NO. in the Sequence Listing.

"construct_id" is an arbitrary name for the recombinant DNA describe more particularly in Table 1.

"annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit.

"description" refers to the description of the top BLAST hit.

"e-value" provides the expectation value for the BLAST hit.

"% id" refers to the percentage of identically matched amino acid residues along the length of the portion of the sequences which is aligned by BLAST between the sequence of interest provided herein and the hit sequence in GenBank.

"traits" identify by two letter codes the confirmed enhancement in a transgenic plant provided by the recombinant DNA. The codes for enhanced traits are:

"CK" which indicates cold tolerance enhancement identified under a cold shock tolerance screen;

"CS" which indicates cold tolerance enhancement identified by a cold germination tolerance screen;

"DS" which indicates drought tolerance enhancement identified by a soil drought stress tolerance screen;

"PEG" which indicates osmotic stress tolerance enhancement identified by a PEG induced osmotic stress tolerance screen;

"HS" which indicates heat stress tolerance enhancement identified by a heat stress tolerance screen;

"SS" which indicates high salinity stress tolerance enhancement identified by a salt stress tolerance screen;

"LN" which indicates nitrogen use efficiency enhancement identified by a limited nitrogen tolerance screen;

"LL" which indicates attenuated shade avoidance response identified by a shade tolerance screen under a low light condition;

"PP" which indicates enhanced growth and development at early stages identified by an early plant growth and development screen;

TABLE 3

| PEP SEQ ID NO | Construct | E-value | % Id | Description | traits | | |
|---|---|---|---|---|---|---|---|
| 804 | 70244 | 0 | 95 | ref\|NP_193113.1\|CYP83A1 (CYTOCHROME P450 83A1); oxygen binding [*Arabidopsis thaliana*] | HS | | |
| 805 | 71108 | 3.00E−54 | 100 | gb\|AAB61093.1\|F20P5.4 gene product [*Arabidopsis thaliana*] | LL | | |
| 806 | 12816 | 0 | 79 | ref\|NP_190754.2\|CAX3 (cation exchanger 3); cation:cation antiporter [*Arabidopsis thaliana*] | LN | | |
| 807 | 12650 | 1.00E−159 | 89 | gb\|AAC25513.1\|AAC25513Strong similarity to hypothetical protein gb\|Y09823 from *A. thaliana*. | LN | | |
| 808 | 12031 | 1.00E−56 | 88 | ref\|NP_179413.1\|unknown protein [*Arabidopsis thaliana*] | LN | | |
| 809 | 12217 | 1.00E−168 | 88 | ref\|NP_194233.1\|unknown protein [*Arabidopsis thaliana*] | LN | | |
| 810 | 12043 | 2.00E−46 | 100 | ref\|NP_194730.1\|unknown protein [*Arabidopsis thaliana*] | PP | | |
| 811 | 12147 | 2.00E−33 | 68 | ref\|NP_190718.1\|unknown protein [*Arabidopsis thaliana*] | LN | | |
| 812 | 13638 | 0 | 100 | ref\|NP_189940.1\|unknown protein [*Arabidopsis thaliana*] | DS | | |
| 813 | 11860 | 2.00E−81 | 93 | ref\|NP_973419.1\|unknown protein [*Arabidopsis thaliana*] | LN | | |
| 814 | 72361 | 1.00E−139 | 93 | ref\|NP_178534.2\|IBR5 (INDOLE-3-BUTYRIC ACID RESPONSE 5); protein tyrosine/serine/threonine phosphatase [*Arabidopsis thaliana*] | CK | | |
| 815 | 12230 | 1.00E−23 | 100 | ref\|NP_564545.1\|TOM6 (TRANSLOCASE OF THE OUTER MITOCHONDRIAL MEMBRANE 6) [*Arabidopsis thaliana*] sp\|Q9XIA7\|TOM6_ARATH Mitochondrial import receptor subunit TOM6 homolog (Translocase of outer membrane 6 kDa subunit homolog) | LN | | |
| 816 | 71626 | 1.00E−47 | 93 | ref\|NP_177455.1\|unknown protein [*Arabidopsis thaliana*] | CK | | |
| 817 | 13454 | 0 | 96 | ref\|NP_566136.1\|armadillo/beta-catenin repeat family protein [*Arabidopsis thaliana*] | LN | | |
| 818 | 12173 | 4.00E−49 | 100 | ref\|NP_186751.1\|ATISU2/ISU2 (IscU-like 2); structural molecule [*Arabidopsis thaliana*] | CK | | |
| 819 | 17806 | 1.00E−35 | 54 | ref\|NP_188341.2\|unknown protein [*Arabidopsis thaliana*] | LN | | |
| 820 | 12011 | 1.00E−144 | 99 | ref\|NP_567393.1\|ATP-binding family protein [*Arabidopsis thaliana*] | LN | | |
| 821 | 72915 | 1.00E−135 | 77 | sp\|Q94A43\|BEH2_ARATHBES1/BZR1 homolog protein 2 | SS | | |
| 822 | 13231 | 1.00E−161 | 96 | ref\|NP_178361.2\|nucleic acid binding [*Arabidopsis thaliana*] | HS | | |
| 823 | 13913 | 1.00E−147 | 88 | ref\|NP_028242.1\|PDV2 (PLASTID DIVISION2) [*Arabidopsis thaliana*] gb\|AAD26950.1\| expressed protein [*Arabidopsis thaliana*] | HS | | |
| 824 | 12749 | 1.00E−140 | 100 | ref\|NP_196620.1\|unknown protein [*Arabidopsis thaliana*] | LN | | |
| 825 | 78901 | 0 | 97 | ref\|NP_565919.1\|COI1 (CORONATINE INSENSITIVE 1); ubiquitin-protein ligase [*Arabidopsis thaliana*] | HS | PP | |
| 826 | 75969 | 0 | 100 | ref\|NP_174005.1\|ATCUL3/ATCUL3A/CUL3/CUL3A (Cullin 3A); protein binding/ubiquitin-protein ligase [*Arabidopsis thaliana*] | CS | HS | |
| 827 | 15606 | 0 | 96 | gb\|AAA32781.1\|cyclin emb\|CAA44169.1\| cyclin [*Arabidopsis thaliana*] | HS | | |
| 828 | 75946 | 0 | 96 | ref\|NP_171797.2\|CUL2 (cullin 2) [*Arabidopsis thaliana*] | LL | | |
| 829 | 13050 | 0 | 97 | ref\|NP_175955.1\|F-box family protein [*Arabidopsis thaliana*] | LN | | |
| 830 | 75958 | 0 | 94 | ref\|NP_177170.1\|lectin protein kinase, putative [*Arabidopsis thaliana*] | HS | LN | |
| 831 | 17333 | 0 | 93 | gb\|AAF02796.1\|AF195115_16Similar to receptor-like protein kinase precursor; F5I10.19 [*Arabidopsis thaliana*] | PP | | |
| 832 | 76002 | 0 | 100 | ref\|NP_193038.1\|MHK; kinase [*Arabidopsis thaliana*] sp\|P43294\|MHK_ARATH Serine/threonine-protein kinase MHK | HS | PEG | |
| 833 | 78735 | 0 | 94 | ref\|NP_187132.1\|protein kinase, putative [*Arabidopsis thaliana*] | LL | PEG | |
| 834 | 13914 | 0 | 100 | ref\|NP_195033.1\|pyruvate decarboxylase, putative [*Arabidopsis thaliana*] | HS | SS | |
| 835 | 14405 | 0 | 92 | ref\|NP_187341.1\|DIN3/LTA1 (DARK INDUCIBLE 3); alpha-ketoacid dehydrogenase [*Arabidopsis thaliana*] | LN | SP | |
| 836 | 75983 | 0 | 100 | ref\|NP_171655.1\|ACS2 (1-Amino-cyclopropane-1-carboxylate synthase 2) [*Arabidopsis thaliana*] | CK | | |

TABLE 3-continued

| PEP SEQ ID NO | Construct | E-value | % Id | Description | traits | |
|---|---|---|---|---|---|---|
| 837 | 70721 | 0 | 94 | ref|NP_851005.1|LPD2 (LIPOAMIDE DEHYDROGENASE 2); FAD binding/dihydrolipoyl dehydrogenase/disulfide oxidoreductase/oxidoreductase [Arabidopsis thaliana] | HS | LN |
| 838 | 13811 | 0 | 92 | ref|NP_178093.1|ATNADP-ME4 (NADP-MALIC ENZYME 4); malate dehydrogenase (oxaloacetate-decarboxylating) (NADP+)/malic enzyme/oxidoreductase, acting on NADH or NADPH, NAD or NADP as acceptor [Arabidopsis thaliana] | DS | |
| 838 | 13828 | 0 | 92 | ref|NP_178093.1|ATNADP-ME4 (NADP-MALIC ENZYME 4); malate dehydrogenase (oxaloacetate-decarboxylating) (NADP+)/malic enzyme/oxidoreductase, acting on NADH or NADPH, NAD or NADP as acceptor [Arabidopsis thaliana] | LN | |
| 839 | 13614 | 1.00E−122 | 96 | ref|NP_176518.1|ribulose-phosphate 3-epimerase, cytosolic, putative/pentose-5-phosphate 3-epimerase, putative [Arabidopsis thaliana] | LN | |
| 840 | 76050 | 0 | 97 | ref|NP_567714.1|AMY1 (ALPHA-AMYLASE-LIKE); alpha-amylase [Arabidopsis thaliana] | CS | |
| 841 | 13038 | 0 | 100 | ref|NP_194382.1|fructose-bisphosphate aldolase, cytoplasmic [Arabidopsis thaliana] | LN | |
| 842 | 13040 | 1.00E−104 | 92 | gb|AAB66906.1|eukaryotic initiation factor (iso)-4F p28 subunit [Arabidopsis thaliana] | LN | |
| 843 | 70716 | 1.00E−172 | 100 | ref|NP_974170.1|serine/threonine protein kinase, putative [Arabidopsis thaliana] | HS | |
| 843 | 76039 | 0 | 99 | ref|NP_001078396.1|PPDK (PYRUVATE ORTHOPHOSPHATE DIKINASE) [Arabidopsis thaliana] | HS | |
| 844 | 71611 | 0 | 99 | ref|NP_001078396.1|PPDK (PYRUVATE ORTHOPHOSPHATE DIKINASE) [Arabidopsis thaliana] | CK | PP |
| 845 | 70253 | 0 | 100 | ref|NP_200694.1|CYP86A1 (cytochrome P450, family 86, subfamily A, polypeptide 1); oxygen binding [Arabidopsis thaliana] | HS | CK |
| 846 | 14415 | 0 | 96 | ref|NP_568054.1|SEC14 cytosolic factor, putative/ phosphoglyceride transfer protein, putative [Arabidopsis thaliana] | LN | |
| 847 | 13718 | 4.00E−56 | 100 | ref|NP_196413.1|unknown protein [Arabidopsis thaliana] sp|Q9SD88|U139_ARATH UPF0139 protein At5g07960 | LN | |
| 848 | 10706 | 0 | 88 | gb|AAA19118.1|glutamyl-tRNA reductase | CK | HS |
| 848 | 10709 | 0 | 88 | gb|AAA19118.1|glutamyl-tRNA reductase | LN | |
| 849 | 14340 | 1.00E−125 | 93 | ref|NP_175332.1|unknown protein [Arabidopsis thaliana] | LN | |
| 850 | 13471 | 1.00E−136 | 95 | ref|NP_565858.1|unknown protein [Arabidopsis thaliana] | LN | |
| 851 | 18304 | 1.00E−133 | 94 | ref|NP_189283.1|TIP2 (TONOPLAST INTRINSIC PROTEIN 2); water channel [Arabidopsis thaliana] | HS | |
| 852 | 13623 | 0 | 96 | ref|NP_176001.2|GTP-binding protein-related [Arabidopsis thaliana] | DS | |
| 853 | 18302 | 0 | 100 | ref|NP_194702.2|NFC5 (NUCLEOSOME/CHROMATIN ASSEMBLY FACTOR GROUP C 5) [Arabidopsis thaliana] sp|Q9SU78|MSI5_ARATH WD-40 repeat-containing protein MSI5 | HS | |
| 854 | 15053 | 0 | 97 | ref|NP_001031261.1|unknown protein [Arabidopsis thaliana] | LN | |
| 855 | 15624 | 0 | 93 | ref|NP_171975.2|RabGAP/TBC domain-containing protein [Arabidopsis thaliana] | LL | PP |
| 856 | 70412 | 0 | 81 | ref|NP_179257.1|nodulin family protein [Arabidopsis thaliana] | HS | |
| 857 | 17902 | 0 | 91 | ref|NP_564843.1|integral membrane transporter family protein [Arabidopsis thaliana] | PP | |
| 858 | 14272 | 0 | 90 | ref|NP_566584.1|YSL5 (YELLOW STRIPE LIKE 5); oligopeptide transporter [Arabidopsis thaliana] | LN | |
| 859 | 15122 | 0 | 95 | ref|NP_565817.2|glycogenin glucosyltransferase (glycogenin)-related [Arabidopsis thaliana] | LN | |
| 859 | 70723 | 0 | 95 | ref|NP_565817.2|glycogenin glucosyltransferase (glycogenin)-related [Arabidopsis thaliana] | HS | |
| 860 | 14248 | 1.00E−154 | 79 | ref|NP_176081.1|unknown protein [Arabidopsis thaliana] | DS | |
| 861 | 13965 | 0 | 100 | ref|NP_173104.1|Per1-like family protein [Arabidopsis thaliana] | CK | |
| 862 | 75912 | 1.00E−169 | 100 | ref|NP_199075.1|unknown protein [Arabidopsis thaliana] | CS | LL |
| 863 | 14344 | 1.00E−81 | 100 | ref|NP_566785.1|universal stress protein (USP) family protein [Arabidopsis thaliana] | CS | |
| 864 | 14807 | 0 | 89 | gb|AAD20391.1|hypothetical protein [Arabidopsis thaliana] | CS | |
| 865 | 17307 | 0 | 89 | dbj|BAE98505.1|hypothetical protein [Arabidopsis thaliana] | PP | |
| 866 | 16431 | 0 | 73 | ref|NP_201248.1|octicosapeptide/Phox/Bem1p (PB1) domain-containing protein [Arabidopsis thaliana] | LN | |
| 867 | 73075 | 0 | 96 | ref|NP_187459.2|protein binding/zinc ion binding [Arabidopsis thaliana] | CS | |

TABLE 3-continued

| PEP SEQ ID NO | Construct | E-value | % Id | Description | traits | |
|---|---|---|---|---|---|---|
| 868 | 16323 | 9.00E−57 | 89 | ref|NP_171768.2|transcription initiation factor IID (TFIID) 18 kDa subunit (TAFII-18) family protein [*Arabidopsis thaliana*] | LN | |
| 869 | 14833 | 1.00E−141 | 90 | ref|NP_176342.1|CCR4-NOT transcription complex protein, putative [*Arabidopsis thaliana*] | SP | |
| 870 | 17030 | 0 | 95 | gb|AAG28899.1|AC008113_15F12A21.29 [*Arabidopsis thaliana*] | LL | |
| 871 | 76414 | 0 | 99 | ref|NP_180595.1|CIPK11 (SNF1-RELATED PROTEIN KINASE 3.22, SOS3-INTERACTING PROTEIN 4); kinase [*Arabidopsis thaliana*] | PEG | |
| 872 | 16021 | 0 | 82 | ref|NP_201301.1|CDKC; 2 (CYCLIN-DEPENDENT KINASE C; 2); kinase [*Arabidopsis thaliana*] | LN | |
| 873 | 78701 | 0 | 93 | ref|NP_564203.1|F-box family protein [*Arabidopsis thaliana*] | HS | |
| 874 | 78702 | 0 | 93 | ref|NP_565142.1|F-box family protein (FBX3) [*Arabidopsis thaliana*] | PEG | |
| 875 | 15220 | 0 | 89 | ref|NP_173623.1|kelch repeat-containing F-box family protein [*Arabidopsis thaliana*] sp|Q9LM55|FBK8_ARATH F-box/Kelch-repeat protein | LN | |
| 876 | 15623 | 0 | 88 | ref|NP_179623.1|transducin family protein/WD-40 repeat family protein [*Arabidopsis thaliana*] | HS | |
| 877 | 19402 | 0 | 96 | ref|NP_568408.1|F-box family protein/WD-40 repeat family protein [*Arabidopsis thaliana*] | PP | |
| 878 | 70559 | 0 | 98 | ref|NP_181061.1|SUVH5 (SU(VAR)3-9 HOMOLOG 5) [*Arabidopsis thaliana*] | LN | |
| 879 | 15111 | 0 | 90 | ref|NP_197821.1|ATXR6 (*Arabidopsis thaliana* Trithorax-related protein 6); DNA binding sp|Q9FNE9|ATXR6_ARATH Histone-lysine N-methyltransferase ATXR6 (Trithorax-related protein 6) (TRX-related protein 6) | DS | |
| 880 | 70832 | 0 | 100 | ref|NP_172633.1|CYP51G1 (CYTOCHROME P450 51); oxygen binding [*Arabidopsis thaliana*] | HS | |
| 881 | 15129 | 4.00E−82 | 77 | ref|NP_188372.1|PHD finger family protein [*Arabidopsis thaliana*] | LN | |
| 882 | 76086 | 0 | 91 | ref|NP_192814.1|EMB1706 (EMBRYO DEFECTIVE 1706); S-adenosylmethionine-dependent methyltransferase [*Arabidopsis thaliana*] | PP | |
| 883 | 15203 | 1.00E−158 | 94 | gb|AAD30650.1|AC006085_23Similar to human CGI-33 protein [*Arabidopsis thaliana*] | CK | |
| 884 | 70216 | 0 | 95 | ref|NP_567665.2|CYP706A1 (cytochrome P450, family 706, subfamily A, polypeptide 1); oxygen binding [*Arabidopsis thaliana*] | HS | PP |
| 885 | 14910 | 0 | 100 | ref|NP_201191.1|UVR8 (UVB-RESISTANCE 8) [*Arabidopsis thaliana*] | DS | |
| 886 | 70318 | 0 | 92 | ref|NP_172325.2|ATCPNIFS/ATNFS2/ATSUFS/CPNIFS/SUFS (CHLOROPLASTIC NIFS-LIKE CYSTEINE DESULFURASE); cysteine desulfurase/selenocysteine lyase/transaminase [*Arabidopsis thaliana*] | HS | |
| 887 | 15207 | 1.00E−44 | 99 | gb|AAG51737.1|AC068667_16beta-1,3 glucanase, putative; 26636-27432 [*Arabidopsis thaliana*] | SP | |
| 888 | 14915 | 0 | 97 | ref|NP_199393.1|CIPK19 (CIPK19); kinase [*Arabidopsis thaliana*] | LN | |
| 889 | 15132 | 1.00E−152 | 80 | ref|NP_187881.1|ZIP1 (ZINC TRANSPORTER 1 PRECURSOR); zinc ion transporter [*Arabidopsis thaliana*] | LN | |
| 890 | 16229 | 0 | 100 | gb|ABG54330.1|double HA-tagged mitogen activated protein kinase 3 [synthetic construct] | SS | |
| 891 | 14932 | 0 | 100 | ref|NP_568748.1|nucleotide-binding family protein [*Arabidopsis thaliana*] | DS | |
| 892 | 76017 | 1.00E−180 | 100 | ref|NP_568235.1|unknown protein [*Arabidopsis thaliana*] | HS | PP |
| 893 | 15964 | 1.00E−44 | 100 | ref|NP_566894.1|unknown protein [*Arabidopsis thaliana*] | DS | |
| 894 | 17227 | 8.00E−83 | 73 | gb|AAD03429.1|similar to nascent polypeptide associated complex alpha chain [*Arabidopsis thaliana*] | CS | |
| 895 | 72952 | 0 | 96 | ref|NP_564480.1|unknown protein [*Arabidopsis thaliana*] | CS | |
| 896 | 73706 | 0 | 96 | ref|NP_568221.1|protein kinase, putative [*Arabidopsis thaliana*] | HS | SS |
| 897 | 18203 | 0 | 92 | ref|NP_568919.1|APRR3 (PSEUDO-RESPONSE REGULATOR 3); transcription regulator [*Arabidopsis thaliana*] | HS | |
| 898 | 16309 | 1.00E−163 | 88 | ref|NP_195558.1|GGR (GERANYLGERANYL REDUCTASE); farnesyltranstransferase [*Arabidopsis thaliana*] | LN | |
| 899 | 15986 | 3.00E−99 | 84 | dbj|BAF02216.1|hypothetical protein [*Arabidopsis thaliana*] | DS | |
| 900 | 15987 | 2.00E−54 | 79 | ref|NP_174170.1|glutaredoxin family protein [*Arabidopsis thaliana*] | DS | |

TABLE 3-continued

| PEP SEQ ID NO | Construct | E-value | % Id | Description | traits | |
|---|---|---|---|---|---|---|
| 901 | 16204 | 2.00E−59 | 100 | ref|NP_566191.1|NADH-ubiquinone oxidoreductase-related [*Arabidopsis thaliana*] | LN | |
| 902 | 11133 | 1.00E−114 | 100 | ref|NP_563897.1|alanine racemase family protein [*Arabidopsis thaliana*] | LN | |
| 903 | 73977 | 9.00E−67 | 100 | ref|NP_194677.1|mitochondrial ATP synthase g subunit family protein [*Arabidopsis thaliana*] | HS | |
| 904 | 15995 | 1.00E−176 | 84 | ref|NP_564660.1|unknown protein [*Arabidopsis thaliana*] | DS | |
| 904 | 18201 | 1.00E−176 | 84 | ref|NP_564660.1|unknown protein [*Arabidopsis thaliana*] | PP | |
| 905 | 16887 | 1.00E−164 | 100 | ref|NP_171820.1|phenazine biosynthesis PhzC/PhzF family protein [*Arabidopsis thaliana*] | PP | |
| 906 | 16213 | 1.00E−140 | 82 | ref|NP_563991.1|unknown protein [*Arabidopsis thaliana*] | HS | |
| 907 | 15507 | 0 | 96 | ref|NP_172255.1|cupin family protein [*Arabidopsis thaliana*] | LN | |
| 908 | 15508 | 3.00E−86 | 100 | ref|NP_564937.1|unknown protein [*Arabidopsis thaliana*] | LN | |
| 909 | 15959 | 3.00E−56 | 74 | ref|NP_180097.1|unknown protein [*Arabidopsis thaliana*] | LN | |
| 910 | 72427 | 0 | 93 | ref|NP_568346.1|tubulin family protein [*Arabidopsis thaliana*] | HS | |
| 911 | 19041 | 2.00E−85 | 82 | ref|NP_565723.1|unknown protein [*Arabidopsis thaliana*] | HS | LN |
| 912 | 17802 | 1.00E−118 | 100 | ref|NP_187425.1|emp24/gp25L/p24 family protein [*Arabidopsis thaliana*] | HS | |
| 913 | 19042 | 0 | 94 | ref|NP_569048.1|ARA12; subtilase [*Arabidopsis thaliana*] | HS | |
| 914 | 76053 | 0 | 94 | ref|NP_172544.1|unknown protein [*Arabidopsis thaliana*] | HS | |
| 915 | 16120 | 1.00E−56 | 90 | ref|NP_192997.1|ribosomal protein L7Ae/L30e/S12e/Gadd45 family protein [*Arabidopsis thaliana*] | CK | |
| 916 | 15424 | 1.00E−103 | 94 | ref|NP_196647.1|CBS domain-containing protein [*Arabidopsis thaliana*] | HS | |
| 917 | 16401 | 0 | 90 | ref|NP_179995.1|CYP71B6 (CYTOCHROME P450 71B6); oxygen binding [*Arabidopsis thaliana*] | PP | |
| 918 | 72417 | 0 | 100 | gb|AAK25868.1|AF360158_1unknown protein [*Arabidopsis thaliana*] | CK | |
| 919 | 73702 | 0 | 90 | ref|NP_564657.1|spliceosome protein-related [*Arabidopsis thaliana*] | HS | SS |
| 920 | 70706 | 0 | 100 | gb|AAD17366.1|similar to human phosphotyrosyl phosphatase activator PTPA (GB:X73478) [*Arabidopsis thaliana*] | HS | |
| 921 | 71145 | 4.00E−57 | 86 | gb|AAG40386.1|AF325034_1AT5g02160 [*Arabidopsis thaliana*] | HS | |
| 922 | 11609 | 0 | 97 | gb|AAC34228.1|putative cytochrome P450 [*Arabidopsis thaliana*] | LN | |
| 923 | 71706 | 0 | 88 | gb|AAF03464.1|AC009327_3 hypothetical protein [*Arabidopsis thaliana*] | CK | |
| 924 | 17325 | 1.00E−144 | 86 | ref|NP_563896.1|unknown protein [*Arabidopsis thaliana*] | PP | |
| 925 | 70102 | 1.00E−166 | 100 | ref|NP_353899.2|hypothetical protein Atu0877 [*Agrobacterium tumefaciens* str. C58] | HS | |
| 926 | 70106 | 1.00E−151 | 92 | ref|NP_353321.1|hypothetical protein Atu0291 [*Agrobacterium tumefaciens* str. C58] | HS | |
| 927 | 70113 | 3.00E−94 | 94 | ref|NP_013690.1|Adenine phosphoribosyltransferase, catalyzes the formation of AMP from adenine and 5-phosphoribosylpyrophosphate; involved in the salvage pathway of purine nucleotide biosynthesis; Apt1p [*Saccharomyces cerevisiae*] | HS | |
| 928 | 70115 | 0 | 100 | ref|NP_116623.1|Alanine:glyoxylate aminotransferase (AGT), catalyzes the synthesis of glycine from glyoxylate, which is one of three pathways for glycine biosynthesis in yeast; has similarity to mammalian and plant alanine:glyoxylate aminotransferases; Agx1p [*Saccharomyces cerevisiae*] | HS | |
| 929 | 70118 | 0 | 94 | ref|NP_012111.1|Mitochondrial glycerol-3-phosphate dehydrogenase; expression is repressed by both glucose and cAMP and derepressed by non-fermentable carbon sources in a Snf1p, Rsf1p, Hap2/3/4/5 complex dependent manner; Gut2p [*Saccharomyces cerevisiae*] | SP | |
| 930 | 70128 | 9.00E−85 | 70 | ref|NP_638658.1|membrane-bound proton-translocating pyrophosphatase [*Xanthomonas campestris* pv. campestris str. ATCC 33913] | HS | |
| 931 | 70130 | 1.00E−161 | 99 | ref|NP_639330.1|a-type carbonic anhydrase [*Xanthomonas campestris* pv. campestris str. ATCC 33913] | HS | PEG |
| 932 | 17103 | 0 | 88 | ref|NP_173155.1|CAT8 (CATIONIC AMINO ACID TRANSPORTER 8); cationic amino acid transporter [*Arabidopsis thaliana*] | SS | |
| 933 | 72748 | 1.00E−33 | 74 | ref|NP_568635.1|unknown protein [*Arabidopsis thaliana*] | HS | |
| 934 | 17502 | 3.00E−94 | 74 | ref|NP_565588.1|unknown protein [*Arabidopsis thaliana*] | HS | |

TABLE 3-continued

| PEP SEQ ID NO | Construct | E-value | % Id | Description | traits | | |
|---|---|---|---|---|---|---|---|
| 935 | 17503 | 1.00E−130 | 100 | ref|NP_176178.1|ATGSTU16 (*Arabidopsis thaliana* Glutathione S-transferase (class tau) 16); glutathione transferase | HS | | |
| 936 | 78708 | 1.00E−168 | 95 | gb|AAK43902.1|AF370583_1Unknown protein [*Arabidopsis thaliana*] | LL | | |
| 937 | 17504 | 1.00E−139 | 95 | ref|NP_565634.1|harpin-induced protein-related/HIN1-related/harpin-responsive protein-related [*Arabidopsis thaliana*] | HS | LL | PP |
| 938 | 17132 | 1.00E−127 | 100 | ref|NP_187978.1|seven in absentia (SINA) family protein [*Arabidopsis thaliana*] | LN | | |
| 939 | 72965 | 0 | 91 | gb|AAN60250.1|unknown [*Arabidopsis thaliana*] | LL | | |
| 940 | 72796 | 3.00E−61 | 100 | ref|NP_201508.1|RALFL34 (RALF-LIKE 34) [*Arabidopsis thaliana*] | CS | | |
| 941 | 16617 | 5.00E−96 | 100 | ref|NP_355193.2|adenine phosphoribosyltransferase [*Agrobacterium tumefaciens* str. C58] | CS | HS | |
| 942 | 16640 | 0 | 100 | ref|NP_355113.2|alcohol dehydrogenase [*Agrobacterium tumefaciens* str. C58] | HS | | |
| 943 | 16603 | 1.00E−132 | 85 | ref|NP_357530.1|ribokinase [*Agrobacterium tumefaciens* str. C58] | HS | | |
| 944 | 16612 | 1.00E−137 | 100 | ref|NP_010335.1|Triose phosphate isomerase, abundant glycolytic enzyme; mRNA half-life is regulated by iron availability; transcription is controlled by activators Reb1p, Gcr1p, and Rap1p through binding sites in the 5' non-coding region; Tpi1p [*Saccharomyces cerevisiae*] | LN | SP | |
| 945 | 16614 | 1.00E−109 | 100 | ref|NP_010741.1|Stress inducible cytoplasmic thioredoxin peroxidase; cooperates with Tsa1p in the removal of reactive oxygen, nitrogen and sulfur species using thioredoxin as hydrogen donor; deletion enhances the mutator phenotype of tsa1 mutants; Tsa2p [*Saccharomyces cerevisiae*] | DS | | |
| 946 | 78354 | 7.00E−80 | 100 | ref|NP_192392.1|methionine sulfoxide reductase domain-containing protein/SelR domain-containing protein [*Arabidopsis thaliana*] | SS | | |
| 947 | 17818 | 6.00E−19 | 60 | ref|NP_564780.1|TIM13 (TIM13); protein translocase [*Arabidopsis thaliana*] | PP | | |
| 948 | 78370 | 3.00E−64 | 91 | ref|NP_194900.1|TAFII15 (SALT TOLERANCE DURING GERMINATION 1); transcription factor [*Arabidopsis thaliana*] | HS | | |
| 949 | 70411 | 0 | 90 | ref|NP_849806.1|UBP1A; mRNA 3'-UTR binding [*Arabidopsis thaliana*] | SP | | |
| 950 | 19154 | 1.00E−151 | 89 | ref|NP_197310.1|transcriptional factor B3 family protein [*Arabidopsis thaliana*] | HS | LN | PP |
| 951 | 19155 | 0 | 82 | ref|NP_200906.2|nuclear transport factor 2 (NTF2) family protein/RNA recognition motif (RRM)-containing protein [*Arabidopsis thaliana*] | HS | | |
| 952 | 18307 | 0 | 94 | ref|NP_194507.1|ACBP2 (ACYL-COA BINDING PROTEIN ACBP 2) [*Arabidopsis thaliana*] | HS | | |
| 953 | 72030 | 0 | 86 | ref|NP_177367.1|zinc finger (C3HC4-type RING finger) family protein [*Arabidopsis thaliana*] | LN | | |
| 954 | 17916 | 1.00E−173 | 95 | ref|NP_568839.1|CSN6A (COP9 signalosome subunit 6A) [*Arabidopsis thaliana*] | PP | | |
| 955 | 17917 | 0 | 96 | ref|NP_188478.1|aspartyl protease family protein [*Arabidopsis thaliana*] | SS | | |
| 956 | 17334 | 0 | 94 | ref|NP_178146.1|chloroplast ADP, ATP carrier protein 1/ADP, ATP translocase 1/adenine nucleotide translocase 1 (AATP1) [*Arabidopsis thaliana*] | PP | | |
| 957 | 71531 | 0 | 100 | ref|NP_565656.1|aldo/keto reductase family protein [*Arabidopsis thaliana*] | HS | | |
| 958 | 18441 | 7.00E−75 | 100 | ref|NP_973779.1|lactoylglutathione lyase family protein/glyoxalase I family protein [*Arabidopsis thaliana*] | HS | | |
| 959 | 19162 | 2.00E−73 | 85 | ref|NP_563687.1|photosystem II family protein [*Arabidopsis thaliana*] | DS | | |
| 960 | 73205 | 0 | 98 | ref|NP_190414.1|zinc finger (CCCH-type) family protein [*Arabidopsis thaliana*] | PEG | | |
| 961 | 18306 | 1.00E−172 | 100 | ref|NP_566769.1|LAG1 (Longevity assurance gene 1) [*Arabidopsis thaliana*] | SS | | |
| 962 | 70808 | 0 | 97 | ref|NP_196136.1|CESA3 (CELLULASE SYNTHASE 3); cellulose synthase/transferase, transferring glycosyl groups [*Arabidopsis thaliana*] | CS | CK | |
| 963 | 17653 | 1.00E−178 | 95 | ref|NP_199155.1|zinc finger (C3HC4-type RING finger) family protein [*Arabidopsis thaliana*] | LN | | |
| 964 | 19535 | 0 | 81 | ref|NP_567002.1|GCN5 (Histon acetyltransferase HAT1) [*Arabidopsis thaliana*] | HS | | |
| 965 | 71719 | 0 | 99 | ref|NP_192044.1|DC1 domain-containing protein [*Arabidopsis thaliana*] | HS | LL | PP |

TABLE 3-continued

| PEP SEQ ID NO | Construct | E-value | % Id | Annotation Description | traits | | |
|---|---|---|---|---|---|---|---|
| 966 | 18546 | 1.00E-102 | 92 | ref|NP_176285.1|AGL56 (AGAMOUS LIKE-56); DNA binding/transcription factor [*Arabidopsis thaliana*] | PP | | |
| 967 | 19534 | 0 | 78 | ref|NP_566721.1|binding [*Arabidopsis thaliana*] | HS | | |
| 968 | 18421 | 0 | 96 | gb|ABK06451.1|flag-tagged protein kinase domain of putative mitogen-activated protein kinase kinase kinase [synthetic construct] | HS | | |
| 969 | 18422 | 0 | 100 | ref|NP_194498.1|MSP1 protein, putative/ intramitochondrial sorting protein, putative [*Arabidopsis thaliana*] | HS | | |
| 970 | 19539 | 0 | 95 | ref|NP_191747.1|CYP78A9 (CYTOCHROME P450 78A9); oxygen binding [*Arabidopsis thaliana*] | HS | PP | |
| 971 | 19244 | 3.00E-74 | 88 | ref|NP_565113.1|auxin-responsive family protein [*Arabidopsis thaliana*] | HS | | |
| 972 | 15803 | 1.00E-142 | 100 | ref|NP_199675.2|cyclin family protein [*Arabidopsis thaliana*] | HS | | |
| 973 | 19545 | 0 | 100 | ref|NP_568665.1|pentatricopeptide (PPR) repeat-containing protein [*Arabidopsis thaliana*] | HS | | |
| 974 | 10222 | 0 | 94 | ref|NP_190896.1|CYP71B5 (CYTOCHROME P450 71B5); oxygen binding [*Arabidopsis thaliana*] | LN | | |
| 974 | 72356 | 0 | 94 | ref|NP_190896.1|CYP71B5 (CYTOCHROME P450 71B5); oxygen binding [*Arabidopsis thaliana*] | CK | PEG | |
| 975 | 70425 | 0 | 98 | ref|NP_200201.3|unknown protein [*Arabidopsis thaliana*] | HS | | |
| 976 | 19237 | 1.00E-150 | 95 | ref|NP_199836.1|31 kDa ribonucleoprotein, chloroplast, putative/RNA-binding protein RNP-T, putative/RNA-binding protein 1/2/3, putative/RNA-binding protein cp31, putative [*Arabidopsis thaliana*] | HS | | |
| 977 | 71303 | 0 | 82 | ref|NP_199431.1|KH domain-containing protein [*Arabidopsis thaliana*] | HS | | |
| 978 | 19240 | 1.00E-180 | 100 | ref|NP_566576.1|meprin and TRAF homology domain-containing protein/MATH domain-containing protein [*Arabidopsis thaliana*] | LN | | |
| 979 | 18535 | 0 | 100 | ref|NP_196179.1|oxidoreductase, 2OG-Fe(II) oxygenase family protein [*Arabidopsis thaliana*] | HS | | |
| 980 | 19450 | 0 | 94 | ref|NP_565422.1|pentatricopeptide (PPR) repeat-containing protein [*Arabidopsis thaliana*] | LN | | |
| 981 | 18221 | 1.00E-66 | 100 | ref|NP_193992.1|protease inhibitor/seed storage/lipid transfer protein (LTP) family protein [*Arabidopsis thaliana*] | PP | | |
| 982 | 18233 | 1.00E-110 | 87 | ref|NP_193179.1|enoyl-CoA hydratase/isomerase family protein [*Arabidopsis thaliana*] | PP | | |
| 983 | 18236 | 1.00E-31 | 70 | ref|NP_565410.1|unknown protein [*Arabidopsis thaliana*] | PP | | |
| 984 | 18238 | 1.00E-129 | 88 | ref|NP_197105.1|3-oxo-5-alpha-steroid 4-dehydrogenase family protein/steroid 5-alpha-reductase family protein [*Arabidopsis thaliana*] | HS | | |
| 985 | 18309 | 1.00E-128 | 93 | gb|AAM61596.1|DNA-binding protein [*Arabidopsis thaliana*] | CS | PEG | |
| 986 | 70337 | 0 | 85 | gb|AAP84710.2|metacaspase 7 [*Arabidopsis thaliana*] | HS | | |
| 987 | 18319 | 1.00E-105 | 89 | ref|NP_172721.1|DDF1 (DWARF AND DELAYED FLOWERING 1); DNA binding/transcription factor [*Arabidopsis thaliana*] | LN | | |
| 988 | 70338 | 1.00E-172 | 85 | ref|NP_200445.1|zinc finger (C3HC4-type RING finger) family protein [*Arabidopsis thaliana*] | LL | | |
| 989 | 10471 | 1.00E-114 | 84 | dbj|BAF00210.1|hypothetical protein [*Arabidopsis thaliana*] | DS | | |
| 990 | 18331 | 1.00E-114 | 63 | ref|NP_565124.1|nucleic acid binding [*Arabidopsis thaliana*] | CS | | |
| 991 | 10228 | 0 | 97 | ref|NP_563880.1|TIF3H1 (eukaryotic translation initiation factor 3 subunit H1); translation initiation factor [*Arabidopsis thaliana*] | LN | | |
| 991 | 10473 | 0 | 97 | ref|NP_563880.1|TIF3H1 (eukaryotic translation initiation factor 3 subunit H1); translation initiation factor [*Arabidopsis thaliana*] | LN | | |
| 992 | 18261 | 1.00E-167 | 91 | ref|NP_563732.1|peroxidase, putative [*Arabidopsis thaliana*] | PP | | |
| 993 | 18848 | 0 | 94 | ref|NP_177805.1|O-methyltransferase family 2 protein [*Arabidopsis thaliana*] | LN | | |
| 994 | 18268 | 1.00E-130 | 92 | gb|AAM62813.1|unknown [*Arabidopsis thaliana*] | PP | | |
| 995 | 18345 | 0 | 92 | ref|NP_182320.1|SWA1 (SLOW WALKER1); nucleotide binding [*Arabidopsis thaliana*] | HS | | |
| 996 | 73607 | 0 | 92 | ref|NP_851068.1|WD-40 repeat family protein [*Arabidopsis thaliana*] | HS | | |
| 997 | 18352 | 1.00E-166 | 83 | ref|NP_201275.1|nodulin MtN21 family protein [*Arabidopsis thaliana*] | HS | SS | PEG |
| 998 | 18357 | 1.00E-171 | 100 | ref|NP_172866.1|mitochondrial substrate carrier family protein [*Arabidopsis thaliana*] | PP | | |
| 999 | 19423 | 0 | 100 | ref|NP_177020.1|CUT1 (CUTICULAR 1); acyltransferase [*Arabidopsis thaliana*] | DS | | |

TABLE 3-continued

| PEP SEQ ID NO | Construct | E-value | % Id | Description | traits | | | |
|---|---|---|---|---|---|---|---|---|
| 1000 | 78373 | 0 | 94 | ref|NP_179537.1|CKL5 (Casein Kinase I-like 5); casein kinase I/kinase [Arabidopsis thaliana] | CK | HS | | |
| 1001 | 70603 | 0 | 100 | ref|NP_175081.1|ALDH3H1 (ALDEHYDE DEHYDROGENASE 4); 3-chloroallyl aldehyde dehydrogenase/aldehyde dehydrogenase (NAD) [Arabidopsis thaliana] | HS | LN | | |
| 1002 | 19616 | 1.00E−159 | 100 | ref|NP_563789.1|SMO2-2 (sterol 4-alpha-methyl-oxidase 2); C-4 methylsterol oxidase [Arabidopsis thaliana] | HS | | | |
| 1003 | 19425 | 1.00E−164 | 91 | ref|NP_564407.1|electron carrier/iron ion binding [Arabidopsis thaliana] | DS | | | |
| 1004 | 19426 | 1.00E−152 | 89 | ref|NP_564428.1|unknown protein [Arabidopsis thaliana] | PP | | | |
| 1005 | 18382 | 2.00E−51 | 87 | ref|NP_564651.1|unknown protein [Arabidopsis thaliana] | PP | | | |
| 1006 | 71536 | 4.00E−86 | 86 | ref|NP_564747.1|ZCF37 [Arabidopsis thaliana] | HS | | | |
| 1007 | 70419 | 6.00E−88 | 66 | ref|NP_564888.1|unknown protein [Arabidopsis thaliana] | LL | CK | DS | |
| 1008 | 70827 | 6.00E−85 | 100 | ref|NP_189667.1|zinc finger (C3HC4-type RING finger) family protein [Arabidopsis thaliana] | HS | | | |
| 1009 | 19311 | 0 | 94 | ref|NP_010849.1|Ferrioxamine B transporter, member of the ARN family of transporters that specifically recognize siderophore-iron chelates; transcription is induced during iron deprivation and diauxic shift; potentially phosphorylated by Cdc28p; Sit1p [Saccharomyces cerevisiae] | LN | | | |
| 1010 | 19323 | 0 | 92 | ref|NP_354642.2|malic enzyme [Agrobacterium tumefaciens str. C58] | LL | | | |
| 1011 | 19320 | 0 | 100 | ref|NP_012542.1|Glyceraldehyde-3-phosphate dehydrogenase, isozyme 2, involved in glycolysis and gluconeogenesis; tetramer that catalyzes the reaction of glyceraldehyde-3-phosphate to 1,3 bis-phosphoglycerate; detected in the cytoplasm and cell-wall; Tdh2p [Saccharomyces cerevisiae] | HS | | | |
| 1012 | 73613 | 0 | 95 | ref|NP_197104.1|NIK1 (NSP-INTERACTING KINASE 1); kinase [Arabidopsis thaliana] | CK | | | |
| 1013 | 70432 | 1.00E−162 | 91 | ref|NP_196709.1|GTP binding [Arabidopsis thaliana] | SS | | | |
| 1014 | 70433 | 0 | 100 | ref|NP_196957.1|transducin family protein/WD-40 repeat family protein [Arabidopsis thaliana] | HS | | | |
| 1015 | 70434 | 1.00E−142 | 94 | ref|NP_180497.1|tropinone reductase, putative/tropine dehydrogenase, putative [Arabidopsis thaliana] | HS | | | |
| 1016 | 72614 | 1.00E−128 | 79 | ref|NP_197757.1|sterile alpha motif (SAM) domain-containing protein [Arabidopsis thaliana] | LL | | | |
| 1017 | 70436 | 7.00E−35 | 70 | ref|NP_197966.1|early nodulin-related [Arabidopsis thaliana] | CS | HS | | |
| 1018 | 74226 | 0 | 92 | dbj|BAB02016.1|MAP kinase [Arabidopsis thaliana] | PP | | | |
| 1019 | 70439 | 1.00E−123 | 91 | ref|NP_191247.1|VQ motif-containing protein [Arabidopsis thaliana] | HS | PEG | | |
| 1020 | 70446 | 1.00E−128 | 100 | ref|NP_568972.2|unknown protein [Arabidopsis thaliana] | CS | | | |
| 1021 | 70613 | 0 | 93 | ref|NP_174145.1|unknown protein [Arabidopsis thaliana] | PEG | | | |
| 1022 | 70447 | 0 | 97 | ref|NP_175977.1|uracil phosphoribosyltransferase, putative/UMP pyrophosphorylase, putative/UPRTase, putative [Arabidopsis thaliana] ref|NP_974037.1| uracil phosphoribosyltransferase, putative/UMP pyrophosphorylase, putative/UPRTase, putative [Arabidopsis thaliana] | CK | | | |
| 1023 | 71725 | 0 | 67 | gb|ABE65946.1| nucleolin [Arabidopsis thaliana] | CK | | | |
| 1024 | 70462 | 9.00E−73 | 92 | ref|NP_567037.1|ARR17 (response regulator 17); transcription regulator/two-component response regulator [Arabidopsis thaliana] | PEG | | | |
| 1025 | 70545 | 0 | 95 | ref|NP_176108.3|bZIP family transcription factor [Arabidopsis thaliana] | SP | | | |
| 1026 | 70741 | 0 | 100 | gb|AAM78097.1|AT4g18060/F15J5_30 [Arabidopsis thaliana] | HS | | | |
| 1027 | 19702 | 0 | 97 | ref|NP_011904.1|Protein of unknown function, green fluorescent protein (GFP)-fusion protein localizes to the endoplasmic reticulum; msc7 mutants are defective in directing meiotic recombination events to homologous chromatids; Msc7p [Saccharomyces cerevisiae] | HS | | | |
| 1028 | 19985 | 1.00E−140 | 86 | gb|AAA88792.1|nucleosome assembly protein 1 | HS | | | |
| 1029 | 19775 | 1.00E−80 | 54 | ref|NP_175779.1|unknown protein [Arabidopsis thaliana] | CK | HS | PP | LN |
| 1030 | 19829 | 3.00E−56 | 42 | ref|NP_565892.1|unknown protein [Arabidopsis thaliana] | CS | | | |
| 1031 | 19982 | 1.00E−123 | 79 | gb|AAV49506.1|L-galactose-1-phosphate phosphatase [Actinidia deliciosa] | HS | PEG | | |
| 1032 | 19755 | 1.00E−110 | 63 | emb|CAO23381.1|unnamed protein product [Vitis vinifera] | HS | | | |
| 1033 | 19732 | 0 | 96 | dbj|BAA22559.1|squalene synthase [Glycine max] | PP | | | |
| 1034 | 70365 | 0 | 91 | gb|AAQ84169.1|1-deoxy-D-xylulose 5-phosphate synthase [Pueraria montana var. lobata] | CS | | | |

TABLE 3-continued

| PEP SEQ ID NO | Construct | Annotation | | | traits | | |
|---|---|---|---|---|---|---|---|
| | | E-value | % Id | Description | | | |
| 1035 | 10476 | 1.00E-168 | 86 | ref|NP_194096.1|CDPK6 (CALCIUM-DEPENDENT PROTEIN KINASE 6); anion channel/calcium- and calmodulin-dependent protein kinase/kinase [*Arabidopsis thaliana*] | LN | | |
| 1036 | 19987 | 0 | 83 | emb|CAO67062.1|unnamed protein product [*Vitis vinifera*] | HS | | |
| 1037 | 19893 | 1.00E-166 | 85 | gb|ABC75353.2|Intracellular chloride channel [*Medicago truncatula*] | HS | | |
| 1038 | 19983 | 6.00E-92 | 60 | emb|CAO39739.1|unnamed protein product [*Vitis vinifera*] | HS | LL | |
| 1039 | 19825 | 1.00E-40 | 39 | emb|CAO18125.1|unnamed protein product [*Vitis vinifera*] | HS | | |
| 1040 | 19919 | 1.00E-121 | 77 | emb|CAO61472.1|unnamed protein product [*Vitis vinifera*] | HS | | |
| 1041 | 19979 | 0 | 67 | emb|CAO68238.1|unnamed protein product [*Vitis vinifera*] | HS | | |
| 1042 | 19786 | 2.00E-80 | 75 | emb|CAO48404.1|unnamed protein product [*Vitis vinifera*] | HS | LN | |
| 1043 | 70903 | 0 | 76 | emb|CAO66035.1|unnamed protein product [*Vitis vinifera*] | HS | PP | PEG |
| 1044 | 70970 | 1.00E-102 | 67 | ref|NP_200538.1|unknown protein [*Arabidopsis thaliana*] | HS | | |
| 1045 | 70980 | 0 | 89 | dbj|BAE71243.1|putative galactose kinase [*Trifolium pratense*] | CK | | |
| 1046 | 70936 | 1.00E-158 | 49 | emb|CAO71465.1|unnamed protein product [*Vitis vinifera*] | HS | | |
| 1047 | 71425 | 1.00E-160 | 74 | emb|CAO14679.1|unnamed protein product[*Vitis vinifera*] | DS | | |
| 1048 | 78666 | 3.00E-45 | 83 | ref|NP_192698.1|GASA3 (GAST1 PROTEIN HOMOLOG 3) [*Arabidopsis thaliana*] | LN | | |
| 1049 | 71202 | 1.00E-163 | 95 | ref|NP_194179.1|serine/threonine protein kinase, putative [*Arabidopsis thaliana*] | LN | | |
| 1050 | 78973 | 0 | 90 | ref|NP_565672.1|DRB2 (DSRNA-BINDING PROTEIN 2); double-stranded RNA binding [*Arabidopsis thaliana*] | LL | | |
| 1051 | 76411 | 1.00E-179 | 99 | ref|NP_172864.1|2-oxoglutarate-dependent dioxygenase, putative [*Arabidopsis thaliana*] | PP | | |
| 1052 | 70635 | 4.00E-64 | 100 | ref|NP_851278.1|senescence-associated family protein [*Arabidopsis thaliana*] | HS | | |
| 1053 | 73715 | 0 | 92 | ref|NP_198428.1|G6PD1 (GLUCOSE-6-PHOSPHATE DEHYDROGENASE 1); glucose-6-phosphate 1-dehydrogenase [*Arabidopsis thaliana*] | PEG | | |
| 1054 | 70638 | 6.00E-79 | 89 | ref|NP_197398.1|AWPM-19-like membrane family protein [*Arabidopsis thaliana*] | HS | LN | |
| 1055 | 70642 | 1.00E-176 | 92 | ref|NP_191315.1|aspartate/glutamate/uridylate kinase family protein [*Arabidopsis thaliana*] | HS | | |
| 1056 | 70643 | 0 | 96 | ref|NP_191703.1|ATCYSC1 (BETA-SUBSTITUTED ALA SYNTHASE 3; 1); L-3-cyanoalanine synthase/cysteine synthase [*Arabidopsis thaliana*] | HS | | |
| 1057 | 71564 | 1.00E-121 | 95 | emb|CAA47753.1|proteosome subunit [*Arabidopsis thaliana*] | HS | SP | |
| 1058 | 75039 | 1.00E-175 | 90 | ref|NP_188659.1|mitochondrial substrate carrier family protein [*Arabidopsis thaliana*] | LN | | |
| 1059 | 70653 | 8.00E-82 | 100 | ref|NP_566365.1|unknown protein [*Arabidopsis thaliana*] | PEG | | |
| 1060 | 70655 | 4.00E-87 | 82 | ref|NP_566619.1|unknown protein [*Arabidopsis thaliana*] | LL | PEG | |
| 1061 | 78321 | 0 | 97 | ref|NP_181404.1|MVD1 (mevalonate diphosphate decarboxylase 1) [*Arabidopsis thaliana*] | DS | HS | |
| 1062 | 78307 | 0 | 100 | ref|NP_182079.1|CYP76C4 (cytochrome P450, family 76, subfamily C, polypeptide 4); oxygen binding [*Arabidopsis thaliana*] | CK | | |
| 1063 | 71808 | 0 | 91 | ref|NP_182082.2|CYP76C3 (cytochrome P450, family 76, subfamily C, polypeptide 3); oxygen binding [*Arabidopsis thaliana*] | HS | | |
| 1064 | 71810 | 0 | 97 | gb|AAF88087.1|AC025417_15T12C24.27 [*Arabidopsis thaliana*] | LN | | |
| 1065 | 71313 | 0 | 100 | ref|NP_187667.1|CYP77A7 (cytochrome P450, family 77, subfamily A, polypeptide 7, unfertilized embryo sac 9); oxygen binding [*Arabidopsis thaliana*] | CS | | |
| 1066 | 72349 | 1.00E-134 | 100 | ref|NP_191072.1|TT5 (TRANSPARENT TESTA 5); chalcone isomerase [*Arabidopsis thaliana*] | SP | | |
| 1067 | 71318 | 0 | 90 | ref|NP_189261.1|CYP71B34 (cytochrome P450, family 71, subfamily B, polypeptide 34); oxygen binding [*Arabidopsis thaliana*] | HS | | |
| 1068 | 71812 | 0 | 92 | ref|NP_195705.1|CYP79B2 (cytochrome P450, family 79, subfamily B, polypeptide 2); oxygen binding [*Arabidopsis thaliana*] | LN | | |
| 1069 | 74060 | 0 | 90 | ref|NP_188731.1|CYP705A32 (cytochrome P450, family 705, subfamily A, polypeptide 32); oxygen binding [*Arabidopsis thaliana*] | DS | | |
| 1070 | 71816 | 0 | 93 | ref|NP_568025.1|CYP81F3 (cytochrome P450, family 81, subfamily F, polypeptide 3); oxygen binding [*Arabidopsis thaliana*] | LL | | |
| 1071 | 71569 | 1.00E-142 | 95 | ref|NP_189364.1|ATPHB4 (PROHIBITIN 4) [*Arabidopsis thaliana*] | CS | | |
| 1072 | 70672 | 0 | 100 | ref|NP_567641.1|PRXR1 (peroxidase 42); peroxidase [*Arabidopsis thaliana*] | PP | | |

TABLE 3-continued

| PEP SEQ ID NO | Construct | E-value | % Id | Description | traits | |
|---|---|---|---|---|---|---|
| 1073 | 71336 | 0 | 96 | ref|NP_563762.1|VHS domain-containing protein/GAT domain-containing protein [*Arabidopsis thaliana*] | DS | |
| 1074 | 71337 | 1.00E-179 | 100 | ref|NP_179721.1|mannose 6-phosphate reductase (NADPH-dependent), putative [*Arabidopsis thaliana*] | HS | |
| 1075 | 71339 | 0 | 93 | ref|NP_200747.1|XH/XS domain-containing protein [*Arabidopsis thaliana*] | CS | |
| 1076 | 71825 | 0 | 87 | ref|NP_195998.2|TRFL10 (TRF-LIKE 10); DNA binding [*Arabidopsis thaliana*] | LN | |
| 1077 | 73696 | 1.00E-166 | 86 | ref|NP_192864.1|MADS-box family protein [*Arabidopsis thaliana*] | SP | |
| 1078 | 70682 | 1.00E-129 | 94 | ref|NP_001078595.1|RNA recognition motif (RRM)-containing protein [*Arabidopsis thaliana*] | HS | |
| 1079 | 70686 | 1.00E-117 | 75 | ref|NP_199096.1|ATU2AF35B; RNA binding [*Arabidopsis thaliana*] | SP | LL |
| 1080 | 78316 | 0 | 100 | ref|NP_192085.1|DC1 domain-containing protein [*Arabidopsis thaliana*] | SS | |
| 1081 | 71667 | 0 | 100 | ref|NP_013976.1|Glutamate decarboxylase, converts glutamate into gamma-aminobutyric acid (GABA) during glutamate catabolism; involved in response to oxidative stress; Gad1p [*Saccharomyces cerevisiae*] | DS | |
| 1082 | 71695 | 0 | 77 | emb|CAA75577.1|L-ascorbate oxidase [*Medicago truncatula*] | CK | |
| 1083 | 71696 | 0 | 96 | gb|AAB03258.1|phosphoinositide-specific phospholipase C P13 | HS | LN |
| 1084 | 72475 | 1.00E-111 | 83 | gb|AAF21310.1|seed maturation protein PM24 [*Glycine max*] | HS | |
| 1085 | 71677 | 1.00E-125 | 77 | gb|ABD28522.1|Cupin, RmlC-type [*Medicago truncatula*] | CK | |
| 1086 | 71691 | 7.00E-34 | 35 | emb|CAO44124.1|unnamed protein product [*Vitis vinifera*] | CS | |
| 1087 | 72476 | 1.00E-122 | 70 | emb|CAO47395.1|unnamed protein product [*Vitis vinifera*] | HS | |
| 1088 | 70803 | 0 | 97 | ref|NP_850874.1|glutamate-tRNA ligase, putative/glutamyl-tRNA synthetase, putatuve/GluRS, putative [*Arabidopsis thaliana*] | SP | LN |
| 1089 | 71612 | 0 | 94 | ref|NP_192179.1|SULTR3; 2 (SULFATE TRANSPORTER 3; 2); sulfate transporter [*Arabidopsis thaliana*] | LL | |
| 1090 | 71637 | 0 | 88 | gb|AAD52696.1|AF087819_1auxin transport protein [*Arabidopsis thaliana*] | LN | |
| 1091 | 71629 | 0 | 97 | ref|NP_565924.1|unknown protein [*Arabidopsis thaliana*] | HS | PEG |
| 1092 | 71622 | 0 | 97 | ref|NP_566085.1|APRR9 (PSEUDO-RESPONSE REGULATOR 9); transcription regulator [*Arabidopsis thaliana*] | LN | |
| 1093 | 70810 | 0 | 91 | ref|NP_175610.1|mitochondrial processing peptidase alpha subunit, putative [*Arabidopsis thaliana*] | HS | SS |
| 1094 | 72452 | 6.00E-76 | 77 | ref|NP_199889.1|auxin-responsive family protein [*Arabidopsis thaliana*] | LN | |
| 1095 | 74071 | 0 | 93 | ref|NP_174516.1|ribose-phosphate pyrophosphokinase 2/phosphoribosyl diphosphate synthetase 2 (PRS2) [*Arabidopsis thaliana*] | LL | |
| 1096 | 11042 | 2.00E-89 | 93 | ref|NP_179709.1|peptidyl-prolyl cis-trans isomerase/cyclophilin (CYP2)/rotamase [*Arabidopsis thaliana*] | LN | |
| 1097 | 72510 | 0 | 89 | ref|NP_196865.1|unknown protein [*Arabidopsis thaliana*] | CK | |
| 1098 | 72537 | 1.00E-124 | 82 | ref|NP_851118.1|unknown protein [*Arabidopsis thaliana*] | HS | LN |
| 1099 | 72541 | 9.00E-57 | 88 | ref|NP_568684.1|unknown protein [*Arabidopsis thaliana*] | PP | |
| 1100 | 72617 | 4.00E-88 | 100 | ref|NP_568761.1|unknown protein [*Arabidopsis thaliana*] | LL | |
| 1101 | 73755 | 1.00E-132 | 100 | ref|NP_200501.1|cysteine protease inhibitor [*Arabidopsis thaliana*] | PP | SS |
| 1102 | 72630 | 2.00E-86 | 93 | ref|NP_201267.1|C/VIF2 (CELL WALL/VACUOLAR INHIBITOR OF FRUCTOSIDASE 2); pectinesterase inhibitor [*Arabidopsis thaliana*] | SP | |
| 1103 | 72645 | 5.00E-37 | 75 | ref|NP_180615.1|photosystem II reaction center W (PsbW) protein-related [*Arabidopsis thaliana*] | LN | |
| 1104 | 72647 | 5.00E-43 | 100 | ref|NP_566036.1|protease inhibitor/seed storage/lipid transfer protein (LTP) family protein [*Arabidopsis thaliana*] | LN | |
| 1105 | 14316 | 1.00E-55 | 86 | ref|NP_188703.1|histone H2A, putative [*Arabidopsis thaliana*] | DS | |
| 1106 | 73689 | 6.00E-79 | 100 | ref|NP_173037.1|transducin family protein/WD-40 repeat family protein [*Arabidopsis thaliana*] | DS | SS |
| 1107 | 73345 | 0 | 92 | ref|NP_174226.1|transducin family protein/WD-40 repeat family protein [*Arabidopsis thaliana*] | HS | LN |
| 1108 | 73347 | 0 | 100 | ref|NP_177513.2|transducin family protein/WD-40 repeat family protein [*Arabidopsis thaliana*] | SP | |
| 1109 | 73231 | 0 | 84 | ref|NP_196332.1|leucine-rich repeat family protein [*Arabidopsis thaliana*] | PP | |
| 1110 | 78325 | 0 | 84 | ref|NP_171637.1|aspartyl protease family protein [*Arabidopsis thaliana*] | HS | |
| 1111 | 72658 | 1.00E-138 | 93 | ref|NP_172224.1|tropinone reductase, putative/tropine dehydrogenase, putative [*Arabidopsis thaliana*] | PEG | |

TABLE 3-continued

| PEP SEQ ID NO | Construct | E-value | % Id | Annotation Description | traits | | |
|---|---|---|---|---|---|---|---|
| 1112 | 72660 | 3.00E−78 | 82 | ref|NP_564585.1|zinc finger (AN1-like) family protein [*Arabidopsis thaliana*] | LN | | |
| 1113 | 72662 | 5.00E−49 | 100 | ref|NP_179096.1|gibberellin-regulated family protein [*Arabidopsis thaliana*] | LN | | |
| 1114 | 73352 | 0 | 97 | ref|NP_566304.1|armadillo/beta-catenin repeat family protein/U-box domain-containing protein [*Arabidopsis thaliana*] | LN | | |
| 1115 | 72814 | 0 | 100 | ref|NP_566558.1|F-box family protein [*Arabidopsis thaliana*] | PP | CS | PEG |
| 1116 | 72816 | 0 | 100 | ref|NP_566824.1|CARA (CARBAMOYL PHOSPHATE SYNTHETASE A); carbamoyl-phosphate synthase (glutamine-hydrolyzing) [*Arabidopsis thaliana*] | PP | | |
| 1117 | 72820 | 0 | 89 | ref|NP_194653.1|leucine-rich repeat family protein/extensin family protein [*Arabidopsis thaliana*] | LL | | |
| 1118 | 73353 | 0 | 97 | ref|NP_194713.1|MTO2 (METHIONINE OVER-ACCUMULATOR); threonine synthase [*Arabidopsis thaliana*] | HS | PEG | |
| 1119 | 75066 | 1.00E−134 | 91 | ref|NP_175644.1|ABA2 (ABA DEFICIENT 2); oxidoreductase [*Arabidopsis thaliana*] | PEG | | |
| 1120 | 78337 | 2.00E−40 | 78 | dbj|BAD43663.1|unknown protein [*Arabidopsis thaliana*] | PEG | | |
| 1121 | 73317 | 0 | 96 | ref|NP_200121.4|oxidoreductase [*Arabidopsis thaliana*] | LN | | |
| 1122 | 73318 | 0 | 94 | ref|NP_568145.1|short-chain dehydrogenase/reductase (SDR) family protein [*Arabidopsis thaliana*] | CS | | |
| 1123 | 73749 | 0 | 97 | gb|AAG51266.1|AC027135_7protein kinase, putative [*Arabidopsis thaliana*] | CS | | |
| 1124 | 18704 | 0 | 88 | ref|NP_201234.1|DCT/DiT2.1 (DICARBOXYLATE TRANSPORT); oxoglutarate:malate antiporter [*Arabidopsis thaliana*] | PEG | | |
| 1125 | 73221 | 1.00E−162 | 82 | ref|NP_563785.1|C2 domain-containing protein [*Arabidopsis thaliana*] | CK | LL | |
| 1126 | 71125 | 1.00E−117 | 94 | ref|NP_172671.1|Rho GDP-dissociation inhibitor family protein [*Arabidopsis thaliana*] | HS | | |
| 1127 | 76203 | 0 | 97 | ref|NP_200678.2|phosphoinositide-specific phospholipase C family protein [*Arabidopsis thaliana*] | PEG | | |
| 1128 | 75067 | 0 | 100 | ref|NP_566565.1|peroxidase, putative [*Arabidopsis thaliana*] | PEG | | |
| 1129 | 73729 | 0 | 100 | ref|NP_194944.1|CYP96A2 (cytochrome P450, family 96, subfamily A, polypeptide 2); oxygen binding [*Arabidopsis thaliana*] | LL | | |
| 1130 | 75206 | 0 | 95 | ref|NP_197962.1|GA3 (GA REQUIRING 3); oxygen binding [*Arabidopsis thaliana*] | HS | | |
| 1131 | 73248 | 0 | 100 | ref|NP_200532.1|CYP81F2 (cytochrome P450, family 81, subfamily F, polypeptide 2); oxygen binding [*Arabidopsis thaliana*] | HS | | |
| 1132 | 73738 | 0 | 93 | ref|NP_198641.1|serine/threonine protein kinase, putative [*Arabidopsis thaliana*] | DS | | |
| 1133 | 73332 | 0 | 97 | ref|NP_173685.1|SUC2 (SUCROSE-PROTON SYMPORTER 2); carbohydrate transporter/sucrose:hydrogen symporter/sugar porter [*Arabidopsis thaliana*] | PP | | |
| 1134 | 78335 | 0 | 100 | ref|NP_189582.1|UDP-glucose 6-dehydrogenase, putative [*Arabidopsis thaliana*] | HS | LL | PP |
| 1135 | 75821 | 6.00E−76 | 90 | ref|NP_190424.1|unknown protein [*Arabidopsis thaliana*] | LL | | |
| 1136 | 72038 | 0 | 97 | emb|CAA18501.1|Calcium-dependent serine/threonine protein kinase [*Arabidopsis thaliana*] | HS | | |
| 1137 | 72027 | 0 | 91 | ref|NP_849857.1|copine-related [*Arabidopsis thaliana*] | DS | | |
| 1138 | 72016 | 0 | 97 | ref|NP_200887.1|ATGCN1 (*Arabidopsis thaliana* general control non-repressible 1) | CS | | |
| 1139 | 70835 | 1.00E−128 | 82 | ref|NP_181461.1|PGPS1 (PHOSPHATIDYLGLYCEROLPHOSPHATE + SYNTHASE + 1); CDP-alcohol phosphatidyltransferase [*Arabidopsis thaliana*] | SS | | |
| 1140 | 72044 | 0 | 99 | ref|NP_014446.1|Protein proposed to interact with phospholipid translocases, shares similarity to Cdc50p; Ynr048wp [*Saccharomyces cerevisiae*] | CS | | |
| 1141 | 72092 | 0 | 92 | ref|NP_010796.1|High-affinity glutamine permease, also transports Leu, Ser, Thr, Cys, Met and Asn; expression is fully dependent on Grr1p and modulated by the Ssy1p-Ptr3p-Ssy5p (SPS) sensor of extracellular amino acids; Gnp1p [*Saccharomyces cerevisiae*] | CK | | |
| 1142 | 72124 | 1.00E−173 | 55 | emb|CAO64952.1|unnamed protein product [*Vitis vinifera*] | HS | | |
| 1143 | 72110 | 1.00E−172 | 63 | emb|CAN75218.1|hypothetical protein [*Vitis vinifera*] | HS | | |
| 1144 | 73916 | 1.00E−162 | 57 | ref|NP_569047.1|SKIP2 (SKP1 INTERACTING PARTNER 2); ubiquitin-protein ligase [*Arabidopsis thaliana*] | HS | | |
| 1145 | 74268 | 0 | 100 | ref|NP_186851.1|aspartate kinase, lysine-sensitive, putative [*Arabidopsis thaliana*] | HS | LL | |

TABLE 3-continued

| PEP SEQ ID NO | Construct | E-value | % Id | Annotation Description | traits | | |
|---|---|---|---|---|---|---|---|
| 1146 | 74269 | 0 | 94 | ref\|NP_566764.1\|bile acid:sodium symporter family protein [*Arabidopsis thaliana*] | DS | | |
| 1147 | 77902 | 0 | 96 | ref\|NP_197021.2\|tyrosyl-DNA phosphodiesterase-related [*Arabidopsis thaliana*] | SS | | |
| 1148 | 74273 | 1.00E−180 | 100 | ref\|NP_199285.1\|molybdenum cofactor sulfurase family protein [*Arabidopsis thaliana*] | HS | | |
| 1149 | 74280 | 1.00E−165 | 94 | emb\|CAA58893.1\|cysteine synthase [*Arabidopsis thaliana*] | HS | | |
| 1150 | 74281 | 0 | 94 | ref\|NP_197655.1\|prephenate dehydratase family protein [*Arabidopsis thaliana*] | LL | | |
| 1151 | 74287 | 0 | 100 | ref\|NP_974217.1\|SUVR4 [*Arabidopsis thaliana*] | CK | HS | |
| 1152 | 73767 | 1.00E−156 | 100 | ref\|NP_194231.1\|nodulin MtN3 family protein [*Arabidopsis thaliana*] | LN | | |
| 1153 | 77304 | 0 | 100 | ref\|NP_175700.2\|catalytic [*Arabidopsis thaliana*] | CK | HS | PEG |
| 1154 | 73761 | 0 | 95 | ref\|NP_566683.1\|mitochondrial substrate carrier family protein [*Arabidopsis thaliana*] | LL | | |
| 1155 | 74721 | 0 | 93 | ref\|NP_194568.1\|AAC3 (ADP/ATP CARRIER 3); ATP:ADP antiporter/binding [*Arabidopsis thaliana*] | LL | | |
| 1156 | 74719 | 0 | 91 | ref\|NP_198474.1\|protein phosphatase 2C, putative/PP2C, putative [*Arabidopsis thaliana*] | CK | | |
| 1157 | 74257 | 0 | 98 | ref\|NP_179113.2\|fatty acid elongase, putative [*Arabidopsis thaliana*] | DS | HS | |
| 1158 | 72749 | 0 | 95 | ref\|NP_176767.1\|regulator of chromosome condensation (RCC1) family protein/zinc finger protein-related [*Arabidopsis thaliana*] | HS | LL | |
| 1159 | 72703 | 2.00E−77 | 92 | ref\|NP_013963.1\|Subunit (17 kDa) of TFIID and SAGA complexes, involved in RNA polymerase II transcription initiation and in chromatin modification, similar to histone H3; Taf9p [*Saccharomyces cerevisiae*] | PEG | | |
| 1160 | 72763 | 0 | 98 | ref\|NP_009691.1\|Protein arginine N-methyltransferase that exhibits septin and Hsl1p-dependent bud neck localization and periodic Hsl1p-dependent phosphorylation; required along with Hsl1p for bud neck recruitment, phosphorylation, and degradation of Swe1p; Hsl7p [*Saccharomyces cerevisiae*] | SS | | |
| 1161 | 72775 | 1.00E−172 | 100 | ref\|NP_009718.1\|Catalytic subunit of the main cell cycle cyclin-dependent kinase (CDK); alternately associates with G1 cyclins (CLNs) and G2/M cyclins (CLBs) which direct the CDK to specific substrates; Cdc28p [*Saccharomyces cerevisiae*] | HS | | |
| 1162 | 72728 | 0 | 96 | ref\|NP_013106.1\|Cytoplasmic response regulator, part of a two-component signal transducer that mediates osmosensing via a phosphorelay mechanism; dephosphorylated form is degraded by the ubiquitin-proteasome system; potential Cdc28p substrate; Ssk1p [*Saccharomyces cerevisiae*] | CS | | |
| 1163 | 72776 | 1.00E−101 | 92 | gb\|EDN62754.1\|oxidant-induced cell cycle arrest [*Saccharomyces cerevisiae* YJM789] | HS | | |
| 1164 | 72717 | 1.00E−131 | 100 | ref\|NP_011075.1\|TATA-binding protein, general transcription factor that interacts with other factors to form the preinitiation complex at promoters, essential for viability; Spt15p [*Saccharomyces cerevisiae*] | DS | | |
| 1165 | 72718 | 1.00E−159 | 90 | ref\|NP_011400.1\|Activating gamma subunit of the AMP-activated Snf1p kinase complex (contains Snf1p and a Sip1p/Sip2p/Gal83p family member); activates glucose-repressed genes, represses glucose-induced genes; role in sporulation, and peroxisome biogenesis; Snf4p [*Saccharomyces cerevisiae*] | DS | | |
| 1166 | 11715 | 0 | 93 | ref\|NP_187616.1\|OMR1 (L-O-METHYLTHREONINE RESISTANT 1); threonine ammonia-lyase [*Arabidopsis thaliana*] | LN | | |
| 1167 | 72779 | 0 | 93 | ref\|NP_011622.1\|B-type cyclin involved in cell cycle progression; activates Cdc28p to promote the transition from G2 to M phase; accumulates during G2 and M, then targeted via a destruction box motif for ubiquitin-mediated degradation by the proteasome; Clb1p [*Saccharomyces cerevisiae*] | DS | | |
| 1168 | 72791 | 0 | 100 | ref\|NP_009709.1\|Protein of unknown function, required for normal localization of actin patches and for normal tolerance of sodium ions and hydrogen peroxide; localizes to both cytoplasm and nucleus; Apd1p [*Saccharomyces cerevisiae*] | DS | HS | |
| 1169 | 72732 | 0 | 100 | ref\|NP_013662.1\|Putative protein of unknown function; non-essential gene; null mutant displays increased frequency of mitochondrial genome loss (petite formation); Aim32p [*Saccharomyces cerevisiae*] | HS | | |

TABLE 3-continued

| PEP SEQ ID NO | Construct | E-value | % Id | Annotation Description | traits | | |
|---|---|---|---|---|---|---|---|
| 1170 | 73027 | 1.00E−125 | 93 | ref|NP_187445.1|Rho GDP-dissociation inhibitor family protein [*Arabidopsis thaliana*] | CS | | |
| 1171 | 73058 | 0 | 96 | ref|NP_175591.1|leucine-rich repeat protein kinase, putative [*Arabidopsis thaliana*] | CK | | |
| 1172 | 73126 | 0 | 95 | ref|NP_173076.1|protein kinase family protein [*Arabidopsis thaliana*] | PEG | | |
| 1173 | 73138 | 0 | 91 | ref|NP_356682.2|aldehyde dehydrogenase [*Agrobacterium tumefaciens* str. C58] | HS | | |
| 1174 | 73174 | 0 | 94 | ref|NP_241069.1|glycine betaine aldehyde dehydrogenase [*Bacillus halodurans* C-125] | HS | | |
| 1175 | 73186 | 0 | 99 | ref|NP_241405.1|NADP-dependent aldehyde dehydrogenase [*Bacillus halodurans* C-125] | HS | LN | |
| 1176 | 11141 | 0 | 100 | ref|NP_568064.1|AGT2 (ALANINE:GLYOXYLATE AMINOTRANSFERASE 2); alanine-glyoxylate transaminase [*Arabidopsis thaliana*] | LN | | |
| 1177 | 73139 | 0 | 89 | ref|NP_242876.1|aldehyde dehydrogenase [*Bacillus halodurans* C-125] | CS | | |
| 1178 | 73128 | 0 | 97 | ref|NP_388272.1|4-aminobutyrate aminotransferase [*Bacillus subtilis* subsp. *subtilis* str. 168] | HS | | |
| 1179 | 73164 | 0 | 93 | ref|NP_389241.1|transaminase [*Bacillus subtilis* subsp. *subtilis* str. 168] | PEG | | |
| 1180 | 73117 | 0 | 97 | ref|NP_391762.1|aldehyde dehydrogenase [*Bacillus subtilis* subsp. *subtilis* str. 168] | CS | HS | |
| 1181 | 73142 | 0 | 99 | ref|YP_585121.1|glyceraldehyde-3-phosphate dehydrogenase, type I [*Ralstonia metallidurans* CH34] | PP | SS | |
| 1182 | 73990 | 1.00E−154 | 90 | ref|NP_949547.1|glutaminase [*Rhodopseudomonas palustris* CGA009] | HS | | |
| 1183 | 73166 | 1.00E−117 | 100 | ref|NP_384268.1|phosphoglyceromutase [*Sinorhizobium meliloti* 1021] | SS | | |
| 1184 | 73178 | 0 | 91 | ref|NP_385430.1|PUTATIVE AMINOTRANSFERASE PROTEIN [*Sinorhizobium meliloti* 1021] | LL | | |
| 1185 | 73190 | 1.00E−142 | 99 | ref|NP_385544.1|PROBABLE TRIOSEPHOSPHATE ISOMERASE PROTEIN [*Sinorhizobium meliloti* 1021] | PEG | | |
| 1186 | 73131 | 0 | 99 | ref|NP_386510.1|beta amino acid--pyruvate transaminase [*Sinorhizobium meliloti* 1021] | CK | | |
| 1187 | 73108 | 0 | 92 | ref|NP_929378.1|pyruvate kinase [*Photorhabdus luminescens* subsp. *laumondii* TTO1] | CK | | |
| 1188 | 73074 | 1.00E−171 | 87 | gb|AAO17215.1|Epd [*Photorhabdus luminescens*] | HS | | |
| 1189 | 73132 | 1.00E−80 | 100 | ref|NP_390154.1|nucleoside diphosphate kinase [*Bacillus subtilis* subsp. *subtilis* str. 168] | CS | | |
| 1190 | 73146 | 2.00E−94 | 93 | ref|NP_931715.1|inorganic pyrophosphatase [*Photorhabdus luminescens* subsp. *laumondii* TTO1] | DS | | |
| 1191 | 73147 | 0 | 97 | ref|NP_015444.1|B-type cyclin involved in cell cycle progression; activates Cdc28p to promote the transition from G2 to M phase; accumulates during G2 and M, then targeted via a destruction box motif for ubiquitin-mediated degradation by the proteasome; Clb2p [*Saccharomyces cerevisiae*] | HS | | |
| 1192 | 73080 | 0 | 92 | gb|AAB17351.1|protein phosphatase type 2C [*Saccharomyces cerevisiae*] | LN | | |
| 1193 | 73077 | 0 | 97 | ref|NP_010018.1|Endosomal protein that regulates cell polarity, controls polarized growth; similar to Ynr048wp and Lem3p; Cdc50p [*Saccharomyces cerevisiae*] | HS | | |
| 1194 | 73183 | 0 | 93 | ref|NP_011895.1|Serine/threonine MAP kinase involved in regulating the maintenance of cell wall integrity and progression through the cell cycle; regulated by the PKC1-mediated signaling pathway; Slt2p [*Saccharomyces cerevisiae*] | CS | HS | |
| 1195 | 73018 | 0 | 100 | ref|NP_014582.1|NAD-dependent glycerol 3-phosphate dehydrogenase, homolog of Gpd1p, expression is controlled by an oxygen-independent signaling pathway required to regulate metabolism under anoxic conditions; located in cytosol and mitochondria; Gpd2p [*Saccharomyces cerevisiae*] | HS | | |
| 1196 | 73112 | 0 | 97 | ref|NP_014271.1|Homolog of human tumor suppressor gene PTEN/MMAC1/TEP1 that has lipid phosphatase activity and is linked to the phosphatidylinositol signaling pathway; plays a role in normal sporulation; Tep1p [*Saccharomyces cerevisiae*] | HS | | |
| 1197 | 73988 | 0 | 83 | ref|NP_013664.1|ER localized integral membrane protein that may promote secretion of certain hexose transporters, including Gal2p; involved in glucose-dependent repression; Gsf2p [*Saccharomyces cerevisiae*] | SS | PEG | |
| 1198 | 10908 | 2.00E−61 | 100 | ref|NP_199112.1|ATTRX3 (thioredoxin H-type 3); thiol-disulfide exchange intermediate [*Arabidopsis thaliana*] | CK | | |

TABLE 3-continued

| PEP SEQ ID NO | Construct | E-value | % Id | Annotation Description | traits | |
|---|---|---|---|---|---|---|
| 1198 | 11147 | 2.00E−61 | 100 | ref|NP_199112.1|ATTRX3 (thioredoxin H-type 3); thiol-disulfide exchange intermediate [*Arabidopsis thaliana*] | LN | |
| 1199 | 72909 | 0 | 95 | ref|NP_011569.1|High affinity methionine permease, integral membrane protein with 13 putative membrane-spanning regions; also involved in cysteine uptake; Mup1p [*Saccharomyces cerevisiae*] | HS | |
| 1200 | 73987 | 0 | 94 | ref|NP_010444.1|Component of the SPS plasma membrane amino acid sensor system (Ssy1p-Ptr3p-Ssy5p), which senses external amino acid concentration and transmits intracellular signals that result in regulation of expression of amino acid permease genes; Ssy1p [*Saccharomyces cerevisiae*] | PP | SS |
| 1201 | 72922 | 0 | 91 | ref|NP_010082.1|Putative transporter, member of the sugar porter family; Ydl199cp[*Saccharomyces cerevisiae*] | LL | |
| 1202 | 73036 | 0 | 95 | ref|NP_010022.1|Plasma membrane permease, mediates uptake of glycerophosphoinositol and glycerophosphocholine as sources of the nutrients inositol and phosphate; expression and transport rate are regulated by phosphate and inositol availability; Git1p [*Saccharomyces cerevisiae*] | CS | HS |
| 1203 | 72958 | 0 | 94 | ref|NP_014622.1|High affinity tryptophan and tyrosine permease, overexpression confers FK506 and FTY720 resistance; Tat2p [*Saccharomyces cerevisiae*] | HS | PP |
| 1204 | 77006 | 1.00E−167 | 100 | ref|NP_182073.1|ATAUR3 (ATAURORA3); ATP binding/histone serine kinase(H3-S10 specific)/protein kinase [*Arabidopsis thaliana*] | LL | LN |
| 1205 | 74732 | 0 | 90 | ref|NP_177415.1|casein kinase, putative [*Arabidopsis thaliana*] | CK | |
| 1206 | 74333 | 1.00E−158 | 100 | ref|NP_180976.1|protein kinase family protein [*Arabidopsis thaliana*] | HS | |
| 1207 | 74735 | 0 | 100 | ref|NP_173489.2|protein kinase [*Arabidopsis thaliana*] | LN | |
| 1208 | 74736 | 0 | 100 | ref|NP_176353.1|protein kinase, putative [*Arabidopsis thaliana*] | LL | |
| 1209 | 74737 | 0 | 100 | gb|AAF16665.1|AC012394_14putative protein kinase; 59396-62219 [*Arabidopsis thaliana*] | HS | |
| 1210 | 76657 | 0 | 95 | ref|NP_187827.1|protein kinase family protein [*Arabidopsis thaliana*] | SP | LL |
| 1211 | 76113 | 0 | 94 | ref|NP_187165.2|protein kinase family protein [*Arabidopsis thaliana*] | CS | |
| 1212 | 74747 | 0 | 92 | ref|NP_174161.1|protein kinase family protein [*Arabidopsis thaliana*] | HS | |
| 1213 | 77309 | 0 | 87 | ref|NP_175879.2|protein kinase family protein [*Arabidopsis thaliana*] | PEG | |
| 1214 | 74322 | 0 | 94 | gb|AAG52342.1|AC011663_21 putative protein kinase; 29119-30743 [*Arabidopsis thaliana*] | LL | |
| 1215 | 76212 | 1.00E−170 | 93 | ref|NP_200959.2|NADP-dependent oxidoreductase, putative [*Arabidopsis thaliana*] | HS | LN |
| 1216 | 76514 | 1.00E−159 | 85 | ref|NP_568357.1|AAA-type ATPase family protein [*Arabidopsis thaliana*] | LL | DS |
| 1217 | 75242 | 0 | 84 | ref|NP_200318.1|2-oxoacid dehydrogenase family protein [*Arabidopsis thaliana*] | LL | |
| 1218 | 77324 | 0 | 97 | gb|AAF79717.1|AC020889_25T1N15.3 [*Arabidopsis thaliana*] | PEG | LN |
| 1219 | 74350 | 3.00E−95 | 93 | ref|NP_178122.1|APT2 (ADENINE PHOSPHORIBOSYL TRANSFERASE 2); adenine phosphoribosyltransferase [*Arabidopsis thaliana*] | LN | |
| 1220 | 77606 | 0 | 96 | ref|NP_190925.1|AFC1 (ARABIDOPSIS FUS3-COMPLEMENTING GENE 1); kinase [*Arabidopsis thaliana*] | HS | SS |
| 1221 | 76530 | 0 | 92 | ref|NP_567069.1|F-box family protein-related [*Arabidopsis thaliana*] | HS | |
| 1222 | 76716 | 1.00E−86 | 61 | ref|NP_565175.1|RNA recognition motif (RRM)-containing protein [*Arabidopsis thaliana*] | HS | |
| 1223 | 77328 | 0 | 89 | ref|NP_567904.1|RNA recognition motif (RRM)-containing protein [*Arabidopsis thaliana*] | HS | |
| 1224 | 12204 | 0 | 100 | ref|NP_189366.1|G6PD5(GLUCOSE-6-PHOSPHATE DEHYDROGENASE 5); glucose-6-phosphate 1-dehydrogenase [*Arabidopsis thaliana*] | DS | |
| 1225 | 77011 | 0 | 96 | ref|NP_563818.1|strictosidine synthase family protein [*Arabidopsis thaliana*] | LL | |
| 1226 | 77607 | 0 | 94 | ref|NP_175157.1|NRAMP2 (NRAMP metal ion transporter 2); metal ion transporter [*Arabidopsis thaliana*] | LL | PEG |
| 1227 | 74612 | 1.00E−68 | 100 | ref|NP_177750.1|unknown protein [*Arabidopsis thaliana*] | HS | |
| 1228 | 76126 | 1.00E−144 | 100 | ref|NP_179467.1|signal recognition particle binding [*Arabidopsis thaliana*] | HS | |

TABLE 3-continued

| PEP SEQ ID NO | Construct | E-value | % Id | Annotation Description | traits | | |
|---|---|---|---|---|---|---|---|
| 1229 | 74376 | 1.00E−150 | 95 | ref|NP_181340.1|DET2 (DE-ETIOLATED 2) [*Arabidopsis thaliana*] | DS | | |
| 1230 | 74377 | 1.00E−46 | 100 | ref|NP_181546.1|ATEM6 (*ARABIDOPSIS* EARLY METHIONINE-LABELLED 6) [*Arabidopsis thaliana*] | DS | LL | PEG |
| 1231 | 74381 | 6.00E−63 | 100 | ref|NP_181990.1|mtACP-1 (MITOCHONDRIAL ACYL CARRIER PROTEIN 1); acyl carrier [*Arabidopsis thaliana*] | CS | | |
| 1232 | 78364 | 6.00E−88 | 87 | ref|NP_566062.1|UBC6 (UBIQUITIN-CONJUGATING ENZYME 6); ubiquitin-protein ligase [*Arabidopsis thaliana*] | HS | | |
| 1233 | 74623 | 1.00E−115 | 75 | ref|NP_188379.1|late embryogenesis abundant domain-containing protein/LEA domain-containing protein [*Arabidopsis thaliana*] | HS | | |
| 1234 | 74668 | 1.00E−122 | 88 | ref|NP_188888.1|late embryogenesis abundant protein, putative/LEA protein, putative [*Arabidopsis thaliana*] | DS | | |
| 1235 | 74629 | 5.00E−83 | 90 | ref|NP_566782.1|unknown protein [*Arabidopsis thaliana*] | LL | | |
| 1236 | 74635 | 1.00E−113 | 92 | ref|NP_190864.1|peroxiredoxin type 2, putative [*Arabidopsis thaliana*] | CS | | |
| 1237 | 74638 | 1.00E−100 | 100 | ref|NP_191788.1|ATARFA1E (ADP-ribosylation factor A1E); GTP binding/phospholipase activator/protein binding [*Arabidopsis thaliana*] | HS | SS | |
| 1238 | 76721 | 1.00E−148 | 77 | ref|NP_192093.1|KCO5 (Ca2+ activated outward rectifying K+ channel 5); outward rectifier potassium channel [*Arabidopsis thaliana*] | PEG | | |
| 1239 | 78365 | 2.00E−83 | 90 | ref|NP_568004.1|UBC17 (UBIQUITIN-CONJUGATING ENZYME 17); ubiquitin-protein ligase [*Arabidopsis thaliana*] | CK | HS | |
| 1240 | 74655 | 1.00E−132 | 91 | ref|NP_195437.1|HCF164 (High chlorophyll fluorescence 164); thiol-disulfide exchange intermediate [*Arabidopsis thaliana*] | LN | | |
| 1241 | 74660 | 1.00E−160 | 92 | ref|NP_196119.1|ATTOC34/OEP34 (Translocase of chloroplast 34) [*Arabidopsis thaliana*] | CS | PEG | |
| 1242 | 74661 | 1.00E−180 | 96 | ref|NP_197135.1|ubiquitin carboxyl-terminal hydrolase family 1 protein [*Arabidopsis thaliana*] | HS | | |
| 1243 | 75259 | 1.00E−101 | 85 | ref|NP_198051.1|drought-responsive family protein [*Arabidopsis thaliana*] | HS | | |
| 1244 | 75282 | 3.00E−93 | 100 | ref|NP_201055.1|ATHVA22B (*Arabidopsis thaliana* HVA22 homologue B) | PEG | | |
| 1245 | 76724 | 0 | 93 | ref|NP_173089.1|organic cation transporter-related [*Arabidopsis thaliana*] | DS | | |
| 1246 | 12350 | 1.00E−131 | 78 | gb|AAM61424.1|serine O-acetyltransferase (EC 2.3.1.30) Sat-52 [*Arabidopsis thaliana*] | LN | | |
| 1247 | 76522 | 0 | 93 | ref|NP_001077495.1|unknown protein [*Arabidopsis thaliana*] | PP | | |
| 1248 | 77903 | 0 | 96 | ref|NP_194952.2|protein kinase family protein [*Arabidopsis thaliana*] | HS | LL | SS |
| 1249 | 76653 | 0 | 100 | ref|NP_568860.1|CIPK21 (CBL-INTERACTING PROTEIN KINASE 21); kinase [*Arabidopsis thaliana*] | CS | | |
| 1250 | 76524 | 0 | 100 | ref|NP_199469.1|protein kinase family protein [*Arabidopsis thaliana*] | CS | | |
| 1251 | 11356 | 1.00E−172 | 100 | ref|NP_181165.1|APG10 (ALBINO AND PALE GREEN 10); 1-(5-phosphoribosyl)-5-[(5-phosphoribosylamino)methylideneamino]imidazole-4-carboxamide isomerase [*Arabidopsis thaliana*] | LN | | |
| 1252 | 75275 | 0 | 94 | ref|NP_199586.1|protein kinase, putative [*Arabidopsis thaliana*] dbj|BAA01715.1| serine/threonine protein kinase [*Arabidopsis thaliana*] | LL | | |
| 1253 | 76225 | 0 | 94 | ref|NP_195285.3|CONNEXIN 32; kinase [*Arabidopsis thaliana*] | PEG | | |
| 1254 | 75281 | 0 | 94 | ref|NP_568893.1|protein kinase family protein [*Arabidopsis thaliana*] | HS | | |
| 1255 | 74384 | 1.00E−102 | 100 | ref|NP_175960.1|prenylated rab acceptor (PRA1) family protein [*Arabidopsis thaliana*] | LL | | |
| 1256 | 71238 | 1.00E−168 | 84 | ref|NP_563814.1|DCP1 (DECAPPING 1) [*Arabidopsis thaliana*] | LN | | |
| 1257 | 12354 | 0 | 100 | ref|NP_172738.1|UGE1 (UDP-D-glucose/UDP-D-galactose 4-epimerase 1); UDP-glucose 4-epimerase/protein dimerization [*Arabidopsis thaliana*] | DS | | |
| 1258 | 76236 | 1.00E−157 | 100 | ref|NP_201384.1|leucine-rich repeat family protein [*Arabidopsis thaliana*] | HS | | |
| 1259 | 74682 | 4.00E−83 | 100 | ref|NP_565581.1|unknown protein [*Arabidopsis thaliana*] | CS | | |
| 1260 | 73425 | 0 | 95 | ref|NP_391649.1|transaminase [*Bacillus subtilis* subsp. *subtilis* str. 168] | LL | | |
| 1261 | 73438 | 0 | 99 | ref|YP_351136.1|Glutamate-ammonia ligase [*Pseudomonas fluorescens* PfO-1] | SP | | |
| 1262 | 73474 | 0 | 92 | ref|NP_790236.1|phosphoglycerate kinase [*Pseudomonas syringae* pv. *tomato* str. DC3000] | HS | PP | |

TABLE 3-continued

| PEP SEQ ID NO | Construct | E-value | % Id | Description | traits | | |
|---|---|---|---|---|---|---|---|
| 1263 | 70850 | 0 | 97 | ref\|NP_190853.1\|ATELP1 (VACUOLAR SORTING RECEPTOR HOMOLOG) [*Arabidopsis thaliana*] | HS | | |
| 1264 | 73429 | 1.00E−144 | 100 | ref\|ZP_01370194.1\|pyrroline-5-carboxylate reductase [*Desulfitobacterium hafniense* DCB-2] | HS | SS | CS |
| 1265 | 73441 | 0 | 94 | ref\|ZP_01370604.1\|enolase [*Desulfitobacterium hafniense* DCB-2] | PEG | | |
| 1266 | 73466 | 0 | 97 | ref\|ZP_00108577.1\|COG1063: Threonine dehydrogenase and related Zn-dependent dehydrogenases [*Nostoc punctiforme* PCC 73102] | LN | | |
| 1267 | 73455 | 1.00E−159 | 100 | ref\|NP_792905.1\|UTP-glucose-1-phosphate uridylyltransferase [*Pseudomonas syringae* pv. *tomato* str. DC3000] | HS | | |
| 1268 | 73432 | 0 | 94 | ref\|YP_582700.1\|Alcohol dehydrogenase, zinc-binding [*Ralstonia metallidurans* CH34] | CS | | |
| 1269 | 73435 | 0 | 97 | ref\|NP_391271.1\|phosphoglyceromutase [*Bacillus subtilis* subsp. *subtilis* str. 168] | LN | | |
| 1270 | 77726 | 0 | 99 | ref\|NP_391273.1\|phosphoglycerate kinase [*Bacillus subtilis* subsp. *subtilis* str. 168] | HS | | |
| 1271 | 73483 | 0 | 96 | ref\|NP_009362.1\|Pyruvate kinase, functions as a homotetramer in glycolysis to convert phosphoenolpyruvate to pyruvate, the input for aerobic (TCA cycle) or anaerobic (glucose fermentation) respiration; Cdc19p [*Saccharomyces cerevisiae*] | LL | | |
| 1272 | 73472 | 0 | 99 | ref\|NP_387397.1\|ASPARTATE AMINOTRANSFERASE B PROTEIN [*Sinorhizobium meliloti* 1021] | DS | | |
| 1273 | 73526 | 0 | 94 | ref\|NP_242877.1\|benzyl alcohol dehydrogenase [*Bacillus halodurans* C-125] | DS | | |
| 1274 | 73538 | 0 | 100 | ref\|NP_243126.1\|hypothetical protein BH2260 [*Bacillus halodurans* C-125] | HS | | |
| 1275 | 73574 | 1.00E−177 | 100 | ref\|NP_244591.1\|2-keto-3-deoxygluconate kinase [*Bacillus halodurans* C-125] | HS | | |
| 1276 | 73539 | 1.00E−170 | 100 | ref\|NP_287481.1\|UTP--glucose-1-phosphate uridylyltransferase subunit GalU [*Escherichia coli* O157:H7 EDL933] | CS | | |
| 1277 | 73563 | 3.00E−62 | 90 | ref\|NP_743010.1\|nucleoside diphosphate kinase [*Pseudomonas putida* KT2440] | CK | | |
| 1278 | 73575 | 1.00E−175 | 100 | ref\|NP_792508.1\|fructokinase [*Pseudomonas syringae* pv. *tomato* str. DC3000] | LL | | |
| 1279 | 73565 | 0 | 95 | ref\|NP_011707.1\|High-affinity histidine permease, also involved in the transport of manganese ions; Hip1p [*Saccharomyces cerevisiae*] | HS | | |
| 1280 | 73531 | 0 | 93 | ref\|NP_388151.1\|hypothetical protein BSU02690 [*Bacillus subtilis* subsp. *subtilis* str. 168] | DS | | |
| 1281 | 73592 | 0 | 96 | ref\|NP_391888.1\|6-phosphogluconate dehydrogenase [*Bacillus subtilis* subsp. *subtilis* str. 168] | LN | | |
| 1282 | 74149 | 0 | 100 | ref\|NP_794093.1\|pyruvate kinase [*Pseudomonas syringae* pv. *tomato* str. DC3000] | LL | | |
| 1283 | 74174 | 0 | 99 | ref\|NP_416880.1\|prediected aminotransferase, PLP-dependent [*Escherichia coli* K12] | LL | LN | |
| 1284 | 74151 | 0 | 100 | ref\|NP_417148.1\|4-aminobutyrate aminotransferase, PLP-dependent [*Escherichia coli* K12] | PP | | |
| 1285 | 74104 | 0 | 100 | ref\|ZP_01369074.1\|glucose-1-phosphate adenylyltransferase [*Desulfitobacterium hafniense* DCB-2] | CS | HS | |
| 1286 | 74164 | 0 | 89 | ref\|NP_242876.1\|aldehyde dehydrogenase [*Bacillus halodurans* C-125] | DS | | |
| 1287 | 74129 | 0 | 77 | ref\|YP_001185919.1\|methylmalonate-semialdehyde dehydrogenase [*Pseudomonas mendocina* ymp] | CK | | |
| 1288 | 72340 | 0 | 97 | ref\|NP_195674.2\|GGT1; gamma-glutamyltransferase/ glutathione gamma-glutamylcysteinyltransferase [*Arabidopsis thaliana*] | HS | | |
| 1289 | 74155 | 0 | 100 | ref\|NP_385556.1\|dihydrolipoamide dehydrogenase [*Sinorhizobium meliloti* 1021] | HS | LL | |
| 1290 | 74168 | 0 | 87 | ref\|NP_927730.1\|glutathione reductase [*Photorhabdus luminescens* subsp. *laumondii* TTO1] | LN | | |
| 1291 | 74133 | 0 | 96 | ref\|ZP_00109554.2\|COG1249: Pyruvate/2-oxoglutarate dehydrogenase complex, dihydrolipoamide dehydrogenase (E3) component, and related enzymes [*Nostoc punctiforme* PCC 73102] | HS | | |
| 1292 | 74160 | 4.00E−95 | 99 | ref\|NP_441445.1\|hypothetical protein slr0816 [*Synechocystis* sp. PCC 6803] dbj\|BAA18125.1\| slr0816 [*Synechocystis* sp. PCC 6803] | LL | | |
| 1293 | 74485 | 0 | 88 | ref\|NP_439939.1\|hypothetical protein slr1495 [*Synechocystis* sp. PCC 6803] | HS | | |
| 1294 | 74450 | 0 | 100 | ref\|NP_442868.1\|LIM17 protein [*Synechocystis* sp. PCC 6803] | CK | | |

TABLE 3-continued

| PEP SEQ ID NO | Construct | E-value | % Id | Annotation Description | traits | |
|---|---|---|---|---|---|---|
| 1295 | 74487 | 0 | 90 | ref|NP_357138.2|branched-chain alpha-keto acid dehydrogenase subunit E2 [*Agrobacterium tumefaciens* str. C58] | PP | |
| 1296 | 74406 | 0 | 96 | gb|AAN78639.1|AE016755_139Dihydrolipoamide dehydrogenase [*Escherichia coli* CFT073] | LN | |
| 1297 | 74454 | 1.00E−112 | 91 | ref|NP_927456.1|ribulose-phosphate 3-epimerase (pentose-5-phosphate 3-epimerase) (PPE) (R5P3E) [*Photorhabdus luminescens* subsp. *laumondii* TTO1] | LL | |
| 1298 | 11361 | 6.00E−61 | 83 | ref|NP_176291.1|FED A (FERREDOXIN 2); electron carrier/iron ion binding [*Arabidopsis thaliana*] | LN | |
| 1299 | 74431 | 0 | 99 | ref|NP_390796.1|pyruvate kinase [*Bacillus subtilis* subsp. *subtilis* str. 168] | HS | |
| 1300 | 74411 | 0 | 94 | ref|NP_949979.1|fructose-1,6-bisphosphatase [*Rhodopseudomonas palustris* CGA009] | SS | |
| 1301 | 74424 | 1.00E−172 | 92 | ref|NP_386873.1|PROBABLE FRUCTOSE-BISPHOSPHATE ALDOLASE CLASS I PROTEIN [*Sinorhizobium meliloti* 1021] | PP | |
| 1302 | 74525 | 0 | 83 | ref|NP_931210.1|glutamate synthase subunit beta [*Photorhabdus luminescens* subsp. *laumondii* TTO1] | HS | |
| 1303 | 74573 | 1.00E−75 | 38 | ref|YP_720246.1|aspartate aminotransferase [*Trichodesmium erythraeum* IMS101] | LN | |
| 1304 | 75827 | 2.00E−44 | 82 | ref|NP_565988.1|unknown protein [*Arabidopsis thaliana*] | LL | |
| 1305 | 77329 | 0 | 98 | ref|NP_566005.1|mitochondrial transcription termination factor-related/mTERF-related [*Arabidopsis thaliana*] | CK | |
| 1306 | 77330 | 0 | 97 | ref|NP_182296.1|auxin-responsive GH3 family protein [*Arabidopsis thaliana*] | PEG | |
| 1307 | 75830 | 6.00E−61 | 100 | ref|NP_186754.1|MUB1 (MEMBRANE-ANCHORED UBIQUITIN-FOLD PROTEIN 1 PRECURSOR) [*Arabidopsis thaliana*] | CK | |
| 1308 | 75832 | 2.00E−42 | 85 | ref|NP_186788.1|VMA10 (VACUOLAR MEMBRANE ATPASE 10) [*Arabidopsis thaliana*] | HS | |
| 1309 | 75836 | 7.00E−41 | 73 | ref|NP_187208.1|unknown protein [*Arabidopsis thaliana*] | CS | |
| 1310 | 77034 | 4.00E−28 | 95 | ref|NP_172702.1|unknown protein [*Arabidopsis thaliana*] | HS | PP |
| 1311 | 76255 | 0 | 92 | ref|NP_566390.1|unknown protein [*Arabidopsis thaliana*] | LL | |
| 1312 | 76542 | 1.00E−77 | 69 | ref|NP_188337.1|unknown protein [*Arabidopsis thaliana*] | CS | LL |
| 1313 | 77511 | 0 | 90 | ref|NP_566642.1|unknown protein [*Arabidopsis thaliana*] | SS | CK |
| 1314 | 76261 | 1.00E−127 | 86 | ref|NP_563649.1|unknown protein [*Arabidopsis thaliana*] | HS | |
| 1315 | 78456 | 0 | 97 | ref|NP_189202.1|MAP1B (METHIONINE AMINOPEPTIDASE 1C); metalloexopeptidase [*Arabidopsis thaliana*] | CK | |
| 1316 | 77041 | 1.00E−125 | 95 | ref|NP_189236.3|plastid-lipid associated protein PAP/fibrillin family protein [*Arabidopsis thaliana*] | LN | |
| 1317 | 76546 | 0 | 90 | gb|AAF79247.1|AC006917_32F10B6.11 [*Arabidopsis thaliana*] | LL | |
| 1318 | 75848 | 9.00E−96 | 100 | ref|NP_189535.1|AIG2 (AVRRPT2-INDUCED GENE 2) [*Arabidopsis thaliana*] | CK | HS |
| 1319 | 77515 | 0 | 80 | ref|NP_189945.1|zinc knuckle (CCHC-type) family protein [*Arabidopsis thaliana*] | HS | |
| 1320 | 76266 | 0 | 82 | emb|CAB83070.1|putative protein [*Arabidopsis thaliana*] | PEG | |
| 1321 | 75852 | 1.00E−26 | 100 | ref|NP_190227.1|unknown protein [*Arabidopsis thaliana*] | HS | |
| 1322 | 76556 | 0 | 86 | ref|NP_190445.2|zinc finger (DHHC type) family protein [*Arabidopsis thaliana*] | PEG | |
| 1323 | 77523 | 1.00E−174 | 96 | ref|NP_001078291.1|unknown protein [*Arabidopsis thaliana*] | HS | |
| 1324 | 75863 | 1.00E−120 | 100 | ref|NP_191267.1|eukaryotic rpb5 RNA polymerase subunit family protein [*Arabidopsis thaliana*] | CS | |
| 1325 | 77052 | 1.00E−171 | 96 | ref|NP_564000.2|unknown protein [*Arabidopsis thaliana*] | PP | |
| 1326 | 75865 | 1.00E−56 | 80 | ref|NP_173123.1|ribosomal protein-related [*Arabidopsis thaliana*] | CS | |
| 1327 | 76551 | 0 | 92 | ref|NP_173144.1|oxidoreductase, 2OG-Fe(II) oxygenase family protein [*Arabidopsis thaliana*] | PEG | |
| 1328 | 76280 | 0 | 86 | ref|NP_564064.1|phytochrome kinase substrate-related [*Arabidopsis thaliana*] | LL | |
| 1329 | 75874 | 7.00E−96 | 100 | ref|NP_193404.1|glycosyltransferase family protein 28 [*Arabidopsis thaliana*] | PP | |
| 1330 | 75879 | 9.00E−62 | 100 | ref|NP_194229.1|ATGP4 (*Arabidopsis thaliana* geranylgeranylated protein) | HS | |
| 1331 | 75880 | 7.00E−59 | 65 | ref|NP_173435.1|unknown protein [*Arabidopsis thaliana*] | HS | |
| 1332 | 77519 | 1.00E−176 | 90 | ref|NP_196118.1|sad1/unc-84 protein-related [*Arabidopsis thaliana*] | HS | CK |
| 1333 | 76745 | 1.00E−111 | 88 | dbj|BAB09403.1|unnamed protein product [*Arabidopsis thaliana*] | HS | |
| 1334 | 76554 | 1.00E−173 | 91 | ref|NP_197092.1|unknown protein [*Arabidopsis thaliana*] | DS | |
| 1335 | 76746 | 3.00E−93 | 75 | ref|NP_568333.1|unknown protein [*Arabidopsis thaliana*] | CK | |
| 1336 | 76750 | 1.00E−85 | 93 | ref|NP_197746.1|unknown protein [*Arabidopsis thaliana*] | LL | |
| 1337 | 76621 | 3.00E−20 | 100 | ref|NP_198912.1|unknown protein [*Arabidopsis thaliana*] | HS | |

TABLE 3-continued

| PEP SEQ ID NO | Construct | E-value | % Id | Description | traits | | |
|---|---|---|---|---|---|---|---|
| 1338 | 76623 | 1.00E−23 | 80 | ref|NP_568739.1|unknown protein [Arabidopsis thaliana] | LL | | |
| 1339 | 76461 | 1.00E−29 | 78 | gb|AAB86938.1|NOI protein [Arabidopsis thaliana] | CS | | |
| 1340 | 76462 | 5.00E−31 | 100 | ref|NP_564277.1|unknown protein [Arabidopsis thaliana] | HS | pp | |
| 1341 | 78987 | 1.00E−147 | 81 | ref|NP_201096.1|protein binding/zinc ion binding [Arabidopsis thaliana] | HS | | |
| 1342 | 76568 | 0 | 96 | ref|NP_564484.1|unknown protein [Arabidopsis thaliana] | HS | | |
| 1343 | 76176 | 0 | 95 | ref|NP_565009.1|glycosyltransferase family 14 protein/core-2/l-branching enzyme family protein [Arabidopsis thaliana] | CK | | |
| 1344 | 76177 | 1.00E−97 | 100 | ref|NP_177287.1|unknown protein [Arabidopsis thaliana] | LN | | |
| 1345 | 78380 | 0 | 100 | ref|NP_565058.1|eukaryotic translation initiation factor-related [Arabidopsis thaliana] | LN | | |
| 1346 | 76629 | 2.00E−46 | 100 | ref|NP_177894.1|unknown protein [Arabidopsis thaliana] | HS | | |
| 1347 | 76189 | 2.00E−58 | 100 | gb|AAD15467.2|unknown protein [Arabidopsis thaliana] | CS | | |
| 1348 | 76761 | 1.00E−106 | 94 | ref|NP_179133.1|ATARFB1A (ADP-ribosylation factor B1A); GTP binding [Arabidopsis thaliana] | LL | | |
| 1349 | 78608 | 0 | 100 | ref|NP_973624.1|ATORC2/ORC2 (ORIGIN RECOGNITION COMPLEX SECOND LARGEST SUBUNIT) [Arabidopsis thaliana] | PP | | |
| 1350 | 78115 | 1.00E−153 | 100 | ref|NP_181669.1|embryo-abundant protein-related [Arabidopsis thaliana] | CK | DS | |
| 1351 | 74873 | 0 | 100 | ref|NP_416275.1|glutamate dehydrogenase, NADP-specific [Escherichia coli K12] | DS | | |
| 1352 | 74826 | 0 | 99 | ref|NP_416651.1|predicted oxidoreductase [Escherichia coli K12] | HS | | |
| 1353 | 74850 | 0 | 99 | gb|AAN81953.1|AE016766_41D-erythrose 4-phosphate dehydrogenase [Escherichia coli CFT073] | HS | | |
| 1354 | 74887 | 4.00E−76 | 90 | gb|AAD25168.1| aquaporin [Saccharomyces cerevisiae] | PEG | | |
| 1355 | 74804 | 0 | 95 | gb|EDN59233.1|chromatin remodeling complex member, RSC [Saccharomyces cerevisiae YJM789] | HS | SS | PEG |
| 1356 | 74831 | 1.00E−167 | 81 | gb|EAY97794.1|hypothetical protein OsI_019027 [Oryza sativa (indica cultivar-group)] | LN | | |
| 1357 | 74822 | 0 | 69 | emb|CAO62934.1|unnamed protein product [Vitis vinifera] | PEG | | |
| 1358 | 74836 | 1.00E−121 | 70 | ref|NP_187378.1|transcriptional activator, putative [Arabidopsis thaliana] | LN | | |
| 1359 | 74901 | 3.00E−31 | 61 | ref|NP_001064928.1|Os10g0491900 [Oryza sativa (japonica cultivar-group)] | HS | | |
| 1360 | 74974 | 1.00E−112 | 87 | ref|NP_001063296.1|Os09g0443500 [Oryza sativa (japonica cultivar-group)] | HS | | |
| 1361 | 74904 | 1.00E−149 | 82 | ref|NP_001063966.1|Os09g0567900 [Oryza sativa (japonica cultivar-group)] | HS | | |
| 1362 | 74916 | 8.00E−92 | 76 | gb|EAZ28333.1|hypothetical protein OsJ_011816 [Oryza sativa (japonica cultivar-group)] | PEG | | |
| 1363 | 74964 | 1.00E−158 | 95 | ref|NP_417814.1|predicted phosphoribulokinase [Escherichia coli K12] | LL | | |
| 1364 | 74918 | 6.00E−82 | 82 | ref|NP_443015.1|hypothetical protein sll1109 [Synechocystis sp. PCC 6803] | LN | | |
| 1365 | 74966 | 0 | 99 | ref|NP_442146.1|hypothetical protein sll0209 [Synechocystis sp. PCC 6803] | HS | | |
| 1366 | 74979 | 1.00E−142 | 82 | ref|NP_440823.1|hypothetical protein slr1220 [Synechocystis sp. PCC 6803] | CK | LL | |
| 1367 | 74934 | 0 | 96 | ref|YP_350971.1|betaine aldehyde dehydrogenase [Pseudomonas fluorescens PfO-1] | PEG | | |
| 1368 | 77814 | 0 | 92 | ref|NP_116585.1|F-box protein required for G1/S and G2/M transition, associates with Skp1p and Cdc53p to form a complex, SCFCdc4, which acts as ubiquitin-protein ligase directing ubiquitination of the phosphorylated CDK inhibitor Sic1p; Cdc4p [Saccharomyces cerevisiae] | HS | | |
| 1369 | 75387 | 1.00E−148 | 53 | ref|NP_001067713.1|Os11g0293900 [Oryza sativa (japonica cultivar-group)] | CK | LL | |
| 1370 | 75328 | 0 | 93 | ref|NP_001050986.1|Os03g0699200 [Oryza sativa (japonica cultivar-group)] | PP | | |
| 1371 | 77808 | 0 | 74 | emb|CAO63310.1|unnamed protein product [Vitis vinifera] | CS | | |
| 1372 | 75389 | 0 | 69 | ref|NP_001045085.1|Os01g0897100 [Oryza sativa (japonica cultivar-group)] | HS | | |
| 1373 | 75318 | 1.00E−126 | 49 | emb|CAO40140.1|unnamed protein product [Vitis vinifera] | CK | | |
| 1374 | 75330 | 0 | 70 | emb|CAH66847.1|H0525C06.10 [Oryza sativa (indica cultivar-group)] | CS | HS | |
| 1375 | 75342 | 1.00E−75 | 69 | ref|NP_001056004.1|Os05g0509700 [Oryza sativa (japonica cultivar-group)] | CK | | |
| 1376 | 75366 | 4.00E−59 | 74 | ref|NP_001063106.1|Os09g0397700 [Oryza sativa (japonica cultivar-group)] | HS | | |
| 1377 | 75319 | 1.00E−121 | 73 | ref|NP_001050079.1|Os03g0343700 [Oryza sativa (japonica cultivar-group)] | HS | | |
| 1378 | 75391 | 0 | 96 | gb|ABU48662.1|G protein alpha subunit [Sorghum bicolor] | HS | | |

TABLE 3-continued

| PEP SEQ ID NO | Construct | E-value | % Id | Description | traits | | |
|---|---|---|---|---|---|---|---|
| 1379 | 75334 | 4.00E−45 | 92 | ref|NP_001049605.1|Os03g0257900 [*Oryza sativa* (japonica cultivar-group)] | HS | | |
| 1380 | 75323 | 0 | 82 | ref|NP_001053032.1|Os04g0466600 [*Oryza sativa* (japonica cultivar-group)] | HS | | |
| 1381 | 75396 | 5.00E−84 | 77 | ref|NP_001068537.1|Os11g0703400 [*Oryza sativa* (japonica cultivar-group)] | PEG | | |
| 1382 | 75401 | 2.00E−72 | 93 | ref|NP_001059557.1|Os07g0454700 [*Oryza sativa* (japonica cultivar-group)] | HS | | |
| 1383 | 75413 | 1.00E−139 | 90 | ref|NP_001050848.1|Os03g0666700 [*Oryza sativa* (japonica cultivar-group)] | LL | | |
| 1384 | 75461 | 0 | 92 | ref|NP_001066463.1|Os12g0236500 [*Oryza sativa* (japonica cultivar-group)] | HS | SS | PP |
| 1385 | 75473 | 6.00E−50 | 71 | ref|NP_001043914.1|Os01g0687600 [*Oryza sativa* (japonica cultivar-group)] | DS | | |
| 1386 | 77817 | 8.00E−26 | 93 | ref|NP_001045143.1|Os01g0908400 [*Oryza sativa* (japonica cultivar-group)] | LL | | |
| 1387 | 75416 | 1.00E−165 | 81 | gb|EAY92384.1|hypothetical protein OsI_013617 [*Oryza sativa* (indica cultivar-group)] | CK | | |
| 1388 | 75464 | 0 | 68 | gb|EAZ22667.1|hypothetical protein OsJ_006150 [*Oryza sativa* (japonica cultivar-group)] | HS | | |
| 1389 | 75441 | 5.00E−46 | 68 | gb|AAA33773.1|PVPR3 | LN | | |
| 1390 | 75454 | 2.00E−82 | 73 | ref|NP_001064989.1|Os10g0502000 [*Oryza sativa* (japonica cultivar-group)] | HS | | |
| 1391 | 75493 | 4.00E−31 | 51 | emb|CAO48835.1|unnamed protein product [*Vitis vinifera*] | HS | PP | PEG |
| 1392 | 75446 | 2.00E−29 | 55 | gb|ABU54835.1|defender against apoptotic death [*Penaeus monodon*] | CS | HS | |
| 1393 | 75495 | 2.00E−86 | 82 | gb|ABG23395.1|2C-methyl-D-erythritol 2,4-cyclodiphosphate synthase [*Stevia rebaudiana*] | SS | | |
| 1394 | 75705 | 1.00E−102 | 71 | ref|NP_001046126.1|Os02g0187100 [*Oryza sativa* (japonica cultivar-group)] | SP | | |
| 1395 | 77818 | 0 | 100 | ref|NP_241861.1|succinate-semialdehyde dehydrogenase [*Bacillus halodurans* C-125] | HS | PEG | |
| 1396 | 75525 | 0 | 99 | ref|NP_415448.1|aspartate aminotransferase, PLP-dependent [*Escherichia coli* K12] | LN | | |
| 1397 | 75549 | 1.00E−115 | 37 | dbj|BAC10067.1|hypothetical protein [*Oryza sativa* Japonica Group] | SS | | |
| 1398 | 75582 | 0 | 68 | emb|CAO16731.1|unnamed protein product [*Vitis vinifera*] | CS | PEG | |
| 1399 | 75535 | 6.00E−53 | 62 | emb|CAO18074.1|unnamed protein product [*Vitis vinifera*] | PEG | | |
| 1400 | 75547 | 1.00E−164 | 74 | emb|CAO42486.1|unnamed protein product [*Vitis vinifera*] | LL | LN | |
| 1401 | 75512 | 1.00E−141 | 63 | emb|CAO40060.1|unnamed protein product [*Vitis vinifera*] | CS | HS | |
| 1402 | 75673 | 1.00E−158 | 55 | ref|NP_001050262.1|Os03g0387900 [*Oryza sativa* (japonica cultivar-group)] | CK | | |
| 1403 | 75626 | 0 | 78 | gb|EAZ07965.1|hypothetical protein OsI_029197 [*Oryza sativa* (indica cultivar-group)] | HS | | |
| 1404 | 75674 | 4.00E−53 | 66 | gb|EAY98259.1|hypothetical protein OsI_019492 [*Oryza sativa* (indica cultivar-group)] | HS | LN | |
| 1405 | 75615 | 2.00E−46 | 59 | gb|EAY75762.1|hypothetical protein OsI_003609 [*Oryza sativa* (indica cultivar-group)] | CK | | |
| 1406 | 75627 | 1.00E−135 | 92 | gb|EAZ15023.1|hypothetical protein OsJ_004848 [*Oryza sativa* (japonica cultivar-group)] | SS | | |
| 1407 | 75628 | 1.00E−103 | 88 | gb|AAQ24835.1|partner of Nob1 [*Sorghum bicolor*] | PEG | | |
| 1408 | 75652 | 1.00E−139 | 85 | gb|EAY93006.1|hypothetical protein OsI_014239 [*Oryza sativa* (indica cultivar-group)] | CK | | |
| 1409 | 75605 | 1.00E−121 | 55 | ref|NP_001047861.1|Os02g0704600 [*Oryza sativa* (japonica cultivar-group)] | CK | HS | LN |
| 1410 | 70228 | 1.00E−83 | 100 | ref|NP_189581.1|AHP2 (HISTIDINE-CONTAINING PHOSPHOTRANSMITTER 2); histidine phosphotransfer kinase/signal transducer [*Arabidopsis thaliana*] | CK | | |
| 1411 | 13302 | 0 | 95 | gb|AAF21885.1|AF101056_1MEI2 [*Arabidopsis thaliana*] | LN | | |
| 1412 | 75610 | 0 | 86 | ref|NP_001054248.1|Os04g0675500 [*Oryza sativa* (japonica cultivar-group)] | CK | | |
| 1413 | 75623 | 0 | 95 | ref|NP_194630.1|AIM1 (ABNORMAL INFLORESCENCE MERISTEM); enoyl-CoA hydratase [*Arabidopsis thaliana*] | HS | | |
| 1414 | 75671 | 0 | 88 | ref|NP_176918.1|leucine-rich repeat family protein [*Arabidopsis thaliana*] | PP | | |
| 1415 | 75695 | 4.00E−78 | 63 | emb|CAO21783.1|unnamed protein product [*Vitis vinifera*] | HS | | |
| 1416 | 75648 | 2.00E−32 | 46 | ref|NP_001054395.1|Os05g0103500 [*Oryza sativa* (japonica cultivar-group)] dbj|BAF16309.1| Os05g0103500 [*Oryza sativa* (japonica cultivar-group)] | SS | | |
| 1417 | 75672 | 0 | 84 | ref|NP_196925.1|leucine-rich repeat transmembrane protein kinase, putative [*Arabidopsis thaliana*] dbj|BAB08300.1| receptor protein kinase-like protein [*Arabidopsis thaliana*] | PP | | |
| 1418 | 75713 | 1.00E−141 | 43 | emb|CAO21763.1|unnamed protein product [*Vitis vinifera*] | CK | | |
| 1419 | 75714 | 7.00E−35 | 36 | gb|ABK93511.1|unknown [*Populus trichocarpa*] | HS | PP | |
| 1420 | 75762 | 1.00E−171 | 65 | emb|CAN68895.1|hypothetical protein [*Vitis vinifera*] | CK | | |

TABLE 3-continued

| PEP SEQ ID NO | Construct | E-value | % Id | Description | traits | |
|---|---|---|---|---|---|---|
| 1421 | 77954 | 0 | 94 | ref|NP_172684.1|flavin-containing monooxygenase family protein/FMO family protein [*Arabidopsis thaliana*] | HS | |
| 1422 | 77955 | 0 | 95 | ref|NP_172680.1|flavin-containing monooxygenase family protein/FMO family protein [*Arabidopsis thaliana*] | HS | |
| 1423 | 77541 | 7.00E-85 | 100 | gb|ABK28567.1|unknown [*Arabidopsis thaliana*] | LN | |
| 1424 | 78131 | 0 | 93 | emb|CAB42923.1|putative mitochondrial protein [*Arabidopsis thaliana*] | HS | |
| 1425 | 78134 | 6.00E-95 | 91 | ref|NP_192051.2|CBL5 (CALCINEURIN B-LIKE PROTEIN 5) [*Arabidopsis thaliana*] | LN | SS |
| 1426 | 77554 | 1.00E-138 | 75 | tpg|DAA00869.1| TPA_exp: PDR2 ABC transporter [*Arabidopsis thaliana*] | HS | |
| 1427 | 78992 | 1.00E-170 | 90 | ref|NP_194508.1|calcium-binding EF hand family protein [*Arabidopsis thaliana*] | CK | |
| 1428 | 77557 | 0 | 84 | ref|NP_196016.1|IQD12 (IQ-domain 12); calmodulin binding [*Arabidopsis thaliana*] | LL | LN |
| 1429 | 78128 | 0 | 96 | ref|NP_196397.1|flavin-containing monooxygenase family protein/FMO family protein [*Arabidopsis thaliana*] | HS | |
| 1430 | 77560 | 0 | 94 | ref|NP_568202.1|calcium-binding EF hand family protein [*Arabidopsis thaliana*] | CK | HS |
| 1431 | 77561 | 0 | 100 | ref|NP_196694.1|monooxygenase family protein [*Arabidopsis thaliana*] | CS | CK |
| 1432 | 77958 | 1.00E-108 | 74 | ref|NP_197694.1|TET12 (TETRASPANIN12) [*Arabidopsis thaliana*] | PP | |
| 1433 | 77563 | 0 | 92 | ref|NP_197887.1|integral membrane transporter family protein [*Arabidopsis thaliana*] | CS | CK |
| 1434 | 78994 | 0 | 91 | ref|NP_001032056.1|F-box family protein [*Arabidopsis thaliana*] | HS | |
| 1435 | 74508 | 0 | 90 | ref|NP_850439.1|CYP76C1 (cytochrome P450, family 76, subfamily C, polypeptide 1); heme binding/iron ion binding/monooxygenase [*Arabidopsis thaliana*] | CS | HS |
| 1436 | 70229 | 0 | 100 | ref|NP_194337.1|MEK1 (mitogen-activated protein kinase kinase 1); MAP kinase kinase/kinase [*Arabidopsis thaliana*] | HS | |
| 1437 | 77959 | 0 | 90 | ref|NP_200937.1|flavin-containing monooxygenase family protein/FMO family protein [*Arabidopsis thaliana*] | HS | |
| 1438 | 77567 | 0 | 88 | ref|NP_171951.2|integral membrane transporter family protein [*Arabidopsis thaliana*] | HS | LN |
| 1439 | 11749 | 2.00E-52 | 74 | ref|NP_181812.1|PDF1 (PROTODERMAL FACTOR 1) [*Arabidopsis thaliana*] | CK | |
| 1440 | 77578 | 0 | 90 | ref|NP_180886.|integral membrane transporter family protein [*Arabidopsis thaliana*] | HS | |
| 1441 | 11751 | 1.00E-110 | 90 | ref|NP_180871.1|SAR1 (SYNAPTOBREVIN-RELATED PROTEIN 1) [*Arabidopsis thaliana*] | LN | |
| 1442 | 77963 | 0 | 86 | ref|NP_566652.1|unknown protein [*Arabidopsis thaliana*] | LN | |
| 1443 | 77925 | 1.00E-149 | 94 | ref|NP_190985.1|ATFIP37 (*ARABIDOPSIS THALIANA* FKBP12 INTERACTING PROTEIN 37) [*Arabidopsis thaliana*] | HS | PP |
| 1444 | 77927 | 0 | 90 | ref|NP_564083.1|unknown protein [*Arabidopsis thaliana*] | HS | |
| 1445 | 77345 | 2.00E-57 | 100 | ref|NP_564113.1|unknown protein [*Arabidopsis thaliana*] | HS | |
| 1446 | 70230 | 0 | 96 | gb|ABF55662.1|double MYC-tagged mitogen activated protein kinase kinase 2 [synthetic construct] | HS | |
| 1447 | 77353 | 1.00E-65 | 100 | ref|NP_564301.1|unknown protein [*Arabidopsis thaliana*] | HS | |
| 1448 | 77354 | 6.00E-42 | 81 | ref|NP_564312.1|unknown protein [*Arabidopsis thaliana*] | LL | |
| 1449 | 77355 | 1.00E-41 | 90 | ref|NP_564515.1|unknown protein [*Arabidopsis thaliana*] | PP | |
| 1450 | 77588 | 1.00E-152 | 100 | ref|NP_176415.1|unknown protein [*Arabidopsis thaliana*] | CS | |
| 1451 | 77591 | 1.00E-164 | 92 | ref|NP_565628.1|unknown protein [*Arabidopsis thaliana*] | LL | |
| 1452 | 77594 | 1.00E-143 | 72 | emb|CAB46003.1|RING-H2 finger protein RHF1a [*Arabidopsis thaliana*] | DS | |
| 1453 | 77595 | 1.00E-144 | 71 | ref|NP_567661.1|SWIB complex BAF60b domain-containing protein [*Arabidopsis thaliana*] | LL | |
| 1454 | 77364 | 5.00E-76 | 84 | ref|NP_194770.1|transcription factor [*Arabidopsis thaliana*] | LN | |
| 1455 | 78904 | 0 | 100 | emb|CAB87764.1|putative protein [*Arabidopsis thaliana*] | HS | |
| 1456 | 77937 | 0 | 100 | ref|NP_197133.1|acetolactate synthase small subunit, putative [*Arabidopsis thaliana*] | HS | |
| 1457 | 77369 | 1.00E-103 | 86 | ref|NP_197494.1|plastid-lipid associated protein PAP-related/fibrillin-related [*Arabidopsis thaliana*] | DS | |
| 1458 | 77940 | 0 | 89 | ref|NP_568648.1|transducin family protein/WD-40 repeat family protein [*Arabidopsis thaliana*] | CK | HS |
| 1459 | 78746 | 0 | 100 | ref|NP_201387.2|ankyrin repeat family protein [*Arabidopsis thaliana*] | HS | |
| 1460 | 77372 | 1.00E-119 | 94 | ref|NP_201515.1|F-box family protein [*Arabidopsis thaliana*] | DS | |
| 1461 | 78126 | 0 | 86 | gb|AAF24593.1|AC007654_9T19E23.14 [*Arabidopsis thaliana*] | CK | |

TABLE 3-continued

| PEP SEQ ID NO | Construct | E-value | % Id | Description | traits | | | |
|---|---|---|---|---|---|---|---|---|
| 1462 | 77951 | 0 | 100 | ref|NP_565803.1|ATEYA (*ARABIDOPSIS THALIANA* EYES ABSENT HOMOLOG); protein tyrosine phosphatase, metal-dependent [*Arabidopsis thaliana*] | LL | PEG | | |
| 1463 | 75901 | 0 | 97 | gb|EDN61448.1|F-box protein [*Saccharomyces cerevisiae* YJM789] | CS | | | |
| 1464 | 12123 | 1.00E-115 | 86 | ref|NP_196598.1|EMB301 (EMBRYO DEFECTIVE 3010); structural constituent of ribosome [*Arabidopsis thaliana*] | LN | | | |
| 1465 | 75987 | 9.00E-84 | 80 | ref|NP_001105929.1|high affinity nitrate transporter [*Zea mays*] | CS | | | |
| 1466 | 75940 | 0 | 100 | ref|NP_842265.1|Phosphoglucose isomerase (PGI) [*Nitrosomonas europaea* ATCC 19718] | HS | PP | | |
| 1467 | 75919 | 1.00E-175 | 95 | ref|NP_780153.1|isocitrate dehydrogenase [*Xylella fastidiosa* Temecula1] | HS | LL | SS | |
| 1468 | 75908 | 0 | 99 | ref|NP_440384.1|glutamate decarboxylase [*Synechocystis* sp. PCC 6803] | HS | | | |
| 1469 | 75920 | 0 | 100 | ref|NP_440189.1|ferredoxin-sulfite reductase [*Synechocystis* sp. PCC 6803] | HS | | | |
| 1470 | 75992 | 0 | 94 | ref|YP_001636715.1|pyruvate kinase [*Chloroflexus aurantiacus* J-10-fl] | HS | | | |
| 1471 | 75933 | 1.00E-116 | 94 | ref|NP_442343.1|ribose-5-phosphate isomerase A [*Synechocystis* sp. PCC 6803] | HS | PP | | |
| 1472 | 77965 | 0 | 92 | ref|NP_181991.1|kelch repeat-containing F-box family protein [*Arabidopsis thaliana*] | DS | | | |
| 1473 | 77966 | 0 | 89 | ref|NP_186818.1|unknown protein [*Arabidopsis thaliana*] | LN | | | |
| 1474 | 77972 | 0 | 90 | ref|NP_189657.1|unknown protein [*Arabidopsis thaliana*] | HS | | | |
| 1475 | 78522 | 0 | 96 | ref|NP_175744.1|unknown protein [*Arabidopsis thaliana*] | SP | | | |
| 1476 | 12194 | 3.00E-78 | 91 | ref|NP_176772.1|TPX2 (THIOREDOXIN-DEPENDENT PEROXIDASE 2); antioxidant [*Arabidopsis thaliana*] | CK | | | |
| 1477 | 78525 | 0 | 87 | gb|AAC24050.1|Similar to *S. cerevisiae* SIK1P protein | LN | | | |
| 1478 | 78527 | 0 | 87 | gb|AAC18814.1|Contains homology to serine/threonine protein kinase gb|X99618 from *Mycobacterium tuberculosis*. | PEG | | | |
| 1479 | 78917 | 0 | 95 | ref|NP_177258.3|armadillo/beta-catenin repeat family protein/U-box domain-containing protein [*Arabidopsis thaliana*] | LN | | | |
| 1480 | 78920 | 0 | 100 | ref|NP_565146.1|ACR3 (ACT Domain Repeat 3) [*Arabidopsis thaliana*] | PP | | | |
| 1481 | 78535 | 0 | 96 | ref|NP_179324.2|pantothenate kinase-related [*Arabidopsis thaliana*] | CK | | | |
| 1482 | 78538 | 0 | 98 | ref|NP_180538.1|kelch repeat-containing F-box family protein [*Arabidopsis thaliana*] | | | | |
| 1483 | 78922 | 0 | 95 | ref|NP_181393.1|F-box family protein [*Arabidopsis thaliana*] | HS | PP | CS | |
| 1484 | 77984 | 1.00E-109 | 100 | ref|NP_566068.1|unknown protein [*Arabidopsis thaliana*] | LN | CK | | |
| 1485 | 73938 | 0 | 100 | ref|NP_201190.1|AAP4 (amino acid permease 4); amino acid permease [*Arabidopsis thaliana*] | DS | CS | | |
| 1486 | 78621 | 0 | 100 | gb|AAD13704.1|hypothetical protein [*Arabidopsis thaliana*] | HS | | | |
| 1487 | 77990 | 1.00E-74 | 85 | ref|NP_187290.1|integral membrane family protein [*Arabidopsis thaliana*] | DS | | | |
| 1488 | 78386 | 1.00E-132 | 100 | ref|NP_187319.1|peptidyl-prolyl cis-trans isomerase cyclophilin-type family protein [*Arabidopsis thaliana*] | SP | | | |
| 1489 | 78001 | 1.00E-70 | 100 | gb|AAF23196.1|AC016795_9unknown protein [*Arabidopsis thaliana*] | HS | | | |
| 1490 | 78543 | 0 | 90 | ref|NP_187807.1|S-locus related protein SLR1, putative (S1) [*Arabidopsis thaliana*] | HS | | | |
| 1491 | 78002 | 1.00E-136 | 100 | ref|NP_187847.1|unknown protein [*Arabidopsis thaliana*] | LL | | | |
| 1492 | 12259 | 1.00E-134 | 100 | gb|AAM67061.1|ribosomal protein S2, putative [*Arabidopsis thaliana*] | LN | | | |
| 1493 | 78005 | 3.00E-93 | 96 | ref|NP_172796.1|unknown protein [*Arabidopsis thaliana*] | LL | | | |
| 1494 | 78008 | 1.00E-135 | 88 | ref|NP_188459.1|unknown protein [*Arabidopsis thaliana*] | PEG | | | |
| 1495 | 78019 | 1.00E-176 | 94 | ref|NP_001031574.1|unknown protein [*Arabidopsis thaliana*] | CK | HS | | |
| 1496 | 78020 | 2.00E-74 | 89 | gb|ABK28619.1|unknown [*Arabidopsis thaliana*] | SS | | | |
| 1497 | 78023 | 1.00E-121 | 94 | ref|NP_173373.2|unknown protein [*Arabidopsis thaliana*] | DS | | | |
| 1498 | 78548 | 1.00E-146 | 86 | ref|NP_564100.1|abscisic acid-responsive HVA22 family protein [*Arabidopsis thaliana*] | LN | PP | | |
| 1499 | 78161 | 1.00E-103 | 94 | ref|NP_173738.2|caleosin-related family protein [*Arabidopsis thaliana*] | HS | PEG | | |
| 1500 | 78162 | 1.00E-179 | 100 | ref|NP_564270.1|unknown protein [*Arabidopsis thaliana*] | CK | LN | PP | PEG |
| 1501 | 78033 | 1.00E-148 | 90 | ref|NP_564297.1|unknown protein [*Arabidopsis thaliana*] | LL | | | |
| 1502 | 78622 | 0 | 95 | ref|NP_564315.1|unknown protein [*Arabidopsis thaliana*] | CK | | | |
| 1503 | 78036 | 1.00E-67 | 100 | ref|NP_174257.1|unknown protein [*Arabidopsis thaliana*] | DS | | | |
| 1504 | 78043 | 0 | 96 | ref|NP_175182.2|endonuclease/exonuclease/phosphatase family protein [*Arabidopsis thaliana*] | CS | | | |
| 1505 | 78165 | 2.00E-92 | 84 | ref|NP_564788.1|unknown protein [*Arabidopsis thaliana*] | LL | | | |
| 1506 | 78066 | 1.00E-116 | 86 | gb|AAF68106.1|AC010793_1F20B17.2 [*Arabidopsis thaliana*] | PP | | | |

TABLE 3-continued

| PEP SEQ ID NO | Construct | E-value | % Id | Annotation Description | traits | | |
|---|---|---|---|---|---|---|---|
| 1507 | 78069 | 1.00E-124 | 64 | ref|NP_178248.2|pentatricopeptide (PPR) repeat-containing protein [*Arabidopsis thaliana*] | PP | | |
| 1508 | 78183 | 1.00E-115 | 100 | ref|NP_180390.2|unknown protein [*Arabidopsis thaliana*] | PP | | |
| 1509 | 78170 | 2.00E-37 | 100 | gb|AAS47599.1|At2g33690 [*Arabidopsis thaliana*] | PP | | |
| 1510 | 78953 | 1.00E-125 | 88 | ref|NP_565921.1|unknown protein [*Arabidopsis thaliana*] | PP | | |
| 1511 | 78929 | 0 | 97 | ref|NP_182026.1|CCD7 (more axillary growth 3) [*Arabidopsis thaliana*] | LN | | |
| 1512 | 78564 | 1.00E-63 | 100 | ref|NP_188669.1|unknown protein [*Arabidopsis thaliana*] | PEG | | |
| 1513 | 78566 | 0 | 100 | ref|NP_566813.1|unknown protein [*Arabidopsis thaliana*] | HS | | |
| 1514 | 78591 | 0 | 96 | gb|AAG12668.1|AC027033_3hypothetical protein; 23726-25026 [*Arabidopsis thaliana*] | SS | | |
| 1515 | 78181 | 3.00E-99 | 100 | ref|NP_563968.1|unknown protein [*Arabidopsis thaliana*] | LN | | |
| 1516 | 78190 | 2.00E-30 | 71 | ref|NP_564173.1|unknown protein [*Arabidopsis thaliana*] | LL | | |
| 1517 | 78571 | 0 | 93 | gb|AAF79874.1|AC000348_27T7N9.16 [*Arabidopsis thaliana*] | CK | | |
| 1518 | 78933 | 1.00E-107 | 84 | gb|AAG51731.1|AC068667_10hypothetical protein; 69078-67980 [*Arabidopsis thaliana*] | LN | | |
| 1519 | 78573 | 8.00E-73 | 80 | ref|NP_174417.1|LOB domain protein 4/lateral organ boundaries domain protein 4 (LBD4) [*Arabidopsis thaliana*] | CK | | |
| 1520 | 78632 | 0 | 100 | ref|NP_564507.1|unknown protein [*Arabidopsis thaliana*] | HS | LL | PP |
| 1521 | 78959 | 0 | 100 | ref|NP_175985.1|pentatricopeptide (PPR) repeat-containing protein [*Arabidopsis thaliana*] | LN | | |
| 1522 | 78191 | 3.00E-51 | 63 | ref|NP_564986.1|ribosomal protein L12 family protein [*Arabidopsis thaliana*] | HS | LN | |
| 1523 | 78595 | 1.00E-150 | 92 | gb|AAB70396.1|Similar to ATP-dependent Clp protease (gb|D90915). | HS | PEG | |
| 1524 | 78646 | 0 | 100 | ref|NP_172453.1|pentatricopeptide (PPR) repeat-containing protein [*Arabidopsis thaliana*] | HS | | |
| 1525 | 76325 | 1.00E-143 | 82 | gb|EAY88291.1|hypothetical protein OsI_009524 [*Oryza sativa* (indica cultivar-group)] | CS | | |
| 1526 | 76337 | 6.00E-76 | 87 | ref|NP_001053732.1|Os04g0595200 [*Oryza sativa* (japonica cultivar-group)] | HS | | |
| 1527 | 76349 | 1.00E-139 | 56 | ref|NP_001066102.1|Os12g0136200 [*Oryza sativa* (japonica cultivar-group)] | PP | | |
| 1528 | 76302 | 4.00E-75 | 82 | ref|NP_001047161.1|Os02g0564500 [*Oryza sativa* (japonica cultivar-group)] | LL | | |
| 1529 | 76329 | 0 | 92 | ref|NP_014151.1|RNA polymerase I subunit A49; Rpa49p [*Saccharomyces cerevisiae*] | PEG | PP | |
| 1530 | 76353 | 0 | 97 | ref|NP_010937.1|Nucleotide binding alpha subunit of the heterotrimeric G protein that interacts with the receptor Gpr1p, has signaling role in response to nutrients; green fluorescent protein (GFP)-fusion protein localizes to the cell periphery; Gpa2p [*Saccharomyces cerevisiae*] | SS | | |
| 1531 | 76389 | 0 | 83 | ref|NP_014172.1|Co-chaperone that stimulates the ATPase activity of Ssa1p, required for a late step of ribosome biogenesis; associated with the cytosolic large ribosomal subunit; contains a J-domain; mutation causes defects in fluid-phase endocytosis; Jjj1p [*Saccharomyces cerevisiae*] | CK | | |
| 1532 | 76378 | 1.00E-119 | 79 | ref|NP_014726.1|Repressor of G1 transcription that binds to SCB binding factor (SBF) at SCB target promoters in early G1; phosphorylation of Whi5p by the CDK, Cln3p/Cdc28p relieves repression and promoter binding by Whi5; periodically expressed in G1; Whi5p [*Saccharomyces cerevisiae*] | HS | PEG | |
| 1533 | 76392 | 1.00E-59 | 55 | ref|NP_001045725.1|Os02g0122300 [*Oryza sativa* (japonica cultivar-group)] | LL | | |
| 1534 | 76321 | 0 | 76 | ref|NP_001058970.1|Os07g0166100 [*Oryza sativa* (japonica cultivar-group)] | LN | | |
| 1535 | 76345 | 0 | 86 | ref|NP_001043794.1|Os01g0665200 [*Oryza sativa* (japonica cultivar-group)] | DS | | |
| 1536 | 76381 | 0 | 88 | ref|NP_001058289.1|Os06g0663200 [*Oryza sativa* (japonica cultivar-group)] | HS | | |
| 1537 | 76358 | 0 | 76 | ref|NP_001050845.1|Os03g0666200 [*Oryza sativa* (japonica cultivar-group)] | LN | | |
| 1538 | 12629 | 0 | 97 | ref|NP_194110.2|unknown protein [*Arabidopsis thaliana*] | HS | | |
| 1539 | 76335 | 1.00E-101 | 66 | ref|NP_001065630.1|Os11g0127700 [*Oryza sativa* (japonica cultivar-group)] | LL | | |
| 1540 | 76372 | 0 | 82 | gb|EAY93387.1|hypothetical protein OsI_014620 [*Oryza sativa* (indica cultivar-group)] | PP | | |
| 1541 | 76396 | 0 | 57 | ref|NP_001047355.1|Os02g0602100 [*Oryza sativa* (japonica cultivar-group)] | DS | | |
| 1542 | 72314 | 0 | 92 | ref|NP_187714.1|steroid hormone receptor/transcription factor [*Arabidopsis thaliana*] | HS | | |
| 1543 | 77840 | 1.00E-166 | 87 | ref|NP_001066296.1|Os12g0176500 [*Oryza sativa* (japonica cultivar-group)] | CS | CK | | ns
TABLE 3-continued

| PEP SEQ ID NO | Construct | E-value | % Id | Annotation Description | traits | | | |
|---|---|---|---|---|---|---|---|---|
| 1544 | 76886 | 1.00E−143 | 85 | dbj\|BAC99390.1\|putative U3 snoRNP protein IMP4 [*Oryza sativa* Japonica Group] | PP | PEG | | |
| 1545 | 76803 | 1.00E−163 | 90 | gb\|EAY89818.1\|hypothetical protein OsI_011051 [*Oryza sativa* (indica cultivar-group)] | LL | | | |
| 1546 | 10302 | 0 | 97 | ref\|NP_172288.1\|ATNRT2:1 (*Arabidopsis thaliana*) high affinity nitrate transporter 2.1); nitrate transporter | HS | | | |
| 1547 | 71107 | 0 | 96 | ref\|NP_030560.1\|unknown protein [*Arabidopsis thaliana*] | HS | | | |
| 1548 | 76887 | 0 | 86 | ref\|NP_001044302.1\|Os01g0758400 [*Oryza sativa* (japonica cultivar-group)] | HS | PP | PEG | |
| 1549 | 77842 | 0 | 76 | ref\|NP_001047779.1\|Os02g0688500 [*Oryza sativa* (japonica cultivar-group)] | LN | | | |
| 1550 | 76805 | 1.00E−165 | 85 | dbj\|BAD08085.1\|putative ornithine carbamoyltransferase [*Oryza sativa* Japonica Group] | HS | | | |
| 1551 | 76817 | 2.00E−51 | 78 | ref\|NP_001063927.1\|Os09g0560500 [*Oryza sativa* (japonica cultivar-group)] | HS | | | |
| 1552 | 77843 | 1.00E−68 | 66 | ref\|NP_001053206.1\|Os04g0497400 [*Oryza sativa* (japonica cultivar-group)] | CS | | | |
| 1553 | 77844 | 0 | 94 | ref\|NP_001105843.1\|sialyltransferase like protein [*Zea mays*] | PP | | | |
| 1554 | 76890 | 0 | 98 | ref\|NP_001044001.1\|Os01g0703600 [*Oryza sativa* (japonica cultivar-group)] | HS | | | |
| 1555 | 77839 | 1.00E−155 | 74 | ref\|NP_001047096.1\|Os02g0550700 [*Oryza sativa* (japonica cultivar-group)] | DS | PP | | |
| 1556 | 76868 | 0 | 83 | ref\|NP_001052270.1\|Os04g0223000 [*Oryza sativa* (japonica cultivar-group)] | HS | PP | PEG | CS |
| 1557 | 76821 | 1.00E−144 | 80 | ref\|NP_001042197.1\|Os01g0179200 [*Oryza sativa* (japonica cultivar-group)] | LN | | | |
| 1558 | 76869 | 3.00E−98 | 73 | gb\|EAZ29350.1\|hypothetical protein OsJ_012833 [*Oryza sativa* (japonica cultivar-group)] | HS | PP | | |
| 1559 | 76881 | 0 | 88 | ref\|NP_001049165.1\|Os03g0180700 [*Oryza sativa* (japonica cultivar-group)] | PP | | | |
| 1560 | 76894 | 4.00E−33 | 94 | ref\|NP_001066312.1\|Os12g0180400 [*Oryza sativa* (japonica cultivar-group)] | LN | | | |
| 1561 | 11930 | 0 | 100 | dbj\|BAF01049.1\|hypothetical protein [*Arabidopsis thaliana*] | SS | | | |
| 1562 | 76848 | 2.00E−80 | 90 | ref\|NP_001043542.1\|Os01g0610100 [*Oryza sativa* (japonica cultivar-group)] | HS | | | |
| 1563 | 76901 | 2.00E−44 | 85 | gb\|EAY92619.1\|hypothetical protein OsI_013852 [*Oryza sativa* (indica cultivar-group)] | LN | | | |
| 1564 | 76914 | 1.00E−139 | 78 | gb\|EAY79090.1\|hypothetical protein OsI_033049 [*Oryza sativa* (indica cultivar-group)] | PP | | | |
| 1565 | 76939 | 1.00E−137 | 71 | gb\|EAY98958.1\|hypothetical protein OsI_020191 [*Oryza sativa* (indica cultivar-group)] | CK | | | |
| 1566 | 76987 | 1.00E−150 | 72 | gb\|ABF93996.1\|Integral membrane protein DUF6 containing protein, expressed [*Oryza sativa* (japonica cultivar-group)] | CK | | | |
| 1567 | 76904 | 4.00E−58 | 76 | gb\|EAZ05371.1\|hypothetical protein OsI_026603 [*Oryza sativa* (indica cultivar-group)] | HS | LN | | |
| 1568 | 76941 | 4.00E−26 | 69 | gb\|EAY83408.1\|hypothetical protein OsI_037367 [*Oryza sativa* (indica cultivar-group)] | HS | | | |
| 1569 | 77113 | 0 | 58 | ref\|NP_001064033.1\|Os10g0110600 [*Oryza sativa* (japonica cultivar-group)] | PEG | | | |
| 1570 | 77185 | 0 | 80 | dbj\|BAD45738.1\|thiF family protein-like [*Oryza sativa* Japonica Group] | DS | | | |
| 1571 | 12911 | 0 | 100 | ref\|NP_001078414.1\|binding [*Arabidopsis thaliana*] | LN | HS | | |
| 1572 | 77127 | 0 | 89 | ref\|NP_001062585.1\|Os09g0115600 [*Oryza sativa* (japonica cultivar-group)] | HS | PEG | | |
| 1573 | 77177 | 0 | 85 | gb\|EAY84671.1\|hypothetical protein OsI_005904 [*Oryza sativa* (indica cultivar-group)] | PEG | | | |
| 1574 | 77178 | 0 | 100 | ref\|NP_441510.1\|bifunctional 3,4-dihydroxy-2-butanone 4-phosphate synthase/GTP cyclohydrolase II protein [*Synechocystis* sp. PCC 6803] | HS | | | |
| 1575 | 77179 | 2.00E−15 | 60 | gb\|EAY74575.1\|hypothetical protein OsI_002422 [*Oryza sativa* (indica cultivar-group)] | HS | | | |
| 1576 | 77191 | 8.00E−61 | 81 | ref\|NP_001046564.1\|Os02g0282100 [*Oryza sativa* (japonica cultivar-group)] | PP | | | |
| 1577 | 77145 | 2.00E−48 | 81 | ref\|NP_001051289.1\|Os03g0751000 [*Oryza sativa* (japonica cultivar-group)] | CK | PP | | |
| 1578 | 77169 | 1.00E−137 | 87 | gb\|AAP50960.1\|putative aurora-related kinase [*Oryza sativa* (japonica cultivar-group)] | PP | | | |
| 1579 | 77110 | 5.00E−30 | 56 | ref\|NP_001042508.1\|Os01g0233000 [*Oryza sativa* (japonica cultivar-group)] | LL | LN | | |
| 1580 | 77146 | 0 | 100 | ref\|NP_353311.1\|bifunctional GMP synthase/glutamine amidotransferase protein [*Agrobacterium tumefaciens* str. C58] | PP | | | |
| 1581 | 77170 | 7.00E−59 | 82 | emb\|CAH67592.1\|OSIGBa0092M08.4 [*Oryza sativa* (indica cultivar-group)] | DS | | | |

TABLE 3-continued

| PEP SEQ ID NO | Construct | E-value | % Id | Description | traits | |
|---|---|---|---|---|---|---|
| 1582 | 77171 | 0 | 95 | ref|NP_244906.1|potassium/proton antiporter [*Bacillus halodurans* C-125] | HS | |
| 1583 | 77148 | 0 | 100 | ref|NP_661081.1|bifunctional GMP synthase/glutamine amidotransferase protein [*Chlorobium tepidum* TLS] | CK | |
| 1584 | 11933 | 1.00E−149 | 94 | ref|NP_849952.1|GONST1 (GOLGI NUCLEOTIDE SUGAR TRANSPORTER 1) [*Arabidopsis thaliana*] | LN | |
| 1585 | 77160 | 0 | 87 | ref|NP_414589.1|potassium:proton antiporter [*Escherichia coli* K12] | DS | |
| 1586 | 77172 | 0 | 92 | gb|AAC77846.1|mannose-1-P guanosyltransferase [*Escherichia coli*] | LL | |
| 1587 | 77184 | 0 | 92 | ref|NP_243321.1|flagellum-specific ATP synthase [*Bacillus halodurans* C-125] | HS | |
| 1588 | 77225 | 0 | 94 | ref|NP_662474.1|3,4-dihydroxy-2-butanone 4-phosphate synthase/GTP cyclohydrolase II [*Chlorobium tepidum* TLS] | LL | |
| 1589 | 77250 | 0 | 97 | ref|NP_599940.1|detergent sensitivity rescuer dtsR1 [*Corynebacterium glutamicum* ATCC 13032] | LN | |
| 1590 | 77277 | 0 | 95 | ref|NP_001048987.1|Os03g0151800 [*Oryza sativa* (japonica cultivar-group)] ica cultivar-group)] | DS | |
| 1591 | 77245 | 7.00E−45 | 64 | gb|EAY86480.1|hypothetical protein OsI-007713 [*Oryza sativa* (indica cultivar-group)] | SS | |
| 1592 | 77246 | 4.00E−49 | 98 | gb|EAZ21400.1|hypothetical protein OsJ_004883 [*Oryza sativa* (japonica cultivar-group)] | HS | |
| 1593 | 77462 | 0 | 75 | ref|NP_001065111.1|Os10g0525000 [*Oryza sativa* (japonica cultivar-group)] | CK | |
| 1594 | 77414 | 0 | 82 | ref|NP_001046919.1|Os02g0506500 [*Oryza sativa* (japonica cultivar-group)] | HS | |
| 1595 | 77439 | 0 | 82 | ref|NP_001045101.1|Os01g0899500 [*Oryza sativa* (japonica cultivar-group)] | PEG | |
| 1596 | 77463 | 1.00E−106 | 89 | ref|NP_001048776.1|Os03g0119000 [*Oryza sativa* (japonica cultivar-group)] | HS | |
| 1597 | 77488 | 0 | 80 | gb|EAT84267.1|hypothetical protein SNOG_07991 [*Phaeosphaeria nodorum* SN15] | DS | |
| 1598 | 77441 | 5.00E−87 | 82 | ref|NP_001053804.1|Os04g0606900 [*Oryza sativa* (japonica cultivar-group)] | SS | PEG |
| 1599 | 77464 | 1.00E−164 | 90 | gb|EAT77502.1|hypothetical protein SNOG_14959 [*Phaeosphaeria nodorum* SN15] | PEG | |
| 1600 | 77442 | 0 | 83 | ref|NP_013943.1|SR protein kinase (SRPK) involved in regulating proteins involved in mRNA metabolism and cation homeostasis; similar to human SRPK1; Sky1p [*Saccharomyces cerevisiae*] | HS | |
| 1601 | 77419 | 0 | 100 | ref|NP_191311.1|ATSIP2 (*ARABIDOPSIS THALIANA SEED IMBIBITION* 2); hydrolase, hydrolyzing O-glycosyl compounds [*Arabidopsis thaliana*] | CK | HS |
| 1602 | 12444 | 1.00E−146 | 100 | ref|NP_569036.1|GAMMA CA3 (GAMMA CARBONIC ANHYDRASE 3); carbonate dehydratase [*Arabidopsis thaliana*] | LN | |
| 1603 | 11791 | 0 | 87 | ref|NP_188619.2|phototropic-responsive NPH3 family protein [*Arabidopsis thaliana*] | LN | |
| 1603 | 12445 | 0 | 87 | ref|NP_188619.2|phototropic-responsive NPH3 family protein [*Arabidopsis thaliana*] | HS | |
| 1604 | 71249 | 0 | 96 | ref|NP_189251.1|CYP71B22 (cytochrome P450, family 71, subfamily B, polypeptide 22); oxygen binding [*Arabidopsis thaliana*] | HS | |
| 1605 | 71237 | 0 | 95 | ref|NP_192740.1|short-chain dehydrogenase/reductase (SDR) family protein [*Arabidopsis thaliana*] | CK | |
| 1606 | 12315 | 1.00E−97 | 100 | ref|NP_567911.1|unknown protein [*Arabidopsis thaliana*] gb|AAM66960.1| unknown [*Arabidopsis thaliana*] | DS | |
| 1606 | 12366 | 1.00E−97 | 100 | ref|NP_567911.1|unknown protein [*Arabidopsis thaliana*] gb|AAM66960.1| unknown [*Arabidopsis thaliana*] | DS | |

Trait Enhancement Screens

DS-Enhancement of Drought Tolerance Identified by a Soil Drought Stress Tolerance Screen:

Drought or water deficit conditions impose mainly osmotic stress on plants. Plants are particularly vulnerable to drought during the flowering stage. The drought condition in the screening process disclosed in Example 1B started from the flowering time and was sustained to the end of harvesting. The present invention provides recombinant DNA that can improve the plant survival rate under such sustained drought condition. Exemplary recombinant DNA for conferring such drought tolerance are identified as such in Table 3. Such recombinant DNA can find particular use in generating transgenic plants that are tolerant to the drought condition imposed during flowering time and in other stages of the plant life cycle. As demonstrated from the model plant screen, in some embodiments of transgenic plants with trait-improving recombinant DNA grown under such sustained drought condition can also have increased total seed weight per plant in addition to the increased survival rate within a transgenic population, providing a higher yield potential as compared to control plants.

PEG-Enhancement of Drought Tolerance Identified by PEG Induced Osmotic Stress Tolerance Screen:

Various drought levels can be artificially induced by using various concentrations of polyethylene glycol (PEG) to produce different osmotic potentials (Pilon-Smits et al., (1995) Plant Physiol. 107:125-130). Several physiological characteristics have been reported as being reliable indications for selection of plants possessing drought tolerance. These characteristics include the rate of seed germination and seedling growth. The traits can be assayed relatively easily by measuring the growth rate of seedling in PEG solution. Thus, a PEG-induced osmotic stress tolerance screen can be a surrogate for drought tolerance screen. As demonstrated from the model plant screen, embodiments of transgenic plants with trait-improving recombinant DNA identified in the PEG-induced osmotic stress tolerance screen can survive better drought conditions providing a higher yield potential as compared to control plants.

SS-Enhancement of Drought Tolerance Identified by High Salinity Stress Tolerance Screen:

Three different factors are responsible for salt damages: (1) osmotic effects, (2) disturbances in the mineralization process, and (3) toxic effects caused by the salt ions, e.g., inactivation of enzymes. While the first factor of salt stress results in the wilting of the plants that is similar to drought effect, the ionic aspect of salt stress is clearly distinct from drought. The present invention provides genes that help plants maintain biomass, root growth, and/or plant development in high salinity conditions, which are identified as such in Table 3. Since osmotic effect is one of the major components of salt stress, which is common to the drought stress, trait-improving recombinant DNA identified in a high salinity stress tolerance screen can also provide transgenic crops with enhanced drought tolerance. As demonstrated from the model plant screen, embodiments of transgenic plants with trait-improving recombinant DNA identified in a high salinity stress tolerance screen can survive better drought conditions and/or high salinity conditions providing a higher yield potential as compared to control plants.

HS-Enhancement of Drought Tolerance Identified by Heat Stress Tolerance Screen:

Heat and drought stress often occur simultaneously, limiting plant growth. Heat stress can cause the reduction in photosynthesis rate, inhibition of leaf growth and osmotic potential in plants. Thus, genes identified by the present invention as heat stress tolerance conferring genes can also impart enhanced drought tolerance to plants. As demonstrated from the model plant screen, embodiments of transgenic plants with trait-improving recombinant DNA identified in a heat stress tolerance screen can survive better heat stress conditions and/or drought conditions providing a higher yield potential as compared to control plants.

CK and CS-Enhancement of Tolerance to Cold Stress:

Low temperature can immediately result in mechanical constraints, changes in activities of macromolecules, and reduced osmotic potential. In the present invention, two screening conditions, e.g., cold shock tolerance screen (CK) and cold germination tolerance screen (CS), were set up to look for transgenic plants that display visual growth advantage at lower temperature. In cold germination tolerance screen, the transgenic *Arabidopsis* plants were exposed to a constant temperature of 8° C. from planting until day 28 post plating. The trait-improving recombinant DNA identified by such screen can be used for the production of transgenic plant that can germinate more robustly in a cold temperature as compared to the wild type plants. In cold shock tolerance screen, the transgenic plants were first grown under the normal growth temperature of 22° C. until day 8 post plating, and subsequently were placed under 8° C. until day 28 post plating. As demonstrated from the model plant screen, embodiments of transgenic plants with trait-improving recombinant DNA identified in a cold shock stress tolerance screen and/or a cold germination stress tolerance screen can survive better cold conditions providing a higher yield potential as compared to control plants.

Enhancement of Tolerance to Multiple Stresses:

Different kinds of stresses often lead to identical or similar reaction in the plants. Genes that are activated or inactivated as a reaction to stress can either act directly in a way the genetic product reduces a specific stress, or they can act indirectly by activating other specific stress genes. By manipulating the activity of such regulatory genes, e.g., multiple stress tolerance genes, the plant can be enabled to react to different kinds of stresses. For examples, PEP SEQ ID NO: 1000 can be used to enhance both salt stress tolerance and heat stress tolerance in plants. Of particular interest, plants transformed with PEP SEQ ID NO: 1495 can resist salt and heat stress. Plants transformed with PEP SEQ ID NO: 1483 can also improve growth in early stage and under heat stress. In addition to these multiple stress tolerance genes, the stress tolerance conferring genes provided by the present invention can be used in combinations to generate transgenic plants that can resist multiple stress conditions.

PP-Enhancement of Early Plant Growth and Development:

It has been known in the art that to minimize the impact of disease on crop profitability, it is important to start the season with healthy and vigorous plants. This means avoiding seed and seedling diseases, leading to increased nutrient uptake and increased yield potential. Traditionally early planting and applying fertilizer are the methods used for promoting early seedling vigor. In early development stage, plant embryos establish only the basic root-shoot axis, a cotyledon storage organ(s), and stem cell populations, called the root and shoot apical meristems that continuously generate new organs throughout post-embryonic development. "Early growth and development" used herein encompasses the stages of seed imbibition through the early vegetative phase. The present invention provides genes that can be used to produce transgenic plants that have advantages in one or more processes including, but not limited to, germination, seedling vigor, root growth and root morphology under non-stressed conditions. The transgenic plants starting from a more robust seedling are less susceptible to the fungal and bacterial pathogens that attach germinating seeds and seedling. Furthermore, seedlings with advantage in root growth are more resistant to drought stress due to extensive and deeper root architecture. Therefore, it can be recognized by those skilled in the art that genes conferring the growth advantage in early stages to plants can also be used to generate transgenic plants that are more resistant to various stress conditions due to enhanced early plant development. The present invention provides such exemplary recombinant DNA that confer both the stress tolerance and growth advantages to plants, identified as such in Table 3, e.g., PEP SEQ ID NO: 1043 which can improve the plant early growth and development, and impart heat stress tolerance to plants. As demonstrated from the model plant screen, embodiments of transgenic plants with trait-improving recombinant DNA identified in the early plant development screen can grow better under non-stress conditions and/or stress conditions providing a higher yield potential as compared to control plants.

SP-Enhancement of Late Plant Growth and Development:

"Late growth and development" used herein encompasses the stages of leaf development, flower production, and seed maturity. In certain embodiments, transgenic plants produced using genes that confer growth advantages to plants provided by the present invention, identified as such in Table 3, exhibit at least one phenotypic characteristics including, but not limited to, increased rosette radius, increased rosette dry weight, seed dry weight, silique dry weight, and silique length. On one hand, the rosette radius and rosette dry weight are used as the indexes of photosynthesis capacity, and thereby plant source strength and yield potential of a plant. On the other hand, the seed dry weight, silique dry weight and silique length are used as the indexes for plant sink strength, which are considered as the direct determinants of yield. As demonstrated from the model plant screen, embodiments of transgenic plants with trait-improving recombinant DNA identified in the late development screen can grow better and/or have enhanced development during leaf development and seed maturation providing a higher yield potential as compared to control plants.

LL-Enhancement of Tolerance to Shade Stress Identified in a Low Light Screen:

The effects of light on plant development are especially prominent at the seedling stage. Under normal light conditions with unobstructed direct light, a plant seeding develops according to a characteristic photomorphogenic pattern, in which plants have open and expanded cotyledons and short hypocotyls. Then the plant's energy is devoted to cotyledon and leaf development while longitudinal extension growth is minimized. Under low light condition where light quality and intensity are reduced by shading, obstruction or high population density, a seedling displays a shade-avoidance pattern, in which the seedling displays a reduced cotyledon expansion, and hypocotyls extension is greatly increased. As the result, a plant under low light condition increases significantly its stem length at the expanse of leaf, seed or fruit and storage organ development, thereby adversely affecting of yield. The present invention provides recombinant DNA that enable plants to have an attenuated shade avoidance response so that the source of plant can be contributed to reproductive growth efficiently, resulting higher yield as compared to the wild type plants. As demonstrated from the model plant screen, embodiments of transgenic plants with trait-improving recombinant DNA identified in a shade stress tolerance screen can have attenuated shade response under shade conditions providing a higher yield potential as compared to control plants. The transgenic plants generated by the present invention can be suitable for a higher density planting, thereby resulting increased yield per unit area.

LN-Enhancement of Tolerance to Low Nitrogen Availability Stress

Nitrogen is a key factor in plant growth and crop yield. The metabolism, growth and development of plants are profoundly affected by their nitrogen supply. Restricted nitrogen supply alters shoot to root ratio, root development, activity of enzymes of primary metabolism and the rate of senescence (death) of older leaves. All field crops have a fundamental dependence on inorganic nitrogenous fertilizer. Since fertilizer is rapidly depleted from most soil types, it must be supplied to growing crops two or three times during the growing season. Enhanced nitrogen use efficiency by plants should enable crops cultivated under low nitrogen availability stress condition resulted from low fertilizer input or poor soil quality.

According to the present invention, transgenic plants generated using the recombinant nucleotides, which confer enhanced nitrogen use efficiency, identified as such in Table 3, exhibit one or more desirable traits including, but not limited to, increased seedling weight, greener leaves, increased number of rosette leaves, increased or decreased root length. One skilled in the art can recognize that the transgenic plants provided by the present invention with enhanced nitrogen use efficiency can also have altered amino acid or protein compositions, increased yield and/or better seed quality. The transgenic plants of the present invention can be productively cultivated under low nitrogen growth conditions, e.g., nitrogen-poor soils and low nitrogen fertilizer inputs, which would cause the growth of wild type plants to cease or to be so diminished us to make the wild type plants practically useless. The transgenic plants also can be advantageously used to achieve earlier maturing, faster growing, and/or higher yielding crops and/or produce more nutritious foods and animal feedstocks when cultivated using nitrogen non-limiting growth conditions.

Stacked Traits:

The present invention also encompasses transgenic plants with stacked engineered traits, e.g., a crop having an enhanced phenotype resulting from expression of a trait-improving recombinant DNA, in combination with herbicide and/or pest resistance traits. For example, genes of the current invention can be stacked with other traits of agronomic interest, such as a trait providing herbicide resistance, for example a RoundUp Ready® trait, or insect resistance, such as using a gene from *Bacillus thuringensis* to provide resistance against lepidopteran, coliopteran, homopteran, hemiopteran, and other insects. Explementary herbicides include glyphosate herbicides, phosphinothricin herbicides, oxynil herbicides, imidazolinone herbicides, dinitroaniline herbicides, pyridine herbicides, sulfonylurea herbicides, bialaphos herbicides, sulfonamide herbicides and gluphosinate herbicides. To illustrate that the production of transgenic plants with herbicide resistance is a capability of those of ordinary skill in the ail, reference is made to U.S. patent application publications 2003/0106096A1 and 2002/0112260A1 and U.S. Pat. Nos. 5,034,322; 5,776,760, 6,107, 549 and 6,376,754, all of which are incorporated herein by reference. To illustrate that the production of transgenic plants with pest resistance is a capability of those of ordinary skill in the art reference is made to U.S. Pat. Nos. 5,250,515 and 5,880,275 which disclose plants expressing an endo-toxin of *Bacillus thuringensis* bacteria, to U.S. Pat. No. 6,506,599 which discloses control of invertebrates which feed on transgenic plants which express dsRNA for suppressing a target gene in the invertebrate, to U.S. Pat. No. 5,986,175 which discloses the control of viral pests by transgenic plants which express viral replicase, and to U.S. Patent Application Publication 2003/0150017 A1 which discloses control of pests by a transgenic plant which express a dsRNA targeted to suppressing a gene in the pest, all of which are incorporated herein by reference.

Once one recombinant DNA has been identified as conferring an enhanced trait of interest in transgenic *Arabidopsis* plants, several methods are available for using the sequence of that recombinant DNA and knowledge about the protein it encodes to identify homologs of that sequence from the same plant or different plant species or other organisms, e.g., bacteria and yeast. Thus, in one aspect, the invention provides methods for identifying a homologous gene with a DNA sequence homologous to any of SEQ ID NO: 1 through SEQ ID NO: 803, or a homologous protein with an amino acid sequence homologous to any of SEQ ID NO: 804 to SEQ ID NO: 1606. In another aspect, the present invention provides the protein sequences of identified homologs for a sequence listed as SEQ ID NO: 1607 through SEQ ID NO: 94613. In yet another aspect, the present invention also includes linking or associating one or more desired traits, or gene function with a homolog sequence provided herein.

The trait-improving recombinant DNA and methods of using such trait-improving recombinant DNA for generating transgenic plants with enhanced traits provided by the present invention are not limited to any particular plant species. Indeed, the plants according to the present invention can be of any plant species, e.g., can be monocotyledonous or dicotyledonous. In one embodiment, they are agricultural plants, e.g., plants cultivated by man for purposes of food production or technical, particularly industrial applications. Of particular interest in the present invention are corn and soybean plants. The recombinant DNA constructs optimized for soybean transformation and recombinant DNA constructs optimized for corn transformation are provided by the present invention. Other plants of interest in the present invention for production of transgenic plants having enhanced traits include, without limitation, cotton, canola, wheat, sunflower, sorghum, alfalfa, barley, millet, rice, tobacco, fruit and vegetable drops, and turfgrass.

In certain embodiments, the present invention contemplates to use an orthologous gene in generating the transgenic plants with similarly enhanced traits as the transgenic Arabidopsis counterpart. Enhanced physiological properties in transgenic plants of the present invention can be confirmed in responses to stress conditions, for example in assays using imposed stress conditions to detect enhanced responses to drought stress, nitrogen deficiency, cold growing conditions, or alternatively, under naturally present stress conditions, for example under field conditions. Biomass measures can be made on greenhouse or field grown plants and can include such measurements as plant height, stein diameter, root and shoot dry weights, and, for corn plants, ear length and diameter.

Trait data on morphological changes can be collected by visual observation during the process of plant regeneration as well as in regenerated plants transferred to soil. Such trait data includes characteristics such as normal plants, bushy plants, taller plants, thicker stalks, narrow leaves, striped leaves, knotted phenotype, chlorosis, albino, anthocyanin production, or altered tassels, ears or roots. Other enhanced traits can be identified by measurements taken under field conditions, such as days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, bareness/prolificacy, green snap, and pest resistance. In addition, trait characteristics of harvested grain can be confirmed, including number of kernels per row on the ear, number of rows of kernels on the ear, kernel abortion, kernel weight, kernel size, kernel density and physical grain quality.

To confirm hybrid yield in transgenic corn plants expressing genes of the present invention, it can be desirable to test hybrids over multiple years at multiple locations in a geographical location where maize is conventionally grown, e.g., in Iowa, Illinois or other locations in the midwestern United States, under "normal" field conditions as well as under stress conditions, e.g., under drought or population density stress.

Transgenic plants can be used to provide plant parts according to the invention for regeneration or tissue culture of cells or tissues containing the constructs described herein. Plant parts for these purposes can include leaves, stems, roots, flowers, tissues, epicotyl, meristems, hypocotyls, cotyledons, pollen, ovaries, cells and protoplasts, or any other portion of the plant which can be used to regenerate additional transgenic plants, cells, protoplasts or tissue culture. Seeds of transgenic plants are provided by this invention can be used to propagate more plants containing the trait-improving recombinant DNA constructs of this invention. These descendants are intended to be included in the scope of this invention if they contain a trait-improving recombinant DNA construct of this invention, whether or not these plants are selfed or crossed with different varieties of plants.

The various aspects of the invention are illustrated by means of the following examples which are in no way intended to limit the full breath and scope of claims.

EXAMPLES

Example 1. Identification of Recombinant DNA that Confers Enhanced Trait(s) to Plants A. Plant Expression Constructs for Arabidopsis Transformation Each gene of interest was amplified from a genomic or cDNA library using primers specific to sequences upstream and downstream of the coding region. Transformation vectors were prepared to constitutively transcribe DNA in either sense orientation (for enhanced protein expression) or anti-sense orientation (for endogenous gene suppression) under the control of an enhanced Cauliflower Mosaic Virus 35S promoter (U.S. Pat. No. 5,359,142) directly or indirectly (Moore, et al., PNAS 95:376-381, 1998; Guyer, e.g., Genetics 149: 633-639, 1998; International patent application NO. PCT/EP98/07577). The transformation vectors also contain a bar gene as a selectable marker for resistance to glufosinate herbicide. The transformation of Arabidopsis plants was carried out using the vacuum infiltration method known in the art (Bethtold, et al., Methods Mol. Biol. 82:259-66, 1998). Seeds harvested from the plants, named as T1 seeds, were subsequently grown in a glufosinate-containing selective medium to select for plants which were actually transformed and which produced T2 transgenic seed.

B. Soil Drought Tolerance Screen

This example describes a soil drought tolerance screen to identify Arabidopsis plants transformed with recombinant DNA that wilt less rapidly and/or produce higher seed yield when grown in soil under drought conditions T2 seeds were sown in flats filled with Metro/Mix® 200 (The Scotts® Company, USA). Humidity domes were added to each flat and flats were assigned locations and placed in climate-controlled growth chambers. Plants were grown under a temperature regime of 22° C. at clay and 20° C. at night, with a photoperiod of 16 hours and average light intensity of 170 µmol/m$^2$/s. After the first true leaves appeared, humidity domes were removed. The plants were sprayed with glufosinate herbicide and put back in the growth chamber for 3 additional days. Flats were watered for 1 hour the week following the herbicide treatment. Watering was continued every seven days until the flower bud primordia became apparent, at which time plants were watered for the last time.

To identify drought tolerant plants, plants were evaluated for wilting response and seed yield. Beginning ten days after the last watering, plants were examined daily until 4 plants/line had wilted. In the next six days, plants were monitored for wilting response. Five drought scores were assigned according to the visual inspection of the phenotypes: 1 for healthy, 2 for dark green, 3 for wilting, 4 severe wilting, and 5 for dead. A score of 3 or higher was considered as wilted.

At the end of this assay, seed yield measured as seed weight per plant under the drought condition was characterized for the transgenic plants and their controls and analyzed as a quantitative response according to example 1M.

Two approaches were used for statistical analysis on the wilting response. First, the risk score was analyzed for wilting phenotype and treated as a qualitative response according to the example 1L. Alternatively, the survival analysis was carried out in which the proportions of wilted and on-wilted transgenic and control plants were compared over each of the six days under scoring and an overall log rank test was performed to compare the two survival curves using S-PLUS statistical software (S-PLUS 6, Guide to statistics, Insightful, Seattle, Wash., USA). A list of recombinant DNA constructs which improve drought tolerance in transgenic plants is illustrated in Table 4

TABLE 4

| PEP SEQ ID | Construct ID | Orientation | Drought score Delta mean | P-value | Seed yield Delta mean | P-value |
|---|---|---|---|---|---|---|
| 989 | 10471 | SENSE | 0.069 | 0.285 | 0.368 | 0.021 |
| 1224 | 12204 | SENSE | 0.152 | 0.018 | −0.519 | 0.041 |
| 1606 | 12315 | ANTI-SENSE | 0.067 | 0.029 | −0.126 | 0.210 |
| 1257 | 12354 | ANTI-SENSE | 0.118 | 0.334 | −0.663 | 0.001 |
| 1606 | 12366 | SENSE | −0.105 | 0.735 | −0.072 | 0.403 |
| 852 | 13623 | SENSE | 0.309 | 0.005 | −0.202 | 0.403 |
| 812 | 13638 | ANTI-SENSE | 0.195 | 0.047 | −0.930 | 0.045 |
| 838 | 13811 | SENSE | −0.037 | 0.729 | −0.578 | 0.032 |
| 860 | 14248 | SENSE | 0.205 | 0.013 | −0.484 | 0.066 |
| 885 | 14910 | ANTI-SENSE | −0.087 | 0.305 | −0.261 | 0.220 |
| 891 | 14932 | ANTI-SENSE | 0.222 | 0.011 | −0.019 | 0.957 |
| 879 | 15111 | ANTI-SENSE | 0.082 | 0.241 | 0.624 | 0.019 |
| 893 | 15964 | ANTI-SENSE | 0.003 | 0.023 | −0.396 | 0.028 |
| 899 | 15986 | ANTI-SENSE | 0.199 | 0.128 | −0.022 | 0.773 |
| 900 | 15987 | ANTI-SENSE | 0.223 | 0.416 | −0.156 | 0.576 |
| 904 | 15995 | ANTI-SENSE | 0.281 | 0.196 | −0.362 | 0.157 |
| 945 | 16614 | SENSE | 0.136 | 0.001 | 0.059 | 0.440 |
| 959 | 19162 | SENSE | 0.007 | 0.887 | 0.348 | 0.019 |
| 999 | 19423 | SENSE | 0.222 | 0.024 | −0.460 | 0.069 |
| 1003 | 19425 | SENSE | 0.002 | 0.556 | 0.099 | 0.019 |
| 1081 | 71667 | SENSE | 0.064 | 0.790 | −0.314 | 0.101 |
| 1164 | 72717 | SENSE | 0.043 | 0.031 | −0.173 | 0.221 |
| 1165 | 72718 | SENSE | 0.119 | 0.037 | −0.272 | 0.359 |
| 1167 | 72779 | SENSE | −0.026 | 0.491 | 0.395 | 0.006 |
| 1168 | 72791 | SENSE | 0.284 | 0.046 | −1.867 | 0.009 |
| 1272 | 73472 | SENSE | 0.159 | 0.036 | −0.223 | 0.511 |
| 1273 | 73526 | SENSE | −0.219 | 0.141 | −0.250 | 0.145 |
| 1280 | 73531 | SENSE | −0.277 | 0.022 | −0.097 | 0.740 |
| 1132 | 73738 | SENSE | 0.386 | 0.022 | −1.025 | 0.018 |
| 1485 | 73938 | SENSE | 0.117 | 0.050 | 0.309 | 0.052 |
| 1069 | 74060 | SENSE | 0.116 | 0.016 | 0.195 | 0.200 |
| 1286 | 74164 | SENSE | 0.602 | 0.031 | 0.287 | 0.137 |
| 1157 | 74257 | SENSE | −0.139 | 0.622 | −0.366 | 0.059 |
| 1146 | 74269 | SENSE | 0.176 | 0.057 | −0.101 | 0.273 |
| 1229 | 74376 | SENSE | −0.023 | 0.583 | −0.747 | 0.053 |
| 1234 | 74668 | SENSE | 0.112 | 0.018 | −0.931 | 0.063 |
| 1351 | 74873 | SENSE | 0.256 | 0.006 | 0.110 | 0.627 |
| 1385 | 75473 | SENSE | 0.108 | 0.031 | −1.469 | 0.015 |
| 1535 | 76345 | SENSE | −0.024 | 0.476 | 0.318 | 0.017 |
| 1541 | 76396 | SENSE | −0.146 | 0.218 | −0.137 | 0.518 |
| 1245 | 76724 | SENSE | 0.514 | 0.029 | −1.467 | 0.021 |
| 1581 | 77170 | SENSE | 0.258 | 0.026 | −0.436 | 0.026 |
| 1570 | 77185 | SENSE | 0.180 | 0.037 | −0.602 | 0.086 |
| 1457 | 77369 | SENSE | −0.117 | 0.194 | −0.324 | 0.096 |
| 1460 | 77372 | SENSE | 0.623 | 0.017 | −0.108 | 0.028 |
| 1597 | 77488 | SENSE | 0.001 | 0.973 | −0.252 | 0.075 |
| 1452 | 77594 | SENSE | 0.200 | 0.032 | −0.334 | 0.096 |
| 1555 | 77839 | SENSE | 0.082 | 0.021 | −0.242 | 0.298 |
| 1472 | 77965 | SENSE | 0.643 | 0.003 | −0.157 | 0.456 |
| 1487 | 77990 | SENSE | 0.246 | 0.022 | −0.303 | 0.458 |

TABLE 4-continued

| PEP SEQ ID | Construct ID | Orientation | Drought score Delta mean | P-value | Seed yield Delta mean | P-value |
|---|---|---|---|---|---|---|
| 1497 | 78023 | SENSE | 0.364 | 0.004 | −3.072 | 0.012 |
| 1503 | 78036 | SENSE | 0.651 | 0.010 | −0.959 | 0.095 |
| 1350 | 78115 | SENSE | 0.412 | 0.027 | −0.024 | 0.880 |
| 1061 | 78321 | SENSE | 0.254 | 0.044 | −0.941 | 0.014 |
| 1230 | 74377 | SENSE | 0.327 | 0.028 | / | / |
| 1007 | 70419 | SENSE | 0.007 | 0.047 | −0.599 | 0.012 |

Transgenic plants comprising recombinant DNA expressing protein as set forth in SEQ ID NO: 1047, 1073, 1105, 1106, 1137, 1190, 1216, 1334, 1585, or 1590 showed enhanced drought tolerance by the second criteria as illustrated in Example 1L.

C. Heat Stress Tolerance Screen

Under high temperatures, *Arabidopsis* seedlings become chlorotic and root growth is inhibited. This example sets forth the heat stress tolerance screen to identify *Arabidopsis* plants transformed with the gene of interest that are more resistant to heat stress based on primarily their seedling weight and root growth under high temperature.

T2 seeds were plated on ½×MS salts, 1/% phytagel, with 10 µg/ml BASTA (7 per plate to with 2 control seeds; 9 seeds total per plate). Plates were placed at 4° C. for 3 days to stratify seeds. Plates were then incubated at room temperature for 3 hours and then held vertically for 11 additional days at temperature of 34° C. at day and 20° C. at night. Photoperiod was 16 h. Average light intensity was ~140 µmol/m²/s. After 14 days of growth, plants were scored for glufosinate resistance, root length, final growth stage, visual color, and seedling fresh weight. A photograph of the whole plate was taken on day 14.

The seedling weight and root length were analyzed as quantitative responses according to example 1M. The final grow stage at day 14 was scored as success if 50% of the plants had reached 3 rosette leaves and size of leaves are greater than 1 mm (Boyes, et al., (2001) The Plant Cell 13, 1499-1510). The growth stage data was analyzed as a qualitative response according to example 1L. A list of recombinant DNA constructs that improve heat tolerance in transgenic plants illustrated in Table 5.

TABLE 5

| PEP SEQ ID | Construct ID | Orientation | Root length day 14 Delta mean | P-value | Growth stage at day 14 Risk score mean | P-value | Seedling weight Delta mean | P-value |
|---|---|---|---|---|---|---|---|---|
| 848 | 10706 | ANTI-SENSE | −0.080 | 0.577 | −0.056 | 0.371 | 0.423 | 0.023 |
| 822 | 13231 | SENSE | 0.267 | 0.037 | 1.633 | 0.010 | 1.492 | 0.000 |
| 834 | 13914 | SENSE | 0.283 | 0.096 | 0.466 | 0.230 | 1.497 | 0.016 |
| 827 | 15606 | SENSE | −0.107 | 0.459 | 0.032 | 0.889 | 0.658 | 0.049 |
| 876 | 15623 | SENSE | 0.265 | 0.088 | 0.150 | 0.371 | 1.064 | 0.012 |
| 906 | 16213 | SENSE | 0.020 | 0.917 | 0.048 | 0.579 | 0.681 | 0.013 |
| 943 | 16603 | SENSE | 0.171 | 0.300 | 0.783 | 0.192 | 0.994 | 0.035 |
| 941 | 16617 | SENSE | 0.327 | 0.055 | 0.179 | 0.312 | 1.362 | 0.007 |
| 934 | 17502 | SENSE | −0.082 | 0.580 | 0.989 | 0.402 | 0.519 | 0.026 |
| 935 | 17503 | SENSE | 0.149 | 0.052 | 0.015 | 0.828 | 0.697 | 0.003 |
| 897 | 18203 | SENSE | −0.078 | 0.640 | −0.221 | 0.300 | 0.728 | 0.041 |
| 984 | 18238 | SENSE | 0.031 | 0.845 | −0.077 | 0.457 | 0.820 | 0.047 |
| 853 | 18302 | SENSE | 0.315 | 0.074 | 1.298 | 0.269 | 1.271 | 0.011 |
| 851 | 18304 | SENSE | 0.346 | 0.222 | 0.374 | 0.381 | 1.111 | 0.043 |

TABLE 5-continued

| PEP SEQ ID | Construct ID | Orientation | Root length day 14 Delta mean | P-value | Growth stage at day 14 Risk score mean | P-value | Seedling weight Delta mean | P-value |
|---|---|---|---|---|---|---|---|---|
| 952 | 18307 | SENSE | 0.394 | 0.183 | 1.676 | 0.287 | 1.088 | 0.013 |
| 997 | 18352 | SENSE | 0.239 | 0.055 | 0.036 | 0.894 | 0.924 | 0.019 |
| 968 | 18421 | SENSE | 0.069 | 0.684 | 0.941 | 0.213 | 0.918 | 0.012 |
| 969 | 18422 | SENSE | 0.236 | 0.243 | / | / | 1.127 | 0.033 |
| 958 | 18441 | SENSE | 0.175 | 0.289 | 0.832 | 0.497 | 0.907 | 0.043 |
| 979 | 18535 | SENSE | −0.007 | 0.946 | −0.100 | 0.496 | 0.853 | 0.015 |
| 911 | 19041 | ANTI-SENSE | 0.160 | 0.012 | −0.063 | 0.102 | 0.932 | 0.003 |
| 913 | 19042 | ANTI-SENSE | 0.068 | 0.618 | 0.024 | 0.725 | 0.767 | 0.030 |
| 950 | 19154 | SENSE | 0.109 | 0.609 | 1.642 | 0.111 | 0.877 | 0.041 |
| 951 | 19155 | SENSE | 0.244 | 0.237 | 0.085 | 0.434 | 0.905 | 0.018 |
| 976 | 19237 | SENSE | 0.094 | 0.296 | 0.492 | 0.362 | 0.663 | 0.047 |
| 971 | 19244 | SENSE | 0.473 | 0.104 | 1.137 | 0.259 | 1.324 | 0.020 |
| 1011 | 19320 | SENSE | −0.265 | 0.212 | / | / | 0.329 | 0.043 |
| 967 | 19534 | SENSE | 0.064 | 0.756 | 0.920 | 0.315 | 0.630 | 0.039 |
| 964 | 19535 | SENSE | 0.190 | 0.158 | −0.025 | 0.750 | 0.961 | 0.013 |
| 970 | 19539 | SENSE | 0.083 | 0.373 | 0.521 | 0.256 | 0.466 | 0.031 |
| 973 | 19545 | SENSE | −0.083 | 0.150 | / | / | 0.609 | 0.038 |
| 1002 | 19616 | SENSE | 0.288 | 0.094 | −0.068 | 0.565 | 0.689 | 0.003 |
| 1027 | 19702 | SENSE | −0.017 | 0.915 | −0.033 | 0.798 | 0.783 | 0.043 |
| 1032 | 19755 | SENSE | 0.312 | 0.129 | 1.611 | 0.029 | 1.285 | 0.008 |
| 1029 | 19775 | SENSE | 0.126 | 0.362 | 2.093 | 0.172 | 0.775 | 0.004 |
| 1042 | 19786 | SENSE | 0.226 | 0.265 | 0.580 | 0.372 | 1.083 | 0.040 |
| 1039 | 19825 | SENSE | 0.053 | 0.662 | −0.055 | 0.759 | 0.872 | 0.022 |
| 1037 | 19893 | SENSE | −0.089 | 0.168 | −0.130 | 0.249 | 0.787 | 0.023 |
| 1040 | 19919 | SENSE | −0.214 | 0.277 | 0.198 | 0.435 | 0.814 | 0.050 |
| 1041 | 19979 | SENSE | 0.202 | 0.080 | 0.738 | 0.222 | 1.048 | 0.047 |
| 1031 | 19982 | SENSE | 0.241 | 0.111 | 0.933 | 0.263 | 1.127 | 0.025 |
| 1038 | 19983 | SENSE | 0.238 | 0.218 | 0.834 | 0.367 | 0.876 | 0.002 |
| 1028 | 19985 | SENSE | 0.216 | 0.057 | 0.414 | 0.306 | 0.860 | 0.001 |
| 1036 | 19987 | SENSE | 0.052 | 0.568 | 0.584 | 0.442 | 0.834 | 0.028 |
| 925 | 70102 | SENSE | −0.013 | 0.877 | −0.115 | 0.461 | 0.779 | 0.012 |
| 926 | 70106 | SENSE | 0.038 | 0.667 | −0.016 | 0.692 | 0.869 | 0.028 |
| 927 | 70113 | SENSE | 0.163 | 0.289 | 1.098 | 0.222 | 1.005 | 0.012 |
| 930 | 70128 | SENSE | 0.025 | 0.785 | 0.347 | 0.302 | 0.920 | 0.016 |
| 931 | 70130 | SENSE | 0.238 | 0.111 | −0.041 | 0.447 | 1.275 | 0.000 |
| 884 | 70216 | SENSE | 0.012 | 0.932 | 0.165 | 0.689 | 0.708 | 0.007 |
| 1436 | 70229 | SENSE | −0.074 | 0.761 | 0.228 | 0.259 | 0.494 | 0.034 |
| 1446 | 70230 | SENSE | 0.068 | 0.053 | −0.005 | 0.908 | 0.554 | 0.008 |
| 804 | 70244 | SENSE | 0.019 | 0.894 | / | / | 0.468 | 0.036 |
| 845 | 70253 | SENSE | −0.080 | 0.196 | −0.189 | 0.436 | 1.085 | 0.004 |
| 856 | 70412 | SENSE | 0.151 | 0.185 | 1.151 | 0.374 | 0.757 | 0.023 |
| 975 | 70425 | SENSE | −0.050 | 0.712 | / | / | 0.815 | 0.011 |
| 1014 | 70433 | SENSE | 0.196 | 0.242 | / | / | 0.737 | 0.021 |
| 1015 | 70434 | SENSE | 0.136 | 0.106 | / | / | 0.814 | 0.000 |
| 1017 | 70436 | SENSE | 0.199 | 0.196 | 0.008 | 0.918 | 0.969 | 0.017 |
| 1019 | 70439 | SENSE | 0.188 | 0.127 | 0.846 | 0.311 | 1.250 | 0.012 |
| 1001 | 70603 | SENSE | 0.430 | 0.028 | 0.301 | 0.281 | 1.573 | 0.004 |
| 1052 | 70635 | SENSE | −0.199 | 0.020 | −0.185 | 0.234 | 0.381 | 0.045 |
| 1054 | 70638 | SENSE | 0.004 | 0.943 | −0.069 | 0.197 | 0.788 | 0.036 |
| 1055 | 70642 | SENSE | −0.100 | 0.336 | −0.278 | 0.049 | 0.385 | 0.003 |
| 1056 | 70643 | SENSE | 0.160 | 0.445 | −0.001 | 0.423 | 0.947 | 0.021 |
| 1078 | 70682 | SENSE | −0.203 | 0.156 | −0.278 | 0.057 | 0.404 | 0.024 |
| 920 | 70706 | ANTI-SENSE | −0.354 | 0.066 | −0.162 | 0.208 | 0.517 | 0.010 |
| 843 | 70716 | ANTI-SENSE | 0.098 | 0.240 | 0.013 | 0.970 | 0.858 | 0.001 |
| 837 | 70721 | ANTI-SENSE | 0.254 | 0.047 | 0.346 | 0.068 | 0.859 | 0.008 |
| 859 | 70723 | ANTI-SENSE | 0.180 | 0.341 | 1.110 | 0.253 | 0.990 | 0.016 |
| 1026 | 70741 | SENSE | 0.046 | 0.693 | 0.469 | 0.265 | 0.927 | 0.008 |
| 1093 | 70810 | SENSE | 0.168 | 0.053 | −0.072 | 0.275 | 0.897 | 0.013 |
| 1008 | 70827 | SENSE | −0.106 | 0.519 | 0.878 | 0.158 | 0.646 | 0.045 |
| 880 | 70832 | SENSE | 0.224 | 0.152 | 1.398 | 0.318 | 0.912 | 0.008 |
| 1263 | 70850 | SENSE | −0.002 | 0.986 | 0.312 | 0.296 | 0.887 | 0.035 |
| 1043 | 70903 | SENSE | 0.065 | 0.734 | 0.623 | 0.454 | 0.776 | 0.002 |
| 1046 | 70936 | SENSE | 0.393 | 0.063 | 0.889 | 0.020 | 1.352 | 0.008 |
| 1044 | 70970 | SENSE | 0.335 | 0.231 | 0.520 | 0.444 | 1.429 | 0.031 |
| 1547 | 71107 | SENSE | −0.257 | 0.177 | 0.027 | 0.685 | 0.528 | 0.045 |
| 1126 | 71125 | SENSE | 0.236 | 0.091 | 1.197 | 0.112 | 1.308 | 0.029 |
| 921 | 71145 | SENSE | 0.093 | 0.534 | / | / | 0.535 | 0.030 |
| 1604 | 71249 | SENSE | −0.150 | 0.372 | 0.056 | 0.768 | 0.866 | 0.035 |
| 977 | 71303 | SENSE | 0.103 | 0.377 | / | / | 0.858 | 0.025 |
| 1067 | 71318 | SENSE | 0.100 | 0.212 | 0.498 | 0.324 | 1.190 | 0.004 |
| 957 | 71531 | SENSE | −0.087 | 0.696 | −0.085 | 0.224 | 0.718 | 0.048 |
| 1006 | 71536 | SENSE | 0.021 | 0.831 | −0.134 | 0.725 | 0.922 | 0.047 |
| 1057 | 71564 | SENSE | 0.305 | 0.153 | 0.033 | 0.795 | 0.793 | 0.013 |
| 1091 | 71629 | SENSE | 0.084 | 0.202 | 1.387 | 0.044 | 1.001 | 0.019 |
| 1083 | 71696 | SENSE | 0.222 | 0.304 | 0.850 | 0.296 | 0.885 | 0.043 |
| 965 | 71719 | SENSE | 0.113 | 0.605 | 0.088 | 0.689 | 0.989 | 0.046 |
| 1063 | 71808 | SENSE | 0.158 | 0.043 | 0.589 | 0.172 | 0.956 | 0.011 |
| 1143 | 72110 | SENSE | −0.031 | 0.607 | −0.114 | 0.565 | 0.329 | 0.041 |
| 1142 | 72124 | SENSE | −0.211 | 0.255 | −0.100 | 0.411 | 0.568 | 0.049 |
| 1542 | 72314 | SENSE | 0.127 | 0.271 | 1.270 | 0.224 | 0.943 | 0.002 |
| 1288 | 72340 | SENSE | 0.089 | 0.574 | 0.893 | 0.258 | 0.864 | 0.032 |
| 910 | 72427 | ANTI-SENSE | −0.024 | 0.813 | −0.019 | 0.423 | 0.658 | 0.006 |
| 1084 | 72475 | SENSE | −0.129 | 0.192 | 0.024 | 0.896 | 0.697 | 0.013 |
| 1087 | 72476 | SENSE | −0.136 | 0.228 | −0.168 | 0.134 | 0.729 | 0.007 |
| 1098 | 72537 | SENSE | −0.124 | 0.341 | −0.254 | 0.011 | 0.352 | 0.025 |
| 1169 | 72732 | SENSE | 0.191 | 0.165 | 0.090 | 0.641 | 0.700 | 0.020 |
| 933 | 72748 | SENSE | 0.125 | 0.369 | 1.403 | 0.138 | 1.010 | 0.000 |
| 1158 | 72749 | SENSE | 0.053 | 0.642 | 0.625 | 0.250 | 0.881 | 0.027 |
| 1161 | 72775 | SENSE | −0.050 | 0.707 | −0.157 | 0.333 | 0.861 | 0.049 |
| 1163 | 72776 | SENSE | 0.091 | 0.358 | 1.128 | 0.239 | 1.244 | 0.006 |
| 1168 | 72791 | SENSE | −0.095 | 0.672 | / | / | 0.763 | 0.034 |
| 1199 | 72909 | SENSE | 0.254 | 0.065 | −0.033 | 0.348 | 0.818 | 0.048 |
| 1203 | 72958 | SENSE | −0.030 | 0.774 | −0.052 | 0.358 | 0.840 | 0.034 |
| 1195 | 73018 | SENSE | 0.053 | 0.638 | 0.057 | 0.895 | 0.856 | 0.042 |
| 1202 | 73036 | SENSE | −0.005 | 0.957 | 0.282 | 0.386 | 0.783 | 0.007 |
| 1188 | 73074 | SENSE | −0.146 | 0.202 | −0.081 | 0.319 | 0.667 | 0.028 |
| 1193 | 73077 | SENSE | 0.028 | 0.770 | 0.495 | 0.459 | 0.944 | 0.001 |
| 1196 | 73112 | SENSE | 0.021 | 0.846 | / | / | 0.886 | 0.019 |
| 1180 | 73117 | SENSE | −0.060 | 0.537 | 0.124 | 0.759 | 0.996 | 0.018 |
| 1178 | 73128 | SENSE | 0.149 | 0.075 | 0.248 | 0.598 | 0.934 | 0.038 |
| 1191 | 73147 | SENSE | 0.689 | 0.024 | 0.822 | 0.293 | 1.572 | 0.010 |
| 1174 | 73174 | SENSE | 0.305 | 0.027 | 0.532 | 0.480 | 0.779 | 0.046 |
| 1194 | 73183 | SENSE | 0.113 | 0.617 | 0.180 | 0.573 | 0.969 | 0.004 |
| 1175 | 73186 | SENSE | 0.101 | 0.628 | 1.230 | 0.130 | 0.714 | 0.014 |
| 1131 | 73248 | SENSE | 0.289 | 0.103 | 0.455 | 0.104 | 1.034 | 0.018 |
| 1118 | 73353 | SENSE | 0.108 | 0.504 | 0.947 | 0.218 | 0.864 | 0.024 |
| 1264 | 73429 | SENSE | 0.305 | 0.067 | 0.867 | 0.057 | 1.190 | 0.003 |
| 1267 | 73455 | SENSE | 0.133 | 0.064 | 0.299 | 0.033 | 0.559 | 0.018 |
| 1262 | 73474 | SENSE | −0.433 | 0.105 | −0.164 | 0.092 | 0.433 | 0.024 |
| 1274 | 73538 | SENSE | −0.003 | 0.962 | 0.241 | 0.339 | 0.741 | 0.003 |
| 1279 | 73565 | SENSE | 0.182 | 0.325 | 0.650 | 0.525 | 1.279 | 0.021 |
| 1275 | 73574 | SENSE | 0.067 | 0.721 | 0.363 | 0.636 | 0.758 | 0.043 |
| 996 | 73607 | SENSE | −0.070 | 0.388 | 0.401 | 0.673 | 0.636 | 0.024 |
| 896 | 73706 | SENSE | 0.064 | 0.744 | 0.294 | 0.124 | 1.082 | 0.012 |
| 1144 | 73916 | SENSE | −0.004 | 0.980 | 0.495 | 0.265 | 1.060 | 0.024 |
| 903 | 73977 | SENSE | 0.230 | 0.065 | 0.096 | 0.370 | 0.596 | 0.014 |
| 1182 | 73990 | SENSE | 0.133 | 0.346 | / | / | 1.140 | 0.025 |
| 1291 | 74133 | SENSE | −0.170 | 0.121 | −0.027 | 0.729 | 0.635 | 0.013 |
| 1289 | 74155 | SENSE | 0.211 | 0.210 | 0.458 | 0.420 | 0.945 | 0.017 |
| 1148 | 74273 | SENSE | 0.050 | 0.756 | 0.694 | 0.467 | 0.837 | 0.026 |
| 1149 | 74280 | SENSE | 0.117 | 0.251 | −0.103 | 0.271 | 0.785 | 0.002 |
| 1151 | 74287 | SENSE | 0.044 | 0.644 | −0.148 | 0.027 | 0.928 | 0.000 |
| 1206 | 74333 | SENSE | 0.144 | 0.114 | 0.144 | 0.521 | 0.748 | 0.023 |
| 1299 | 74431 | SENSE | 0.002 | 0.987 | −0.190 | 0.282 | 0.674 | 0.012 |
| 1293 | 74485 | SENSE | −0.007 | 0.920 | −0.098 | 0.273 | 0.923 | 0.007 |
| 1435 | 74508 | SENSE | 0.409 | 0.104 | 0.221 | 0.394 | 0.825 | 0.001 |
| 1302 | 74525 | SENSE | 0.110 | 0.261 | 0.080 | 0.467 | 0.967 | 0.004 |
| 1227 | 74612 | SENSE | −0.319 | 0.220 | −0.591 | 0.063 | 0.563 | 0.017 |
| 1233 | 74623 | SENSE | −0.167 | 0.140 | / | / | 0.521 | 0.000 |
| 1237 | 74638 | SENSE | 0.036 | 0.848 | 0.418 | 0.399 | 0.828 | 0.049 |
| 1209 | 74737 | SENSE | 0.004 | 0.959 | 0.877 | 0.414 | 0.972 | 0.008 |
| 1212 | 74747 | SENSE | 0.254 | 0.074 | 1.728 | 0.157 | 0.961 | 0.027 |
| 1355 | 74804 | SENSE | 0.615 | 0.095 | 1.179 | 0.314 | 1.685 | 0.019 |
| 1352 | 74826 | SENSE | −0.062 | 0.460 | / | / | 0.655 | 0.009 |
| 1353 | 74850 | SENSE | 0.167 | 0.271 | 0.910 | 0.352 | 0.950 | 0.040 |
| 1359 | 74901 | SENSE | 0.117 | 0.664 | 0.258 | 0.353 | 0.897 | 0.041 |
| 1361 | 74904 | SENSE | −0.030 | 0.814 | −0.030 | 0.791 | 0.866 | 0.016 |

TABLE 5-continued

| PEP SEQ ID | Construct ID | Orientation | Root length day 14 Delta mean | Root length day 14 P-value | Growth stage at day 14 Risk score mean | Growth stage at day 14 P-value | Seedling weight Delta mean | Seedling weight P-value |
|---|---|---|---|---|---|---|---|---|
| 1365 | 74966 | SENSE | −0.041 | 0.658 | 0.114 | 0.770 | 0.671 | 0.015 |
| 1360 | 74974 | SENSE | 0.142 | 0.382 | −0.117 | 0.116 | 0.793 | 0.047 |
| 1130 | 75206 | SENSE | 0.044 | 0.484 | −0.217 | 0.093 | 0.671 | 0.010 |
| 1254 | 75281 | SENSE | 0.207 | 0.020 | 0.046 | 0.795 | 0.827 | 0.009 |
| 1380 | 75323 | SENSE | 0.041 | 0.684 | −0.202 | 0.074 | 0.473 | 0.006 |
| 1374 | 75330 | SENSE | −0.005 | 0.712 | −0.001 | 0.998 | 0.753 | 0.001 |
| 1379 | 75334 | SENSE | 0.427 | 0.107 | 0.050 | 0.599 | 1.040 | 0.004 |
| 1376 | 75366 | SENSE | −0.013 | 0.883 | / | / | 0.832 | 0.008 |
| 1372 | 75389 | SENSE | 0.304 | 0.038 | 0.181 | 0.377 | 0.923 | 0.005 |
| 1378 | 75391 | SENSE | 0.076 | 0.434 | 0.109 | 0.434 | 0.918 | 0.020 |
| 1382 | 75401 | SENSE | 0.020 | 0.910 | / | / | 0.854 | 0.005 |
| 1392 | 75446 | SENSE | 0.431 | 0.174 | 0.231 | 0.269 | 0.967 | 0.021 |
| 1390 | 75454 | SENSE | 0.055 | 0.585 | 0.288 | 0.378 | 0.770 | 0.022 |
| 1384 | 75461 | SENSE | 0.032 | 0.434 | 0.020 | 0.936 | 0.931 | 0.034 |
| 1388 | 75464 | SENSE | −0.117 | 0.288 | 0.085 | 0.651 | 0.717 | 0.014 |
| 1391 | 75493 | SENSE | 0.007 | 0.891 | −0.021 | 0.738 | 1.080 | 0.013 |
| 1401 | 75512 | SENSE | 0.089 | 0.652 | 0.860 | 0.279 | 0.806 | 0.032 |
| 1409 | 75605 | SENSE | 0.153 | 0.136 | −0.016 | 0.721 | 1.065 | 0.014 |
| 1413 | 75623 | SENSE | 0.151 | 0.321 | −0.030 | 0.721 | 0.751 | 0.000 |
| 1403 | 75626 | SENSE | 0.364 | 0.001 | 0.619 | 0.475 | 1.127 | 0.014 |
| 1404 | 75674 | SENSE | −0.028 | 0.530 | / | / | 0.893 | 0.021 |
| 1415 | 75695 | SENSE | 0.132 | 0.300 | 0.072 | 0.640 | 1.108 | 0.010 |
| 1419 | 75714 | SENSE | −0.049 | 0.701 | 0.169 | 0.588 | 0.853 | 0.025 |
| 1308 | 75832 | SENSE | 0.043 | 0.229 | −0.006 | 0.944 | 0.691 | 0.013 |
| 1318 | 75848 | SENSE | 0.117 | 0.485 | 0.324 | 0.491 | 0.953 | 0.035 |
| 1321 | 75852 | SENSE | −0.218 | 0.196 | −0.017 | 0.895 | 0.468 | 0.039 |
| 1330 | 75879 | SENSE | 0.126 | 0.570 | −0.007 | 0.937 | 0.863 | 0.042 |
| 1331 | 75880 | SENSE | 0.198 | 0.119 | 0.331 | 0.249 | 0.842 | 0.011 |
| 1468 | 75908 | SENSE | 0.057 | 0.686 | −0.064 | 0.759 | 0.916 | 0.015 |
| 1467 | 75919 | SENSE | −0.063 | 0.562 | −0.056 | 0.586 | 0.640 | 0.036 |
| 1471 | 75933 | SENSE | 0.126 | 0.099 | 0.431 | 0.238 | 0.905 | 0.004 |
| 1466 | 75940 | SENSE | 0.147 | 0.429 | 1.316 | 0.343 | 0.872 | 0.049 |
| 830 | 75958 | SENSE | 0.036 | 0.515 | −0.144 | 0.102 | 1.048 | 0.001 |
| 826 | 75969 | SENSE | 0.164 | 0.316 | 0.002 | 0.990 | 0.696 | 0.025 |
| 1470 | 75992 | SENSE | 0.103 | 0.525 | 0.101 | 0.605 | 0.853 | 0.005 |
| 832 | 76002 | SENSE | −0.016 | 0.860 | 0.032 | 0.815 | 0.868 | 0.023 |
| 892 | 76017 | SENSE | 0.107 | 0.424 | 0.359 | 0.280 | 0.978 | 0.022 |
| 843 | 76039 | SENSE | 0.226 | 0.299 | 0.039 | 0.656 | 1.072 | 0.008 |
| 914 | 76053 | SENSE | 0.293 | 0.058 | 0.940 | 0.022 | 1.142 | 0.004 |
| 1215 | 76212 | SENSE | 0.006 | 0.732 | 0.105 | 0.829 | 0.808 | 0.012 |
| 1258 | 76236 | SENSE | −0.062 | 0.693 | 0.941 | 0.453 | 0.871 | 0.031 |
| 1314 | 76261 | SENSE | 0.065 | 0.490 | 0.699 | 0.344 | 0.901 | 0.039 |
| 1526 | 76337 | SENSE | 0.121 | 0.439 | 0.454 | 0.199 | 0.924 | 0.010 |
| 1532 | 76378 | SENSE | −0.077 | 0.500 | 0.220 | 0.481 | 0.829 | 0.034 |
| 1536 | 76381 | SENSE | −0.011 | 0.954 | 0.712 | 0.324 | 0.806 | 0.004 |
| 1340 | 76462 | SENSE | −0.019 | 0.861 | −0.004 | 0.959 | 0.716 | 0.038 |
| 1221 | 76530 | SENSE | 0.260 | 0.305 | −0.053 | 0.801 | 1.088 | 0.004 |
| 1342 | 76568 | SENSE | −0.008 | 0.748 | 0.059 | 0.677 | 0.610 | 0.016 |
| 1337 | 76621 | SENSE | −0.098 | 0.270 | 0.001 | 0.995 | 0.622 | 0.006 |
| 1346 | 76629 | SENSE | 0.154 | 0.603 | 0.550 | 0.509 | 0.982 | 0.049 |
| 1222 | 76716 | SENSE | −0.007 | 0.945 | / | / | 0.792 | 0.024 |
| 1333 | 76745 | SENSE | 0.044 | 0.738 | −0.010 | 0.927 | 0.695 | 0.021 |
| 1550 | 76805 | SENSE | 0.369 | 0.113 | 0.041 | 0.519 | 0.950 | 0.018 |
| 1551 | 76817 | SENSE | 0.126 | 0.645 | 0.007 | 0.790 | 0.861 | 0.024 |
| 1562 | 76848 | SENSE | −0.080 | 0.699 | −0.112 | 0.185 | 0.804 | 0.006 |
| 1558 | 76869 | SENSE | 0.345 | 0.160 | 1.378 | 0.130 | 1.205 | 0.030 |
| 1548 | 76887 | SENSE | 0.319 | 0.292 | / | / | 0.812 | 0.036 |
| 1554 | 76890 | SENSE | 0.226 | 0.007 | −0.032 | 0.300 | 0.659 | 0.027 |
| 1567 | 76904 | SENSE | 0.178 | 0.268 | / | / | 0.917 | 0.004 |
| 1310 | 77034 | SENSE | −0.033 | 0.843 | 0.479 | 0.109 | 0.953 | 0.001 |
| 1572 | 77127 | SENSE | 0.061 | 0.705 | −0.026 | 0.704 | 0.769 | 0.043 |
| 1582 | 77171 | SENSE | 0.054 | 0.519 | −0.133 | 0.026 | 0.698 | 0.000 |
| 1575 | 77179 | SENSE | 0.146 | 0.392 | 0.039 | 0.517 | 1.072 | 0.010 |
| 1587 | 77184 | SENSE | 0.025 | 0.782 | / | / | 0.979 | 0.012 |
| 1153 | 77304 | SENSE | 0.174 | 0.297 | 1.437 | 0.321 | 1.010 | 0.047 |
| 1223 | 77328 | SENSE | 0.116 | 0.253 | / | / | 1.016 | 0.024 |
| 1445 | 77345 | SENSE | 0.222 | 0.005 | 0.215 | 0.529 | 0.833 | 0.010 |
| 1447 | 77353 | SENSE | 0.124 | 0.184 | 0.043 | 0.702 | 0.830 | 0.007 |
| 1594 | 77414 | SENSE | 0.115 | 0.229 | / | / | 0.965 | 0.002 |
| 1601 | 77419 | SENSE | 0.309 | 0.205 | 0.762 | 0.199 | 1.166 | 0.013 |
| 1600 | 77442 | SENSE | 0.112 | 0.214 | 0.779 | 0.067 | 0.825 | 0.019 |
| 1596 | 77463 | SENSE | −0.027 | 0.865 | −0.143 | 0.007 | 0.674 | 0.045 |
| 1319 | 77515 | SENSE | 0.242 | 0.195 | 0.088 | 0.276 | 1.411 | 0.014 |
| 1332 | 77519 | SENSE | 0.667 | 0.043 | 1.824 | 0.173 | 1.142 | 0.021 |
| 1323 | 77523 | SENSE | 0.190 | 0.379 | 1.044 | 0.059 | 1.312 | 0.014 |
| 1426 | 77554 | SENSE | 0.358 | 0.257 | 1.126 | 0.108 | 0.949 | 0.034 |
| 1430 | 77560 | SENSE | −0.047 | 0.095 | 0.786 | 0.380 | 0.583 | 0.012 |
| 1438 | 77567 | SENSE | −0.178 | 0.220 | / | / | 0.437 | 0.020 |
| 1440 | 77578 | SENSE | 0.213 | 0.119 | 1.089 | 0.387 | 0.931 | 0.013 |
| 1270 | 77726 | SENSE | −0.060 | 0.338 | / | / | 0.990 | 0.007 |
| 1368 | 77814 | SENSE | −0.032 | 0.843 | −0.117 | 0.556 | 0.885 | 0.025 |
| 1395 | 77818 | SENSE | 0.094 | 0.220 | 0.336 | 0.311 | 0.879 | 0.004 |
| 1248 | 77903 | SENSE | 0.014 | 0.798 | 0.015 | 0.874 | 0.675 | 0.017 |
| 1443 | 77925 | SENSE | 0.005 | 0.960 | 0.085 | 0.472 | 0.911 | 0.001 |
| 1444 | 77927 | SENSE | −0.167 | 0.181 | −0.114 | 0.590 | 0.638 | 0.002 |
| 1456 | 77937 | SENSE | 0.231 | 0.151 | 0.815 | 0.062 | 1.368 | 0.001 |
| 1458 | 77940 | SENSE | −0.017 | 0.859 | / | / | 0.706 | 0.004 |
| 1421 | 77954 | SENSE | 0.326 | 0.111 | 1.981 | 0.208 | 1.139 | 0.014 |
| 1422 | 77955 | SENSE | −0.078 | 0.652 | −0.062 | 0.104 | 0.529 | 0.029 |
| 1437 | 77959 | SENSE | 0.345 | 0.055 | 0.505 | 0.429 | 1.016 | 0.038 |
| 1474 | 77972 | SENSE | 0.101 | 0.481 | 0.125 | 0.606 | 1.030 | 0.008 |
| 1495 | 78019 | SENSE | 0.030 | 0.321 | 0.320 | 0.481 | 0.931 | 0.034 |
| 1429 | 78128 | SENSE | 0.341 | 0.052 | 0.016 | 0.764 | 1.007 | 0.021 |
| 1424 | 78131 | SENSE | 0.042 | 0.138 | 0.018 | 0.829 | 0.687 | 0.005 |
| 1499 | 78161 | SENSE | 0.156 | 0.202 | 0.170 | 0.418 | 0.898 | 0.000 |
| 1522 | 78191 | SENSE | 0.177 | 0.313 | 0.964 | 0.512 | 0.854 | 0.020 |
| 1061 | 78321 | SENSE | 0.196 | 0.245 | −0.007 | 0.773 | 1.013 | 0.048 |
| 1110 | 78325 | SENSE | 0.046 | 0.345 | 0.123 | 0.609 | 0.643 | 0.007 |
| 1232 | 78364 | SENSE | 0.054 | 0.615 | 0.837 | 0.243 | 0.475 | 0.038 |
| 1239 | 78365 | SENSE | 0.083 | 0.384 | / | / | 1.153 | 0.030 |
| 948 | 78370 | SENSE | 0.016 | 0.854 | 0.310 | 0.456 | 0.826 | 0.036 |
| 1000 | 78373 | SENSE | 0.018 | 0.774 | 0.595 | 0.263 | 1.046 | 0.009 |
| 1482 | 78538 | SENSE | 0.123 | 0.332 | 1.152 | 0.342 | 0.921 | 0.024 |
| 1490 | 78543 | SENSE | −0.003 | 0.979 | / | / | 0.934 | 0.008 |
| 1513 | 78566 | SENSE | 0.131 | 0.429 | 0.479 | 0.532 | 0.820 | 0.017 |
| 1523 | 78595 | SENSE | 0.182 | 0.295 | 0.005 | 0.938 | 0.766 | 0.014 |
| 1520 | 78632 | SENSE | 0.394 | 0.058 | 0.997 | 0.314 | 1.143 | 0.017 |
| 1459 | 78746 | SENSE | 0.192 | 0.256 | 1.115 | 0.346 | 1.025 | 0.013 |
| 1455 | 78904 | SENSE | 0.150 | 0.222 | 0.970 | 0.084 | 0.946 | 0.030 |
| 1483 | 78922 | SENSE | 0.162 | 0.307 | 2.327 | 0.024 | 1.156 | 0.007 |
| 1341 | 78987 | SENSE | −0.034 | 0.626 | 0.689 | 0.246 | 0.828 | 0.005 |
| 1434 | 78994 | SENSE | 0.282 | 0.000 | 2.384 | 0.009 | 0.940 | 0.002 |

Transgenic plants comprising recombinant DNA expressing protein as set forth in SEQ ID NO: 823, 825, 873, 886, 912, 916, 919, 928, 937, 942, 972, 986, 995, 1074, 1107, 1134, 1136, 1145, 1157, 1173, 1220, 1228, 1242, 1243, 1285, 1377, 1469, 1486, 1489, 1524, 1538, 1546, 1556, 1568, 1571, 1574, 1592, or 1603 showed enhanced heat stress tolerance by the second criteria as illustrated in Example 1L and 1M.

D. Salt Stress Tolerance Screen

This example sets forth the high salinity stress screen to identify *Arabidopsis* plants transformed with the gene of interest that are tolerant to high levels of salt based on their rate of development, root growth and chlorophyll accumulation under high salt conditions.

T2 seeds were plated on glufosinate selection plates containing 90 mM NaCl and grown under standard light and temperature conditions. All seedlings used in the experiment were grown at a temperature of 22° C. at day and 20° C. at night, a 16-hour photoperiod, an average light intensity of approximately 120 umol/m$^2$. On day 11, plants were measured for primary root length. After 3 more days of growth (day 14), plants were scored for transgenic status, primary root length, growth stage, visual color, and the seedlings were pooled for fresh weight measurement. A photograph of the whole plate was also taken on day 14.

The seedling weight and root length were analyzed as quantitative responses according to example 1M. The final growth stage at day 14 was scored as success if 50% of the plants reached 3 rosette leaves and size of leaves are greater than 1 mm (Boyes, D. C., et al., (2001), The Plant Cell 13, 1499/1510). The growth stage data Was analyzed as a qualitative response according to example 1L. A list of recombinant DNA constructs that improve high salinity tolerance in transgenic plants illustrated in Table 6.

T2 seeds were plated on BASTA selection plates containing 3% PEG and grown under standard light and temperature conditions. Seeds were plated on each plate containing 3% PEG, ½×MS salts, 1% phytagel, and 10 μg/ml glufosinate. Plates were placed at 4° C. for 3 clays to stratify seeds. On day 11, plants were measured for primary root length. After 3 more days of growth, e.g., at day 14, plants were scored for transgenic status, primary root length, growth

TABLE 6

| PEP SEQ ID | Orientation | Root length at day 11 | | Root length at day 14 | | Growth stage at day 14 | | Seedling weight at day 14 | |
|---|---|---|---|---|---|---|---|---|---|
| | | Delta mean | P-value | Delta mean | P-value | Delta mean | P-value | Delta mean | P-value |
| 932 | ANTI-SENSE | 0.305 | 0.019 | 0.360 | 0.093 | 0.583 | 0.428 | 0.835 | 0.050 |
| 955 | SENSE | 0.028 | 0.336 | 0.085 | 0.047 | −0.038 | 0.866 | 0.060 | 0.036 |
| 1093 | SENSE | 0.097 | 0.010 | 0.046 | 0.488 | 0.605 | 0.172 | 0.166 | 0.016 |
| 1139 | SENSE | 0.187 | 0.011 | 0.092 | 0.015 | −0.038 | 0.923 | −0.002 | 0.987 |
| 1183 | SENSE | 0.251 | 0.118 | 0.328 | 0.016 | / | / | 0.404 | 0.148 |
| 1106 | SENSE | 0.093 | 0.383 | 0.169 | 0.030 | 0.370 | 0.357 | 0.215 | 0.053 |
| 896 | SENSE | 0.349 | 0.000 | 0.270 | 0.069 | 0.057 | 0.797 | 0.421 | 0.047 |
| 1416 | SENSE | 0.062 | 0.516 | 0.081 | 0.035 | −0.159 | 0.513 | −0.076 | 0.670 |
| 1591 | SENSE | 0.034 | 0.592 | 0.051 | 0.003 | 0.255 | 0.623 | 0.194 | 0.052 |
| 1598 | SENSE | 0.227 | 0.004 | 0.224 | 0.002 | 1.203 | 0.316 | 0.281 | 0.258 |
| 1425 | SENSE | −0.107 | 0.327 | −0.028 | 0.724 | −0.215 | 0.425 | 0.384 | 0.029 |
| 1384 | SENSE | −0.088 | 0.195 | −0.0557 | 0.531 | −0.009 | 0.980 | 0.101 | 0.025 |

Transgenic plants comprising recombinant DNA expressing protein as set forth in SEQ ID NO: 821, 834, 890, 919, 946, 961, 997, 1013, 1080, 1101, 1147, 1160, 1181, 1197, 1200, 1220, 1237, 1248, 1264, 1300, 1313, 1355, 1393, 1397, 1406, 1467, 1496, 1514, 1530 or 1561 showed enhanced salt stress tolerance by the second criteria as illustrated in Example 1L and 1M.

E. Polyethylene Glycol (PEG) Induced Osmotic Stress Tolerance Screen

There are numerous factors, which can influence seed germination and subsequent seedling growth, one being the availability of water. Genes, which can directly affect the success rate of germination and early seedling growth, are usable agronomic traits for improving the germination and growth of crop plants under drought stress. In this assay, PEG was used to induce osmotic stress on germinating transgenic lines of *Arabidopsis thaliana* seeds in order to screen for osmotically resistant seed lines.

stage, visual color, and the seedlings were pooled for fresh weight measurement. A photograph of the whole plate was taken on day 14.

Seedling weight and root length were analyzed as quantitative responses according to example 1M. The final growth stage at day 14 was scored as success or failure based on whether the plants reached 3 rosette leaves and size of leaves are greater than 1 mm. The growth stage data was analyzed as a qualitative response according to example 1L. A list of recombinant DNA constructs that improve osmotic stress tolerance in transgenic plants illustrated in Table 7.

TABLE 7

| PEP Seq ID | Orientation | Root length at day 11 | | Root length at day 14 | | Growth stage at day 14 | | Seedling weight at day 14 | |
|---|---|---|---|---|---|---|---|---|---|
| | | Delta mean | P-value | Delta mean | P-value | Delta mean | P-value | Delta mean | P-value |
| 1019 | SENSE | 0.003 | 0.883 | 0.068 | 0.022 | 0.113 | 0.715 | −0.139 | 0.215 |
| 960 | SENSE | 0.139 | 0.278 | 0.065 | 0.010 | 2.264 | 0.322 | 0.197 | 0.256 |
| 1241 | SENSE | 0.061 | 0.690 | 0.096 | 0.044 | 1.011 | 0.569 | −0.095 | 0.666 |
| 1119 | SENSE | 0.002 | 0.978 | −0.107 | 0.415 | 2.760 | 0.156 | 0.156 | 0.000 |
| 1391 | SENSE | 0.602 | 0.012 | 0.533 | 0.044 | / | / | 0.866 | 0.005 |
| 1322 | SENSE | 0.062 | 0.041 | 0.150 | 0.020 | / | / | −0.132 | 0.218 |
| 1238 | SENSE | 0.099 | 0.387 | 0.118 | 0.004 | 2.693 | 0.175 | −0.187 | 0.005 |
| 1556 | SENSE | 0.153 | 0.116 | 0.271 | 0.081 | / | / | 0.331 | 0.019 |
| 1153 | SENSE | 0.063 | 0.067 | 0.081 | 0.134 | 2.964 | 0.104 | 0.280 | 0.020 |
| 1218 | SENSE | 0.040 | 0.067 | −0.089 | 0.170 | 0.492 | 0.806 | 0.198 | 0.030 |
| 1599 | SENSE | 0.099 | 0.168 | 0.103 | 0.237 | / | / | 0.292 | 0.031 |
| 1478 | SENSE | 0.216 | 0.115 | 0.197 | 0.041 | 1.353 | 0.414 | 0.234 | 0.388 |
| 1512 | SENSE | −0.167 | 0.071 | −0.230 | 0.141 | −1.066 | 0.090 | 0.085 | 0.012 |
| 1572 | SENSE | 0.447 | 0.005 | 0.352 | 0.025 | 4 | / | 0.656 | 0.046 |

Transgenic plants comprising recombinant DNA expressing protein as set forth in SEQ ID NO: 832, 833, 871, 874, 931, 974, 985, 997, 1021, 1024, 1031, 1043, 1053, 1059, 1060, 1091, 1111, 1115, 1118, 1120, 1124, 1127, 1128, 1159, 1172, 1179, 1185, 1197, 1213, 1226, 1230, 1244, 1253, 1265, 1306, 1320, 1327, 1354, 1355, 1357, 1362, 1367, 1381, 1395, 1398, 1399, 1407, 1462, 1494, 1499, 1500, 1523, 1529, 1532, 1544, 1548, 1569, 1572, 1573, 1595, or 1598 showed enhanced PEG osmotic stress tolerance by the second criteria as illustrated in Example 1L and 1M.

F. Cold Shock Tolerance Screen

This example set forth a screen to identify *Arabidopsis* plants transformed with the genes of interest that are more tolerant to cold stress subjected during day 8 to day 28 after seed planting. During these crucial early stages, seedling growth and leaf area increase were measured to assess tolerance when *Arabidopsis* seedlings were exposed to low temperatures. Using this screen, genetic alterations can be found that enable plants to germinate and grow better than wild type plants under sudden exposure to low temperatures.

Eleven seedlings from T2 seeds of each transgenic line plus one control line were plated together on a plate containing ½× Gamborg Salts with 0.8 Phytagel™, 1% Phytagel, and 0.3% Sucrose. Plates were then oriented horizontally and stratified for three days at 4° C. At day three, plates were removed from stratification and exposed to standard conditions (16 hr photoperiod, 22° C. at day and 20° C. at night) until day 8. At day eight, plates were removed from standard conditions and exposed to cold shock conditions (24 hr photoperiod, 8° C. at both day and night) until the final day of the assay, e.g., day 28. Rosette areas were measured at day 8 and day 28, which were analyzed as quantitative responses according to example 1M. A list of recombinant nucleotides that improve cold shock stress tolerance in plants illustrated in Table 8.

TABLE 8

| PEP SEQ ID | Construct ID | Orientation | Rosette area at day 8 Delta mean | P-value | Risk score mean | P-value | Rosette area difference Delta mean | P-value |
|---|---|---|---|---|---|---|---|---|
| 814 | 72361 | SENSE | 0.172 | 0.712 | 0.657 | 0.000 | 0.757 | 0.001 |
| 816 | 71626 | SENSE | 0.634 | 0.013 | 0.456 | 0.032 | 0.513 | 0.003 |
| 861 | 13965 | ANTI-SENSE | 0.414 | 0.077 | 0.248 | 0.117 | 0.274 | 0.012 |
| 915 | 16120 | SENSE | 0.494 | 0.247 | 0.758 | 0.042 | 0.722 | 0.077 |
| 918 | 72417 | SENSE | 0.984 | 0.041 | 0.125 | 0.023 | 0.114 | 0.051 |
| 923 | 71706 | SENSE | 0.010 | 0.943 | 0.231 | 0.064 | 0.459 | 0.019 |
| 962 | 70808 | SENSE | 0.394 | 0.285 | 0.290 | 0.014 | 0.362 | 0.072 |
| 974 | 72356 | SENSE | 0.570 | 0.057 | 0.823 | 0.044 | 0.888 | 0.096 |
| 1000 | 78373 | SENSE | −0.020 | 0.948 | 0.846 | 0.006 | 0.923 | 0.005 |
| 1012 | 73613 | SENSE | 0.574 | 0.024 | 0.579 | 0.010 | 0.570 | 0.012 |
| 1022 | 70447 | SENSE | 0.294 | 0.369 | 0.195 | 0.015 | 0.106 | 0.089 |
| 1023 | 71725 | SENSE | 0.201 | 0.492 | 0.199 | 0.026 | 0.225 | 0.055 |
| 1085 | 71677 | SENSE | 0.596 | 0.003 | 0.741 | 0.021 | 0.425 | 0.226 |
| 1097 | 72510 | SENSE | 0.813 | 0.250 | 0.891 | 0.009 | 1.105 | 0.015 |
| 1125 | 73221 | SENSE | 0.582 | 0.016 | 0.412 | 0.027 | 0.425 | 0.117 |
| 1141 | 72092 | SENSE | 0.092 | 0.750 | 0.568 | 0.006 | 0.480 | 0.027 |
| 1151 | 74287 | SENSE | 0.692 | 0.065 | 0.795 | 0.017 | 0.774 | 0.015 |
| 1153 | 77304 | SENSE | 0.664 | 0.194 | 1.164 | 0.014 | 1.479 | 0.014 |
| 1156 | 74719 | SENSE | 0.350 | 0.133 | 0.393 | 0.083 | 0.449 | 0.013 |
| 1171 | 73058 | SENSE | 0.500 | 0.180 | 0.322 | 0.027 | 0.329 | 0.049 |
| 1186 | 73131 | SENSE | 0.369 | 0.286 | 0.725 | 0.031 | 0.907 | 0.052 |
| 1187 | 73108 | SENSE | 0.579 | 0.065 | 0.725 | 0.018 | 0.644 | 0.025 |
| 1198 | 10908 | ANTI-SENSE | −0.549 | 0.086 | 0.112 | 0.095 | 0.136 | 0.050 |
| 1205 | 74732 | SENSE | 0.348 | 0.082 | 0.457 | 0.059 | 0.513 | 0.019 |
| 1239 | 78365 | SENSE | 0.430 | 0.141 | 0.621 | 0.035 | 0.600 | 0.043 |
| 1307 | 75830 | SENSE | 0.865 | 0.113 | 1.430 | 0.003 | 1.558 | 0.002 |
| 1315 | 78456 | SENSE | −0.352 | 0.118 | 0.534 | 0.077 | 0.650 | 0.049 |
| 1335 | 76746 | SENSE | 0.552 | 0.112 | 0.508 | 0.071 | 0.734 | 0.041 |
| 1343 | 76176 | SENSE | 0.435 | 0.095 | 1.337 | 0.018 | 1.472 | 0.018 |
| 1350 | 78115 | SENSE | 0.136 | 0.464 | 0.413 | 0.016 | 0.421 | 0.018 |
| 1375 | 75342 | SENSE | 1.019 | 0.029 | 1.486 | 0.039 | 1.752 | 0.046 |

TABLE 8-continued

| PEP SEQ ID | Construct ID | Orientation | Rosette area at day 8 Delta mean | P-value | Risk score mean | P-value | Rosette area difference Delta mean | P-value |
|---|---|---|---|---|---|---|---|---|
| 1408 | 75652 | SENSE | −0.425 | 0.454 | 0.388 | 0.005 | 0.415 | 0.009 |
| 1409 | 75605 | SENSE | 0.424 | 0.100 | 0.703 | 0.041 | 0.808 | 0.010 |
| 1420 | 75762 | SENSE | 1.078 | 0.039 | 0.558 | 0.037 | 0.480 | 0.011 |
| 1430 | 77560 | SENSE | 0.378 | 0.128 | 0.261 | 0.028 | 0.288 | 0.041 |
| 1431 | 77561 | SENSE | −0.191 | 0.296 | 0.446 | 0.054 | 0.511 | 0.047 |
| 1439 | 11749 | ANTI-SENSE | −0.458 | 0.494 | 0.622 | 0.028 | 0.710 | 0.008 |
| 1458 | 77940 | SENSE | 0.498 | 0.200 | 0.305 | 0.167 | 0.573 | 0.009 |
| 1461 | 78126 | SENSE | −0.708 | 0.080 | 0.426 | 0.046 | 0.485 | 0.071 |
| 1500 | 78162 | SENSE | 1.502 | 0.000 | 1.496 | 0.025 | 1.778 | 0.024 |
| 1502 | 78622 | SENSE | 0.550 | 0.221 | 0.722 | 0.018 | 0.752 | 0.016 |
| 1517 | 78571 | SENSE | 1.529 | 0.033 | 1.204 | 0.001 | 1.303 | 0.001 |
| 1519 | 78573 | SENSE | 0.292 | 0.457 | 0.603 | 0.007 | 0.542 | 0.038 |
| 1543 | 77840 | SENSE | −0.182 | 0.173 | 0.232 | 0.030 | 0.299 | 0.020 |
| 1565 | 76939 | SENSE | 0.598 | 0.154 | 0.520 | 0.037 | 0.597 | 0.035 |
| 1566 | 76987 | SENSE | 0.953 | 0.052 | 0.845 | 0.010 | 0.936 | 0.007 |
| 1577 | 77145 | SENSE | 0.408 | 0.180 | 0.403 | 0.041 | 0.368 | 0.140 |
| 1593 | 77462 | SENSE | 1.157 | 0.052 | 1.077 | 0.012 | 0.969 | 0.003 |
| 1601 | 77419 | SENSE | 0.156 | 0.513 | 0.763 | 0.010 | 0.844 | 0.031 |
| 1605 | 71237 | SENSE | 0.836 | 0.009 | 0.825 | 0.005 | 1.041 | 0.007 |
| 845 | 70253 | SENSE | 0.578 | 0.007 | 0.571 | 0.064 | 0.459 | 0.007 |
| 1007 | 70419 | SENSE | −0.079 | 0.646 | 0.197 | 0.126 | 0.266 | 0.012 |
| 1313 | 77511 | SENSE | 0.822 | 0.011 | 0.131 | 0.013 | 0.063 | 0.189 |
| 1332 | 77519 | SENSE | 0.275 | 0.286 | 0.911 | 0.034 | 1.020 | 0.031 |
| 1484 | 77984 | SENSE | −0.104 | 0.724 | 0.255 | 0.055 | 0.274 | 0.048 |

Transgenic plants comprising recombinant DNA expressing protein as set forth in SEQ ID NO: 818, 836, 844, 848, 883, 1029, 1045, 1062, 1082, 1277, 1287, 1294, 1305, 1318, 1366, 1369, 1373, 1387, 1402, 1405, 1410, 1412, 1418, 1427, 1433, 1476, 1481, 1495, 1531, or 1583 showed enhanced cold stress tolerance by the second criterial as illustrated in Example 1L and 1M.

G. Cold Germination Tolerance Screen

This example sets forth a screen to identify *Arabidopsis* plants transformed with the genes of interests are resistant to cold stress based on their rate of development, root growth and chlorophyll accumulation under low temperature conditions.

T2 seeds were plated and all seedlings used in the experiment were grown at 8° C. Seeds were first surface disinfested using-chlorine gas and then seeded on assay plates containing an aqueous solution of ½× Gamborg's B/5 Basal Salt Mixture (Sigma/Aldrich Corp., St. Louis, Mo., USA G/5788), 1% Phytagel™ (Sigma-Aldrich, P-8169), and 10 ug/ml glufosinate with the final pH adjusted to 5.8 using KOH. Test plates were held vertically for 28 days at a constant temperature of 8° C., a photoperiod of 16 hr, and average light intensity of approximately 100 umol/m²/s. At 28 days post plating, root length was measured, growth stage was observed, the visual color was assessed, and a whole plate photograph was taken.

The root length at day 28 was analyzed as a quantitative response according to example 1M. The growth stage at day 7 was analyzed as a qualitative response according to example 1L. A list of recombinant DNA constructs that improve cold stress tolerance in transgenic plants illustrated in Table 9,

TABLE 9

| NUC Seq ID NO | PEP SEQ ID NO | Construct ID | Nomination ID | Orientation | Root length at day 28 Delta mean | P-value | Growth stage at day 28 Delta mean | P-value |
|---|---|---|---|---|---|---|---|---|
| 187 | 990 | 18331 | CGPG3338 | SENSE | / | / | / | / |
| 227 | 1030 | 19829 | CGPG3981 | SENSE | −0.021 | 0.389 | 0.597 | 0.031 |
| 231 | 1034 | 70365 | CGPG4028 | SENSE | −0.088 | 0.312 | 0.725 | 0.013 |
| 214 | 1017 | 70436 | CGPG3703 | SENSE | 0.051 | 0.747 | 1.952 | 0.005 |
| 217 | 1020 | 70446 | CGPG3730 | SENSE | −0.064 | 0.784 | 1.572 | 0.009 |
| 159 | 962 | 70808 | CGPG289 | SENSE | 0.090 | 0.637 | 2.318 | 0.003 |
| 262 | 1065 | 71313 | CGPG4401 | SENSE | 0.160 | 0.542 | 1.654 | 0.001 |
| 272 | 1075 | 71339 | CGPG4551 | SENSE | / | / | / | / |
| 283 | 1086 | 71691 | CGPG4656 | SENSE | −0.048 | 0.305 | 1.121 | 0.003 |
| 335 | 1138 | 72016 | CGPG5246 | SENSE | 0.385 | 0.012 | 1.855 | 0.161 |
| 337 | 1140 | 72044 | CGPG5268 | SENSE | 0.442 | 0.044 | 1.908 | 0.003 |
| 359 | 1162 | 72728 | CGPG5530 | SENSE | 0.243 | 0.300 | 2.142 | 0.002 |
| 137 | 940 | 72796 | CGPG2451 | SENSE | 0.187 | 0.063 | 0.775 | 0.014 |
| 92 | 895 | 72952 | CGPG2095 | SENSE | / | / | / | / |
| 399 | 1202 | 73036 | CGPG5796 | SENSE | 0.246 | 0.127 | 2.235 | 0.001 |
| 64 | 867 | 73075 | CGPG1797 | SENSE | 0.046 | 0.788 | 1.242 | 0.007 |
| 377 | 1180 | 73117 | CGPG5657 | SENSE | 0.384 | 0.033 | 1.764 | 0.001 |
| 386 | 1189 | 73132 | CGPG5705 | SENSE | 0.208 | 0.283 | 2.646 | 0.003 |
| 374 | 1177 | 73139 | CGPG5641 | SENSE | 0.040 | 0.536 | 1.183 | 0.002 |
| 473 | 1276 | 73539 | CGPG6475 | SENSE | 0.004 | 0.967 | 1.052 | 0.002 |
| 482 | 1285 | 74104 | CGPG6566 | SENSE | 0.107 | 0.490 | 1.060 | 0.003 |
| 428 | 1231 | 74381 | CGPG6111 | SENSE | 0.060 | 0.631 | 0.457 | 0.049 |
| 632 | 1435 | 74508 | CGPG8 | SENSE | 0.323 | 0.009 | 1.197 | 0.387 |
| 433 | 1236 | 74635 | CGPG6147 | SENSE | 0.165 | 0.172 | 1.596 | 0.006 |
| 438 | 1241 | 74660 | CGPG6177 | SENSE | 0.358 | 0.007 | 1.518 | 0.001 |
| 571 | 1374 | 75330 | CGPG7508 | SENSE | 0.019 | 0.906 | 0.570 | 0.026 |
| 589 | 1392 | 75446 | CGPG7637 | SENSE | / | / | / | / |
| 598 | 1401 | 75512 | CGPG7752 | SENSE | 0.057 | 0.576 | 1.652 | 0.001 |
| 595 | 1398 | 75582 | CGPG7742 | SENSE | 0.213 | 0.374 | 1.883 | 0.003 |
| 506 | 1309 | 75836 | CGPG6827 | SENSE | 0.228 | 0.076 | 1.314 | 0.041 |
| 521 | 1324 | 75863 | CGPG6942 | SENSE | 0.162 | 0.132 | 1.468 | 0.002 |
| 523 | 1326 | 75865 | CGPG6949 | SENSE | 0.046 | 0.615 | 1.742 | 0.006 |
| 660 | 1463 | 75901 | CGPG8211 | SENSE | 0.437 | 0.015 | 1.733 | 0.070 |
| 59 | 862 | 75912 | CGPG1726 | SENSE | −0.035 | 0.550 | 0.265 | 0.000 |
| 37 | 840 | 76050 | CGPG1463 | SENSE | −0.146 | 0.404 | 0.213 | 0.043 |
| 408 | 1211 | 76113 | CGPG5862 | SENSE | 0.135 | 0.014 | 0.615 | 0.453 |
| 544 | 1347 | 76189 | CGPG7253 | SENSE | 0.015 | 0.018 | 0.333 | 0.645 |
| 722 | 1525 | 76325 | CGPG8870 | SENSE | −0.141 | 0.553 | 0.557 | 0.026 |
| 447 | 1250 | 76524 | CGPG6266 | SENSE | 0.099 | 0.300 | 1.123 | 0.015 |
| 446 | 1249 | 76653 | CGPG6254 | SENSE | 0.507 | 0.101 | 3.257 | 0.004 |
| 628 | 1431 | 77561 | CGPG7972 | SENSE | 0.278 | 0.061 | 1.265 | 0.009 |
| 647 | 1450 | 77588 | CGPG8108 | SENSE | 0.063 | 0.677 | 1.028 | 0.032 |
| 749 | 1552 | 77843 | CGPG9017 | SENSE | 0.382 | 0.011 | 1.325 | 0.006 |
| 701 | 1504 | 78043 | CGPG8606 | SENSE | 0.237 | 0.204 | 0.859 | 0.003 |
| 91 | 894 | 17227 | CGPG2077 | SENSE | 0.071 | 0.621 | 0.820 | 0.006 |
| 319 | 1122 | 73318 | CGPG5029 | SENSE | 0.004 | 0.989 | 0.532 | 0.011 |
| 465 | 1268 | 73432 | CGPG6421 | SENSE | −0.038 | 0.743 | 0.532 | 0.011 |
| 568 | 1371 | 77808 | CGPG7499 | SENSE | 0.170 | 0.037 | 1.138 | 0.023 |
| 312 | 1115 | 72814 | CGPG4982 | SENSE | 0.080 | 0.592 | 1.467 | 0.013 |
| 461 | 1264 | 73429 | CGPG6397 | SENSE | 0.320 | 0.206 | 1.589 | 0.017 |
| 682 | 1485 | 73938 | CGPG85 | SENSE | 0.029 | 0.927 | 1.140 | 0.005 |
| 680 | 1483 | 78922 | CGPG8489 | SENSE | 0.260 | 0.123 | 1.326 | 0.004 |

Transgenic plants comprising recombinant DNA expressing protein as set forth in 826, 863, 864, 941, 985, 1071, 1123; 1170, 1194, 1259, 1312, 1339, 1433, 1465, 1543, 1556 showed enhanced cold stress tolerance by the second criterial as illustrated in Example 1L and 1M.

H. Shade Tolerance Screen

Plants undergo a characteristic morphological response in shade that includes the elongation of the petiole, a change in the leaf angle, and a reduction in chlorophyll content. While these changes can confer a competitive advantage to individuals, in a monoculture the shade avoidance response is thought to reduce the overall biomass of the population. Thus, genetic alterations that prevent the shade avoidance response can be associated with higher yields. Genes that favor growth under low light conditions can also promote yield, as inadequate light levels frequently limit yield. This protocol describes a screen to look for *Arabidopsis* plants that show an attenuated shade avoidance response and/or grow better than control plants under low light intensity. Of particular interest, we were looking for plants that didn't extend their petiole length, had an increase in seedling weight relative to the reference and had leaves that were more close to parallel with the plate surface.

T2 seeds were plated on glufosinate selection plates with ½ MS medium. Seeds were sown on ½×MS salts, 1% Phytagel, 10 ug/ml BASTA. Plants were grown on vertical plates at a temperature of 22° C. at day, 20° C. at night and under low light (approximately 30 uE/m$^2$/s, far/red ratio (655/665/725/735)~0.35 using PLAQ lights with GAM color filter #680). Twenty-three days after seedlings were sown, measurements were recorded including seedling status, number of rosette leaves, status of flower bud, petiole leaf angle, petiole length, and pooled fresh weights. A digital image of the whole plate was taken on the measurement day.

Seedling weight and petiole length were analyzed as quantitative responses according to example 1M. The number of rosette leaves, flowering bud formation and leaf angel were analyzed as qualitative responses according to example 1L.

A list of recombinant DNA constructs that improve shade tolerance in plants illustrated in Table 10.

TABLE 10

| NUC Seq ID | PEP SEQ ID | Construct ID | Orientation | Seedling weight at day 23 Delta mean | P-value | Petiole length at day 23 Delta mean | P-value |
|---|---|---|---|---|---|---|---|
| 52 | 855 | 15624 | SENSE | 0.327 | 0.041 | 0.141 | 0.189 |
| 398 | 1201 | 72922 | SENSE | 0.421 | 0.049 | 0.339 | 0.070 |
| 427 | 1230 | 74377 | SENSE | 0.411 | 0.039 | 0.374 | 0.067 |
| 405 | 1208 | 74736 | SENSE | 0.268 | 0.024 | 0.147 | 0.141 |
| 566 | 1369 | 75387 | SENSE | 0.329 | 0.008 | 0.342 | 0.010 |
| 59 | 862 | 75912 | SENSE | 0.470 | 0.035 | 0.572 | 0.058 |
| 664 | 1467 | 75919 | SENSE | 0.453 | 0.007 | 0.114 | 0.063 |
| 736 | 1539 | 76335 | SENSE | −1.012 | 0.081 | −0.594 | 0.007 |
| 783 | 1586 | 77172 | SENSE | 0.426 | 0.044 | 0.218 | 0.164 |
| 698 | 1501 | 78033 | SENSE | 0.060 | 0.033 | −0.129 | 0.612 |

For "seeding weight", if p<0.05 and delta or risk score mean >0, the transgenic plants showed statistically significant trait enhancement as compared to the reference. If p<0.2 and delta or risk score mean >0, the transgenic plants showed a trend of trait enhancement as compared to the reference with p<0.2.

For "petiole length", if p<0.05 and delta <0, the transgenic plants showed statistically significant trait enhancement as compared to the reference. If p<0.2 and delta <0, the transgenic plants showed a trend of trait enhancement as compared to the reference.

Transgenic plants comprising recombinant DNA expressing protein as set forth in SEQ ID NO: 805, 828, 833, 870, 936, 937, 939, 965, 988, 1007, 1010, 1016, 1038, 1050, 1060, 1070, 1079, 1089, 1095, 1100, 1117, 125, 1129, 1134, 1135, 1145, 1150, 1154, 1155, 1158, 1184, 1204, 1210, 1214, 1216, 1217, 1225, 1226, 1235, 1248, 1252, 1255, 1260, 1271, 1278, 1282, 1283, 1289, 1292, 1297, 1304, 1311, 1312, 1317, 1328, 1336, 1338, 1348, 1363, 1366, 1383, 1386, 1400, 1428, 1448, 1451, 1453, 1462, 1491, 1493, 1505, 1516, 1520, 1528, 1533, 1545, 1579, or 1588 showed enhanced tolerance to shade or low light condition by the second criteria as illustrated in Example 1L and 1M.

I. Early Plant Growth and Development Screen

This example sets forth a plate based phenotypic analysis platform for the rapid detection of phenotypes that are evident during the first two weeks of growth. In this screen, we were looking for genes that confer advantages in the processes of germination, seedling vigor, root growth and root morphology under non-stressed growth conditions to plants. The transgenic plants with advantages in seedling growth and development were determined by the seedling weight and root length at day 14 after seed planting.

T2 seeds were plated on glufosinate selection plates and grown under standard conditions (~100 uE/m²/s, 16 h photoperiod, 22° C. at day, 20° C. at night). Seeds were stratified for 3 days at 4° C. Seedlings were grown vertically (at a temperature of 22° C. at day 20° C. at night). Observations were taken on day 10 and day 14. Both seedling weight and root length at clay 14 were analyzed as quantitative responses according to example 1M.

A list recombinant DNA constructs that improve early plant growth and development illustrated in Table 11.

TABLE 11

| NUC SEQ ID | PEP SEQ ID | Orientation | Root length at day 10 Delta mean | P-value | Root length at day 14 Delta mean | P-value | Seedling weight at day 14 Delta mean | P-value |
|---|---|---|---|---|---|---|---|---|
| 52 | 855 | SENSE | 0.091 | 0.027 | 0.071 | 0.018 | 0.037 | 0.744 |
| 102 | 905 | SENSE | 0.188 | 0.210 | 0.104 | 0.247 | 0.308 | 0.021 |
| 121 | 924 | SENSE | 0.242 | 0.015 | 0.128 | 0.063 | 0.203 | 0.078 |
| 153 | 956 | SENSE | 0.153 | 0.027 | 0.122 | 0.197 | 0.256 | 0.010 |
| 134 | 937 | SENSE | 0.329 | 0.048 | 0.250 | 0.085 | 0.712 | 0.020 |
| 144 | 947 | SENSE | 0.127 | 0.146 | 0.045 | 0.566 | 0.371 | 0.023 |
| 101 | 904 | SENSE | 0.537 | 0.026 | 0.356 | 0.004 | 0.634 | 0.021 |
| 178 | 981 | SENSE | 0.372 | 0.136 | 0.273 | 0.033 | 0.346 | 0.082 |
| 179 | 982 | SENSE | 0.404 | 0.001 | 0.222 | 0.051 | 0.288 | 0.111 |
| 191 | 994 | SENSE | 0.282 | 0.008 | 0.285 | 0.009 | 0.445 | 0.012 |
| 163 | 966 | SENSE | 0.132 | 0.219 | 0.121 | 0.035 | 0.135 | 0.439 |
| 74 | 877 | SENSE | 0.282 | 0.033 | 0.166 | 0.015 | 0.143 | 0.363 |
| 162 | 965 | SENSE | 0.320 | 0.119 | 0.253 | 0.035 | 0.458 | 0.109 |
| 296 | 1099 | SENSE | 0.047 | 0.653 | 0.057 | 0.369 | 0.141 | 0.013 |
| 313 | 1116 | SENSE | 0.222 | 0.124 | 0.166 | 0.039 | 0.187 | 0.202 |
| 400 | 1203 | SENSE | 0.103 | 0.336 | 0.171 | 0.067 | 0.263 | 0.049 |
| 459 | 1262 | SENSE | 0.278 | 0.081 | 0.273 | 0.027 | 0.308 | 0.121 |
| 215 | 1018 | SENSE | 0.138 | 0.023 | 0.088 | 0.068 | 0.167 | 0.092 |
| 498 | 1301 | SENSE | 0.248 | 0.245 | 0.203 | 0.100 | 0.435 | 0.002 |
| 492 | 1295 | SENSE | 0.066 | 0.018 | −0.052 | 0.334 | 0.215 | 0.171 |
| 567 | 1370 | SENSE | −0.134 | 0.218 | 0.030 | 0.770 | −0.132 | 0.305 |
| 611 | 1414 | SENSE | 0.232 | 0.220 | 0.168 | 0.035 | 0.165 | 0.319 |
| 614 | 1417 | SENSE | 0.142 | 0.277 | 0.147 | 0.174 | 0.167 | 0.562 |
| 616 | 1419 | SENSE | 0.038 | 0.549 | 0.046 | 0.130 | −0.028 | 0.873 |
| 526 | 1329 | SENSE | −0.044 | 0.135 | 0.070 | 0.044 | −0.026 | 0.085 |
| 663 | 1466 | SENSE | 0.075 | 0.043 | −0.065 | 0.418 | 0.047 | 0.639 |
| 79 | 882 | SENSE | 0.127 | 0.094 | 0.117 | 0.041 | 0.111 | 0.266 |
| 724 | 1527 | SENSE | 0.512 | 0.024 | 0.437 | 0.010 | 0.634 | 0.001 |
| 737 | 1540 | SENSE | −0.011 | 0.931 | 0.120 | 0.151 | −0.090 | 0.487 |
| 248 | 1051 | SENSE | 0.197 | 0.003 | 0.145 | 0.007 | 0.020 | 0.783 |
| 444 | 1247 | SENSE | 0.369 | 0.009 | 0.279 | 0.012 | 0.255 | 0.004 |
| 741 | 1544 | SENSE | 0.205 | 0.011 | 0.129 | 0.350 | 0.168 | 0.158 |
| 522 | 1325 | SENSE | 0.134 | 0.354 | 0.160 | 0.069 | 0.085 | 0.653 |
| 777 | 1580 | SENSE | 0.218 | 0.022 | 0.064 | 0.601 | 0.067 | 0.770 |
| 775 | 1578 | SENSE | −0.192 | 0.322 | 0.019 | 0.780 | −0.333 | 0.091 |
| 629 | 1432 | SENSE | −0.042 | 0.151 | 0.075 | 0.016 | −0.184 | 0.176 |
| 704 | 1507 | SENSE | −0.074 | 0.546 | 0.123 | 0.058 | 0.113 | 0.433 |
| 697 | 1500 | SENSE | 0.173 | 0.049 | 0.078 | 0.546 | 0.109 | 0.054 |
| 706 | 1509 | SENSE | 0.074 | 0.018 | 0.076 | 0.301 | 0.059 | 0.664 |
| 331 | 1134 | SENSE | 0.107 | 0.013 | 0.050 | 0.569 | 0.202 | 0.178 |
| 546 | 1349 | SENSE | −0.182 | 0.037 | −0.050 | 0.104 | −0.150 | 0.613 |
| 717 | 1520 | SENSE | 0.297 | 0.085 | 0.223 | 0.029 | 0.292 | 0.213 |
| 22 | 825 | SENSE | / | / | / | / | 0.444 | 0.025 |
| 581 | 1384 | SENSE | 0.116 | 0.126 | 0.193 | 0.013 | 0.181 | 0.175 |
| 726 | 1529 | SENSE | 0.375 | 0.012 | 0.088 | 0.188 | 0.353 | 0.015 |
| 755 | 1558 | SENSE | 0.409 | 0.031 | 0.203 | 0.091 | 0.346 | 0.198 |

Transgenic plants comprising recombinant DNA expressing a protein as set forth in 810, 831, 844, 857, 865, 884, 892, 917, 950, 954, 970, 983, 992, 998, 1004, 1005, 1029, 1033, 1043, 1072, 1101, 1109, 1115, 1133, 1181, 1200, 1284, 1310, 1340, 1384, 1391, 1443, 1449, 1471, 1480, 1483, 1498, 1506, 1508, 1510, 1529, 1548, 1553, 1555, 1556, 1558, 1559, 1564, 1576, or 1577 showed enhanced tolerance to shade or low light condition by the second criterial as illustrated in Example 1L and 1M.

J. Late Plant Growth and Development Screen

This example sets forth a soil based phenotypic platform to identify genes that confer advantages in the processes of leaf development, flowering production and seed maturity to plants.

*Arabidopsis* plants were grown on a commercial potting mixture (Metro Mix 360, Scotts Co., Marysville, Oh.) consisting of 30-40% medium grade horticultural vermiculite, 35-55% sphagnum peat moss, 10-20% processed bark ash, 1-15% pine bark and a starter nutrient charge. Soil was supplemented with Osmocote time-release fertilizer at a rate of 30 mg/ft³. T2 seeds were imbibed in 1% agarose solution for 3 days at 4° C. and then sown at a density of ~5 per 2½" pot. Thirty-two pots were ordered in a 4 by 8 grid in standard greenhouse flat. Plants were grown in environmentally controlled rooms under a 16 h day length with an average light intensity of ~200 µmoles/m²/s. Day and night temperature set points were 22° C. and 20° C., respectively. Humidity was maintained at 65%. Plants were watered by sub-irrigation every two days on average until mid-flowering, at which point the plants were watered daily until flowering was complete.

Application of the herbicide glufosinate was performed to select T2 individuals containing the target transgene. A single application of glufosinate was applied when the first true leaves were visible. Each pot was thinned to leave a single glufosinate-resistant seedling ~3 days after the selection was applied.

The rosette radius was measured at day 25. The silique length was measured at day 40. The plant parts were harvested at day 49 for dry weight measurements if flowering production was stopped. Otherwise, the dry weights of rosette and silique were carried out at day 53. The seeds were harvested at day 58. All measurements were analyzed as quantitative responses according to example 1M. A list of recombinant DNA constructs that improve late plant growth and development illustrated in Table 12.

0.1% sucrose T 1% phytagel media and grown under standard light and temperature conditions. At 12 days of growth, plants were scored for seedling status (e.g., viable or non-viable) and root length. After 21 days of growth, plants were scored for BASTA resistance, visual color, seedling weight, number of green leaves, number of rosette leaves, root length and formation of flowering buds. A photograph of each plant was also taken at this time point.

The seedling weight and root length were analyzed as quantitative responses according to example 1M. The number green leaves, the number of rosette leaves and the flowerbud formation were analyzed as qualitative responses according to example 1L. The leaf color raw data were collected on each plant as the percentages of five color elements (Green, DarkGreen, LightGreen, RedPurple, YellowChlorotic) using a computer imaging system. A statistical logistic regression model was developed to predict an overall value based on five colors for each plant.

A list of recombinant DNA constructs that improve low nitrogen availability tolerance in plants illustrated in Table 13.

TABLE 12

| PEP SEQ ID | Construct ID | Rosette dry weight at day 53 | | Rosette radius at day 25 | | Seed net dry weight at day 62 | | Silique dry weight at day 53 | | Silique length at day 40 | |
|---|---|---|---|---|---|---|---|---|---|---|---|
| | | Delta mean | P-value | Delta mean | P-value | Delta mean | P-value | Delta mean | P-value | Delta mean | P-value |
| 835 | 14405 | 0.110 | 0.430 | / | / | 0.557 | 0.001 | 0.200 | 0.214 | 0.043 | 0.252 |
| 869 | 14833 | 0.247 | 0.382 | / | / | 1.126 | 0.021 | 0.587 | 0.044 | 0.075 | 0.340 |
| 887 | 15207 | 0.238 | 0.023 | −0.407 | 0.087 | 0.047 | 0.785 | 0.343 | 0.046 | −0.015 | 0.540 |
| 949 | 70411 | 0.181 | 0.008 | / | / | −0.268 | 0.192 | 0.061 | 0.025 | −0.039 | 0.240 |
| 1057 | 71564 | 0.397 | 0.049 | 0.190 | 0.205 | 0.440 | 0.005 | 0.342 | 0.035 | 0.070 | 0.043 |
| 1066 | 72349 | 0.174 | 0.011 | / | / | −0.526 | 0.049 | −0.292 | 0.131 | 0.041 | 0.265 |
| 1102 | 72630 | 0.200 | 0.022 | / | / | 0.537 | 0.030 | −0.257 | 0.034 | −0.297 | 0.015 |
| 1108 | 73347 | 0.063 | 0.559 | −0.046 | 0.475 | 0.848 | 0.035 | 0.243 | 0.188 | −0.005 | 0.706 |
| 944 | 16612 | −0.438 | 0.116 | −0.280 | 0.026 | 0.493 | 0.023 | −0.746 | 0.034 | −0.023 | 0.289 |
| 929 | 70118 | −0.186 | 0.237 | −0.004 | 0.944 | 1.043 | 0.042 | / | / | 0.040 | 0.279 |
| 1025 | 70545 | 0.057 | 0.434 | 0.111 | 0.355 | 1.228 | 0.021 | / | / | −0.060 | 0.418 |
| 1079 | 70686 | −0.071 | 0.644 | 0.136 | 0.109 | 0.700 | 0.004 | / | / | 0.014 | 0.571 |
| 1088 | 70803 | 0.173 | 0.197 | −0.207 | 0.053 | 0.691 | 0.008 | / | / | 0.067 | 0.094 |
| 1261 | 73438 | 0.397 | 0.057 | −0.251 | 0.005 | 0.733 | 0.014 | −0.056 | 0.542 | −0.012 | 0.809 |
| 1077 | 73696 | −0.384 | 0.425 | −0.284 | 0.129 | 0.666 | 0.020 | / | / | −0.097 | 0.154 |
| 1394 | 75705 | 0.570 | 0.049 | 0.019 | 0.797 | 0.477 | 0.165 | 0.213 | 0.337 | −0.164 | 0.018 |
| 1210 | 76657 | 0.091 | 0.481 | −0.370 | 0.031 | 0.744 | 0.019 | −0.016 | 0.927 | −0.038 | 0.395 |
| 1488 | 78386 | 0.092 | 0.010 | −0.118 | 0.227 | −0.578 | 0.034 | / | / | 0.017 | 0.502 |
| 1475 | 78522 | 0.386 | 0.003 | 0.728 | 0.001 | 1.532 | 0.007 | / | / | 0.170 | 0.038 |

If p<0.05 and delta or risk score mean >0, the transgenic plants showed statistically significant trait enhancement as compared to the reference. If p<0.2 and delta or risk score mean >0, the transgenic plants showed a trend of trait enhancement as compared to the reference.

K. Limited Nitrogen Tolerance Screen

Under low nitrogen conditions, *Arabidopsis* seedlings become chlorotic and have less biomass. This example sets forth the limited nitrogen tolerance screen to identify *Arabidopsis* plants transformed with the gene of interest that are altered in their ability to accumulate biomass and/or retain chlorophyll under low nitrogen condition.

T2 seeds were plated on glufosinate selection plates containing 0.5×N-Free Hoagland's T 0.1 mM $NH_4NO_3$ T

TABLE 13

| NUC SEQ ID | PEP SEQ ID | Construct ID | Orientation | Leaf color at day 21 | | Rosette weight at day 21 | |
|---|---|---|---|---|---|---|---|
| | | | | Risk score mean | P-value | Delta mean | P-value |
| 188 | 991 | 10473 | SENSE | 4.078 | 0.017 | −0.181 | 0.023 |
| 373 | 1176 | 11141 | SENSE | 4.800 | 0.027 | −0.059 | 0.513 |
| 395 | 1198 | 11147 | SENSE | 3.499 | 0.012 | −0.157 | 0.323 |
| 10 | 813 | 11860 | ANTI-SENSE | −3.108 | 0.157 | 0.345 | 0.017 |
| 781 | 1584 | 11933 | ANTI-SENSE | 0.412 | 0.024 | 0.004 | 0.902 |
| 661 | 1464 | 12123 | ANTI-SENSE | 4.867 | 0.025 | 0.036 | 0.750 |
| 8 | 811 | 12147 | ANTI-SENSE | 2.164 | 0.134 | 0.074 | 0.007 |
| 6 | 809 | 12217 | SENSE | 3.494 | 0.047 | 0.086 | 0.245 |

TABLE 13-continued

| NUC SEQ ID | PEP SEQ ID | Construct ID | Orientation | Leaf color at day 21 Risk score mean | P-value | Rosette weight at day 21 Delta mean | P-value |
|---|---|---|---|---|---|---|---|
| 12 | 815 | 12230 | SENSE | 1.878 | 0.077 | 0.111 | 0.015 |
| 799 | 1602 | 12444 | SENSE | 0.144 | 0.926 | 0.014 | 0.010 |
| 21 | 824 | 12749 | ANTI-SENSE | 0.315 | 0.022 | 0.109 | 0.325 |
| 3 | 806 | 12816 | SENSE | −0.989 | 0.012 | 0.098 | 0.002 |
| 38 | 841 | 13038 | ANTI-SENSE | 2.207 | 0.450 | 0.074 | 0.040 |
| 39 | 842 | 13040 | ANTI-SENSE | 3.223 | 0.039 | 0.137 | 0.241 |
| 608 | 1411 | 13302 | ANTI-SENSE | 2.956 | 0.013 | 0.040 | 0.100 |
| 35 | 838 | 13828 | ANTI-SENSE | 3.733 | 0.002 | −0.043 | 0.188 |
| 46 | 849 | 14340 | ANTI-SENSE | 3.417 | 0.023 | −0.113 | 0.049 |
| 32 | 835 | 14405 | SENSE | 2.350 | 0.158 | 0.097 | 0.031 |
| 43 | 846 | 14415 | SENSE | 3.195 | 0.006 | −0.131 | 0.066 |
| 85 | 888 | 14915 | ANTI-SENSE | 3.923 | 0.005 | −0.081 | 0.079 |
| 78 | 881 | 15129 | SENSE | 3.751 | 0.002 | 0.096 | 0.164 |
| 104 | 907 | 15507 | ANTI-SENSE | 8.130 | 0.013 | −0.086 | 0.312 |
| 106 | 909 | 15959 | ANTI-SENSE | 5.694 | 0.032 | −0.165 | 0.121 |
| 98 | 901 | 16204 | SENSE | 7.476 | 0.013 | −0.012 | 0.416 |
| 95 | 898 | 16309 | SENSE | 0.678 | 0.046 | 0.072 | 0.436 |
| 65 | 868 | 16323 | SENSE | 2.085 | 0.019 | −0.008 | 0.779 |
| 16 | 819 | 17806 | ANTI-SENSE | 3.639 | 0.036 | −0.087 | 0.208 |
| 104 | 987 | 18319 | SENSE | 1.043 | 0.023 | −0.100 | 0.061 |
| 147 | 950 | 19154 | SENSE | −1.213 | 0.201 | 0.146 | 0.033 |
| 175 | 978 | 19240 | SENSE | 0.175 | 0.828 | 0.098 | 0.002 |
| 289 | 1092 | 71622 | SENSE | 0.222 | 0.357 | 0.082 | 0.003 |
| 287 | 1090 | 71637 | SENSE | 0.074 | 0.772 | 0.061 | 0.001 |
| 261 | 1064 | 71810 | SENSE | 2.561 | 0.010 | −0.038 | 0.111 |
| 416 | 1219 | 74350 | SENSE | 8.315 | 0.006 | 0.020 | 0.504 |
| 500 | 1303 | 74573 | SENSE | 4.232 | 0.015 | 0.093 | 0.207 |
| 555 | 1358 | 74836 | SENSE | 1.278 | 0.002 | −0.133 | 0.018 |
| 561 | 1364 | 74918 | SENSE | 5.122 | 0.022 | 0.414 | 0.346 |
| 27 | 830 | 75958 | SENSE | 1.827 | 0.046 | −0.078 | 0.101 |
| 731 | 1534 | 76321 | SENSE | 5.099 | 0.004 | −0.120 | 0.313 |
| 754 | 1557 | 76821 | SENSE | 4.293 | 0.011 | −0.157 | 0.044 |
| 757 | 1560 | 76894 | SENSE | 3.806 | 0.048 | 0.123 | 0.102 |
| 513 | 1316 | 77041 | SENSE | 1.772 | 0.042 | −0.186 | 0.098 |
| 786 | 1589 | 77250 | SENSE | 7.658 | 0.015 | 0.035 | 0.664 |
| 620 | 1423 | 77541 | SENSE | 1.896 | 0.045 | −0.189 | 0.081 |
| 746 | 1549 | 77842 | SENSE | 4.863 | 0.048 | −0.184 | 0.037 |
| 670 | 1473 | 77966 | SENSE | 1.716 | 0.120 | 0.218 | 0.022 |
| 719 | 1522 | 78191 | SENSE | 2.686 | 0.037 | 0.121 | 0.113 |
| 695 | 1498 | 78548 | SENSE | 1.766 | 0.191 | 0.116 | 0.027 |
| 226 | 1029 | 19775 | SENSE | 0.037 | 0.858 | 0.240 | 0.042 |
| 34 | 837 | 70721 | ANTI-SENSE | 1.858 | 0.012 | 0.052 | 0.047 |
| 280 | 1083 | 71696 | SENSE | −0.133 | 0.002 | 0.085 | 0.049 |

For rosette weight, if p<0.05 and delta or risk score mean >0, the transgenic plants showed statistically significant trait enhancement as compared to the reference. If p<0.2 and delta or risk score mean >0, the transgenic plants showed a trend of trail enhancement as compared to the reference with p<0.2. For root length, if p<0.05, the transgenic plants showed statistically significant trait enhancement as compared to the reference. If p<0.2, the transgenic plants showed a trend of trait enhancement as compared to the reference.

Transgenic plants comprising recombinant DNA expressing a protein as set forth in 807, 808, 817, 820, 829, 839, 847, 848, 850, 854, 858, 859, 866, 872, 875, 878, 889, 902, 908, 911, 922, 938, 944, 953, 963, 974, 980, 993, 1001, 1009, 1035, 1042, 1048, 1049, 1054, 1058, 1068, 1076, 1088, 1094, 1096, 1098, 1103, 1104, 1107, 1112, 1113, 1114, 1121, 1152, 1166, 1175, 1192, 1204, 1207, 1215, 1218, 1240, 1246, 1251, 1256, 1266, 1269, 1281, 1283, 1290, 1296, 1298, 1344, 1345, 1356, 1389, 1396, 1400, 1404, 1409, 1425, 1428, 1438, 1441, 1442, 1454, 1477, 1479, 1484, 1492, 1500, 1511, 1515, 1518, 1521, 1537, 1563, 1567, 1571, 1579, or 1603 showed enhanced tolerance to shade or low light condition by the second criterial as illustrated in Example 1L and 1M.

L. Statistic Analysis for Qualitative Responses

A list of responses that were analyzed as qualitative responses illustrated in Table 14.

TABLE 14

| response | Screen | categories (success vs. failure) |
|---|---|---|
| Wilting response Risk Score | Soil drought tolerance screen | non-wilted vs. wilted |
| growth stage at day 14 | heat stress tolerance screen | 50% of plants reach stage 1.03 vs. not |
| growth stage at day 14 | salt stress tolerance screen | 50% of plants reach stage 1.03 vs. not |
| growth stage at day 14 | PEG induced osmotic stress tolerance screen | 50% of plants reach stage 1.03 vs. not |
| growth stage at day 7 | cold germination tolerance screen | 50% of plants reach stage 0.5 vs. not |
| number of rosette leaves at day 23 | Shade tolerance screen | 5 leaves appeared vs. not |
| Flower bud formation at day 23 | Shade tolerance screen | flower buds appear vs. not |
| leaf angle at day 23 | Shade tolerance screen | >60 degree vs. <60 degree |
| number of green leaves at day 21 | limited nitrogen tolerance screen | 6 or 7 leaves appeared vs. not |
| number of rosette leaves at day 21 | limited nitrogen tolerance screen | 6 or 7 leaves appeared vs. not |
| Flower bud formation at day 21 | limited nitrogen tolerance screen | flower buds appear vs. not |

Plants were grouped into transgenic and reference groups and were scored as success or failure according to Table 14. First, the risk (R) was calculated, which is the proportion of plants that were scored as of failure plants within the group. Then the relative risk (RR) was calculated as the ratio of R (transgenic) to R (reference). Risk score (RS) was calculated as $-\log_2^{RR}$. Two criteria were used to determine a transgenic with enhanced trait(s). Transgenic plants comprising recombinant DNA disclosed herein showed trait enhancement according to either or both of the two criteria.

For the first criteria, the risk scores from multiple events of the transgene of interest were evaluated for statistical significance by t-test using SAS statistical software (SAS 9, SAS/STAT User's Guide, SAS Institute Inc, Cary, N.C., USA). RS with a value greater than 0 indicates that the transgenic plants perform better than the reference. RS with a value less than 0 indicates that the transgenic plants perform worse than the reference. The RS with a value equal to 0 indicates that the performance of the transgenic plants and the reference don't show any difference. If $p<0.05$ and risk score mean >0, the transgenic plants showed statistically significant trait enhancement as compared to the reference. If $p<0.2$ and risk score mean >0, the transgenic plants showed a trend of trait enhancement as compared to the reference.

For the second criteria, the RS from each event was evaluated for statistical significance by t-test using SAS statistical software (SAS 9, SAS/STAT User's Guide, SAS Institute Inc, Cary, N.C., USA). The RS with a value greater than 0 indicates that the transgenic plants from this event perform better than the reference. The RS with a value less than 0 indicates that the transgenic plants from this event perform worse than the reference. The RS with a value equal to 0 indicates that the performance of the transgenic plants from this event and the reference don't show any difference. If $p<0.05$ and risk score mean >0, the transgenic plants from this event showed statistically significant trait enhancement as compared to the reference. If $p<0.2$ and risk score mean >0, the transgenic plants showed a trend of trait enhancement as compared to the reference. If two or more events of the transgene of interest showed improvement in the same response, the transgene was deemed to show trait enhancement.

M. Statistic Analysis for Quantitative Responses

A list of responses that were analyzed as quantitative responses illustrated in Table 15.

TABLE 15

| response | screen |
|---|---|
| seed yield | Soil drought stress tolerance screen |
| seedling weight at day 14 | heat stress tolerance screen |
| root length at day 14 | heat stress tolerance screen |
| seedling weight at day 14 | salt stress tolerance screen |
| root length at day 14 | salt stress tolerance screen |
| root length at day 11 | salt stress tolerance screen |
| seedling weight at day 14 | PEG induced osmotic stress tolerance screen |
| root length at day 11 | PEG induced osmotic stress tolerance screen |
| root length at day 14 | PEG induced osmotic stress tolerance screen |
| rosette area at day 8 | cold shock tolerance screen |
| rosette area at day 28 | cold shock tolerance screen |
| difference in rosette area from day 8 to day 28 | cold shock tolerance screen |
| root length at day 28 | cold germination tolerance screen |
| seedling weight at day 23 | Shade tolerance screen |
| petiole length at day 23 | Shade tolerance screen |
| root length at day 14 | Early plant growth and development screen |

TABLE 15-continued

| response | screen |
|---|---|
| Seedling weight at day 14 | Early plant growth and development screen |
| Rosette dry weight at day 53 | Late plant growth and development screen |
| rosette radius at day 25 | Late plant growth and development screen |
| seed dry weight at day 58 | Late plant growth and development screen |
| silique dry weight at day 53 | Late plant growth and development screen |
| silique length at day 40 | Late plant growth and development screen |
| Seedling weight at day 21 | Limited nitrogen tolerance screen |
| Root length at day 21 | Limited nitrogen tolerance screen |

The measurements (M) of each plant were transformed by $\log_2$ calculation. The Delta was calculated as $\log_2 M(\text{transgenic}) - \log_2 M(\text{reference})$. Two criteria were used to determine trait enhancement. A transgene of interest could show trait enhancement according to either or both of the two criteria. The measurements (M) of each plant were transformed by $\log_2$ calculation. The Delta was calculated as $\log_2 M(\text{transgenic}) - \log_2 M(\text{reference})$. If the measured response was Petiole Length for the Low Light assay, Delta was subsequently multiplied by −1, to account for the fact that a shorter petiole length is considered an indication of trait enhancement.

For the first criteria, the Deltas from multiple events of the transgene of interest were evaluated for statistical significance by t-test using SAS statistical software (SAS 9, SAS/STAT User's Guide, SAS Institute Inc, Cary, N.C., USA). Delta with a value greater than 0 indicates that the transgenic plants perform better than the reference. Delta with a value less than 0 indicates that the transgenic plants perform worse than the reference. The Delta with a value equal to 0 indicates that the performance of the transgenic plants and the reference don't show any difference. If $p<0.05$ and risk score mean >0, the transgenic plants showed statistically significant trait enhancement as compared to the reference. If $p<0.2$ and risk score mean >0, the transgenic plants showed a trend of trait enhancement as compared to the reference.

For the second criteria, the delta from each event was evaluated for statistical significance by t-test using SAS statistical software (SAS 9, SAS/STAT User's Guide, SAS Institute Inc, Cary, N.C., USA). The Delta with a value greater than 0 indicates that the transgenic plants from this event perform better than the reference. The Delta with a value less than 0 indicates that the transgenic plants from this event perform worse than the reference. The Delta with a value equal to 0 indicates that the performance of the transgenic plants from this event and the reference don't show any difference. If $p<0.05$ and delta mean >0, the transgenic plants from this event showed statistically significant trait improvement as compared to the reference. If $p<0.2$ and delta mean >0, the transgenic plants showed a trend of trait enhancement as compared to the reference. If two or more events of the transgene of interest showed enhancement in the same response, the transgene was deemed to show trait improvement.

Example 2. Plant Expression Constructs

This example illustrates the construction of plasmids for transferring recombinant DNA into a plant cell nucleus that can be regenerated into transgenic plants.

Plant Expression Constructs for Corn Transformation

A base corn transformation vector pMON93039, as set forth in SEQ ID NO: 94614, illustrated in Table 16 and FIG. 1, is made for use in preparing recombinant DNA for *Agrobacterium*-mediated transformation into corn tissue.

TABLE 16

| Function | Name | Annotation | Coordinates of SEQ ID NO: 94614 |
|---|---|---|---|
| *Agrobacterium* T-DNA transfer | B-AGRtu.right border | Agro right border sequence, essential for transfer of T-DNA. | 11364-11720 |
| Gene of interest expression cassette | E-Os.Act1 | Upstream promoter region of the rice actin 1 gene | 19-775 |
| | E-CaMV.35S.2xA1-B3 | Duplicated35S A1-B3 domain without TATA box | 788-1120 |
| | P-Os.Act1 | Promoter region of the rice actin 1 gene | 1125-1204 |
| | L-Ta.Lhcb1 | 5' untranslated leader of wheat major chlorophyll a/b binding protein | 1210-1270 |
| | I-Os.Act1 | First intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | First exon of the rice actin 1 gene | 3671-3750 |
| | I-Os.Act1 | First intron and flanking UTR exon sequences from the rice actin 1 gene | 3751-4228 |
| | TS-At.ShkG-CTP2 | Transit peptide region of *Arabidopsis* EPSPS | 4238-4465 |
| | CR-AGRtu.aroA-CP4.nat | Coding region for bacterial strain CP4 native aroA gene. | 4466-5833 |
| | T-AGRtu.nos | A 3' non-translated region of the nopaline synthase gene of *Agrobacterium tumefaciens* Ti plasmid which functions to direct polyadenylation of the mRNA. | 5849-6101 |
| *Agrobacterium* T-DNA transfer | B-AGRtu.left border | Agro left border sequence, essential for transfer of T-DNA. | 6168-6609 |
| Maintenance in *E. coli* | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the *E. coli* plasmid ColE1. | 9220-9808 |
| | P-Ec.aadA-SPC/STR | Promoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |
| | T-Ec.aadA-SPC/STR | 3' UTR from the Tn7 adenylyltransferase (AAD(3")) gene of *E. coli*. | 11170-11227 |

Primers for PCR amplification of protein coding nucleotides of recombinant DNA are designed at or near the start and stop codons of the coding sequence in order to eliminate most of the 5' and 3' untranslated regions. Each recombinant DNA coding for or suppressing a protein identified in Table 2 is amplified by PCR prior to insertion into the insertion site within the gene of interest expression cassette of the base vector.

B. Plant Expression Constructs for Soy and Canola Transformation

Vectors for use in transformation of soybean and canola can also be prepared. Elements of an exemplary common expression vector pMON82053 (SEQ ID NO: 94615) are shown in Table 17 below and FIG. 2.

TABLE 17

| Function | Name | Annotation | Coordinates of SEQ ID NO: 94615 |
|---|---|---|---|
| *Agrobacterium* T-DNA transfer | B-AGRtu.left border | Agro left border sequence, essential for transfer of T-DNA. | 6144-6585 |
| Plant selectable marker expression cassette | P-At.Act7 | Promoter from the *Arabidopsis* actin 7 gene | 6624-7861 |
| | L-At.Act7 | 5'UTR of *Arabidopsis* Act7 gene | |
| | I-At.Act7 | Intron from the *Arabidopsis* actin7 gene | |
| | TS-At.ShkG-CTP2 | Transit peptide region of *Arabidopsis* EPSPS | 7864-8091 |
| | CR-AGRtu.aroA-CP4.nno_At | Synthetic CP4 coding region with dicot preferred codon usage. | 8092-9459 |
| | T-AGRtu.nos | A 3' non-translated region of the nopaline synthase gene of *Agrobacterium tumefaciens* Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton. | 688-1002 |
| *Agrobacterium* T-DNA transfer | B-AGRtu.right border | Agro right border sequence, essential for transfer of T-DNA. | 1033-1389 |
| Maintenance in *E. coli* | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the *E. coli* plasmid ColE1. | 2945-3533 |
| | P-Ec.aadA-SPC/STR | Promoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of *E. coli*. | 1526-1583 |

Primers for PCR amplification of protein coding nucleotides of recombinant DNA are designed at or near the start and stop codons of the coding sequence in order to eliminate most of the 5' and 3' untranslated regions. Each recombinant DNA coding for or suppressing a protein identified in Table 2 is amplified by PCR prior to insertion into the insertion site within the gene of interest expression cassette of the base vector.

C. Cotton Transformation Vector

Plasmids for use in transformation of cotton tissue are prepared with elements of expression vector pMON99053 (SEQ ID NO: 94616) are shown in Table 18 below and FIG. 3. Primers for PCR amplification of protein coding nucleotides of recombinant DNA are designed at or near the start and stop codons of the coding sequence in order to eliminate most of the 5' and 3' untranslated regions. Each recombinant DNA coding for or suppressing a protein identified in Table 2 is amplified by PCR prior to insertion into the insertion site within the gene of interest expression cassette of the base vector.

TABLE 18

| Function | Name | Annotation | Coordinates of SEQ ID NO: 94616 |
|---|---|---|---|
| *Agrobacterium* T-DNA transfer | B-AGRtu.right border | Agro right border sequence, essential for transfer of T-DNA. | 1-357 |

TABLE 18-continued

| Function | Name | Annotation | Coordinates of SEQ ID NO: 94616 |
|---|---|---|---|
| Gene of interest expression cassette | Exp-CaMV.35S-enh + Ph.DnaK | Enhanced version of the 35S RNA promoter from CaMV plus the *petunia* hsp70 5' untranslated region | 388-1091 |
| | T-Ps.RbcS2-E9 | The 3' non-translated region of the pea RbcS2 gene which functions to direct polyadenylation of the mRNA. | 1165-1797 |
| Plant selectable marker expression cassette | Exp-CaMV.35S | Promoter and 5' untranslated region from the 35S RNA of CaMV | 1828-2151 |
| | CR-Ec.nptII-Tn5 | Coding region for neomycin phosphotransferase gene from transposon Tn5 which confers resistance to neomycin and kanamycin. | 2185-2979 |
| | T-AGRtu.nos | A 3' non-translated region of the nopaline synthase gene of *Agrobacterium tumefaciens* Ti plasmid which functions to direct polyadenylation of the mRNA. | 3011-3263 |
| *Agrobacterium* T-DNA transfer | B-AGRtu.left border | Agro left border sequence, essential for transfer of T-DNA. | 3309-3750 |
| Maintenance in *E. coli* | OR-Ec.oriV-RK2 | The vegetative origin of replication from plasmid RK2. | 3837-4233 |
| | CR-Ec.rop | Coding region for repressor of primer from the ColE1 plasmid. Expression of this gene product interferes with primer binding at the origin of replication, keeping plasmid copy number low. | 5742-5933 |
| | OR-Ec.ori-ColE1 | The minimal origin of replication from the *E. coli* plasmid ColE1. | 6363-6949 |
| | P-Ec.aadA-SPC/STR | Promoter for Tn7 adenylyltransferase (AAD(3")) | 7480-7521 |
| | CR-Ec.aadA-SPC/STR | Coding region for Tn7 adenylyltransferase (AAD(3")) conferring spectinomycin and streptomycin resistance. | 7522-8310 |
| | T-Ec.aadA-SPC/STR | 3' UTR from the Tn7 adenylyltransferase (AAD(3")) gene of *E. coli*. | 8311-8368 |

Example 3. Corn Transformation

This example illustrates transformation methods in producing a transgenic nucleus in a corn plant cell and the plants, seeds and pollen produced from a transgenic cell with such a nucleus having an enhanced trait, e.g. enhanced water use efficiency, enhanced cold tolerance, increased yield, enhanced nitrogen use efficiency, enhanced seed protein and enhanced seed oil. Plasmid vectors are prepared by cloning-DNA identified in Table 2 in the base vector for use in corn transformation of corn tissue.

For *Agrobacterium*-mediated transformation of corn embryo cells corn plants of a readily transformable line are grown in the greenhouse and ears are harvested when the embryos are 1.5 to 2.0 mm in length. Ears are surface sterilized by spraying or soaking the ears in 80% ethanol, followed by air drying. Immature embryos are isolated from individual kernels on surface sterilized ears. Prior to inoculation of maize cells, *Agrobacterium* cells are grown overnight at room temperature. Immature maize embryo cells are inoculated with *Agrobacterium* shortly after excision, and incubated at room temperature with *Agrobacterium* for 5-20 minutes. Immature embryo plant cells are then co-cultured with *Agrobacterium* for 1 to 3 days at 23° C. in the dark. Co-cultured embryos are transferred to selection media and cultured for approximately two weeks to allow embryogenic callus to develop. Embryogenic callus is transferred to culture medium containing 100 mg/L paromomycin and subcultured at about two week intervals. Transformed plant cells are recovered 6 to 8 weeks after initiation of selection.

For *Agrobacterium*-mediated transformation of maize callus immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media. Paromomycin resistant calli are identified about 6-8 weeks after initiation of selection.

For transformation by microprojectile bombardment maize immature embryos are isolated and cultured 3-4 clays prior to bombardment. Prior to microprojectile bombardment, a suspension of gold particles is prepared onto which the desired recombinant DNA expression cassettes are precipitated. DNA is introduced into maize cells as described in U.S. Pat. Nos. 5,550,318 and 6,399,861 using the electric discharge particle acceleration gene delivery device. Following microprojectile bombardment, tissue is cultured in the dark at 27° C. Additional transformation methods and materials for making transgenic plants of this invention, for example, various media and recipient target cells, transformation of immature embryos and subsequence regeneration of fertile transgenic plants are disclosed in U.S. Pat. Nos. 6,194,636, 6,232,526 and 7,151,204, which are incorporated herein by reference.

To regenerate transgenic corn plants a callus of transgenic plant cells resulting from transformation and selection is placed on media to initiate shoot development into plantlets which are transferred to potting soil for initial growth in a growth chamber at 26° C. followed by a mist bench before transplanting to 5 inch pots where plants are grown to maturity. The regenerated plants are self-fertilized and seed is harvested for use in one or more methods to select seeds, seedlings or progeny second generation transgenic plants (R2 plants) or hybrids, e.g. by selecting transgenic plants exhibiting an enhanced trait as compared to a control plant.

Transgenic corn plant cells are transformed with recombinant DNA from each of the genes identified in Table 2. Progeny transgenic plants and seed of the transformed plant cells are screened for enhanced water use efficiency, enhanced cold tolerance, increased yield, enhanced nitrogen use efficiency, enhanced seed protein and enhanced seed oil as obtained in Example 7.

Example 4. Soybean Transformation

This example illustrates plant transformation in producing the transgenic soybean plants of this invention and the production and identification of transgenic seed for transgenic soybean having enhanced water use efficiency, enhanced cold tolerance, increased yield, enhanced nitrogen use efficiency, enhanced seed protein and enhanced seed oil.

For *Agrobacterium* mediated transformation, soybean seeds are imbided overnight and the meristem explants excised. The explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed imbibition, and wounded using sonication. Following wounding, explants are placed in co-culture for 2-5 days at which point they are transferred to selection media for 6-8 weeks to allow selection and growth of transgenic shoots. Resistant shoots are harvested approximately 6-8 weeks and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil. Additionally, a DNA construct can be transferred into the genome of a soybean cell by particle bombardment and the cell regenerated into a fertile soybean plant as described in U.S. Pat. No. 5,015,580, herein incorporated by reference.

Transgenic soybean plant cells are transformed with recombinant DNA from each of the genes identified in Table 2. Transgenic progeny plants and seed of the transformed plant cells are screened for enhanced water use efficiency, enhanced cold tolerance, increased yield, enhanced nitrogen use efficiency, enhanced seed protein and enhanced seed oil as obtained in Example 10.

Example 5. Cotton Transgenic Plants with Enhanced Agronomic Traits

Cotton transformation is performed as generally described in WO0036911 and in U.S. Pat. No. 5,846,797. Transgenic cotton plants containing each recombinant DNA having a sequence of SEQ ID NO: 1 through SEQ ID NO: 803 are obtained by transforming with recombinant DNA from each of the genes identified in Table 2. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, e.g. cotton variety ST474, cotton variety FM 95S, and cotton variety Siokra L-23, are used to compare the relative performance of the transgenic cotton plants containing the recombinant DNA. The specified culture conditions are growing a first set of transgenic and control plants under "wet" conditions, e.g. irrigated in the range of 85 to 100 percent of evapotranspiration to provide leaf water potential of −14 to −15 bars, and growing a second set of transgenic and control plants under "dry" conditions, e.g. irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 6. Canola Transformation

This example illustrates plant transformation in producing the transgenic canola plants of this invention and the production and identification of transgenic seed for transgenic canola having enhanced water use efficiency, enhanced cold tolerance, increased yield, enhanced nitrogen use efficiency, enhanced seed protein and enhanced seed oil.

Tissues from in vitro grown canola seedlings are prepared and inoculated with overnight-grown *Agrobacterium* cells containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterization is performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 1. Transgenic progeny plants and seed of the transformed plant cells are screened for enhanced water use efficiency, enhanced cold tolerance, increased yield, enhanced nitrogen use efficiency, enhanced seed protein and enhanced seed oil as obtained in Example 7.

Example 7. Identification of Homologs

This example illustrates the identification of homologs of proteins encoded by the DNA identified in Table 1 which is used to provide transgenic seed and plants having enhanced agronomic traits. From the sequence of the homologs, homologous DNA sequence can be identified for preparing additional transgenic seeds and plants of this invention with enhanced agronomic traits.

An "All Protein Database" is constructed of known protein sequences using a proprietary sequence database and the National Center for Biotechnology Information (NCBI) non-redundant amino acid database (nr.aa). For each organism from Which a polynucleotide sequence provided herein was obtained, an "Organism Protein Database" is constructed of known protein sequences of the organism; it is a subset of the All Protein Database based on the NCBI taxonomy ID for the organism.

The All Protein Database is queried using amino acid sequences provided herein as SEQ ID NO: 804 through SEQ ID NO: 1606 using NCBI "blastp" program with E-value cutoff of 1e-8. Up to 1000 top hits are kept, and separated by organism names. For each organism other than that of the query sequence, a list is kept for hits from the query organism itself with a more significant E-value than the best hit of the organism. The list contains likely duplicated genes of the polynucleotides provided herein, and is referred to as the Core List. Another list is kept for all the hits from each organism, sorted by E-value, and referred to as the Hit List.

The Organism Protein Database is queried using polypeptide sequences provided herein as SEQ ID NO: 804 through SEQ ID NO: 1606 using NCBI "blastp" program with E-value cutoff of $1e^{-4}$. Up to 1000 top hits are kept. A BLAST searchable database is constructed based on these hits, and is referred to as "SubDB". SubDB is queried with each sequence in the Hit List using NCBI "blastp" program with E-value cutoff of $1e^{-8}$. The hit with the best E-value is compared with the Core List from the corresponding organism. The hit is deemed a likely ortholog if it belongs to the Core List, otherwise it is deemed not a likely ortholog and there is no further search of sequences in the Hit List for the same organism. Likely orthologs from a large number of distinct organisms were identified and are reported by amino acid sequences of SEQ ID NO: 1607 to SEQ ID NO: 94613. These orthologs are reported in Tables 19 as homologs to the proteins cognate to genes used in trait-improving recombinant DNA Example 8. Consensus Sequence Build ClustalW program is selected for multiple sequence alignments of an amino acid sequence of SEQ ID NO: 804 and its homologs, through SEQ ID NO: 1606 and its homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. The consensus sequence of SEQ ID NO: 1325 and its 30 homologs were derived according to the procedure described above and is displayed in FIG. 4.

Example 9. Pfam Module Annotation

This example illustrates the identification of domain and domain module by Pfam analysis.

The amino acid sequence of the expressed proteins that were shown to be associated with an enhanced trait were analyzed for Pfam protein family against the current Pfam collection of multiple sequence alignments and hidden Markov models using the HMMER software in the appended computer listing. The Pfam domain modules and individual protein domain for the proteins of SEQ ID NO: 804 through 1606 are shown in Table 20 and Table 21 respectively. The Hidden Markov model databases for the identified patent families are also in the appended computer listing allowing identification of other homologous proteins and their cognate encoding DNA to enable the full breadth of the invention for a person of ordinary skill in the art. Certain proteins are identified by a single Pfam domain and others by multiple Pfam domains. For instance, the protein with amino acids of SEQ ID NO: 830 is characterized by two Pfam domains, e.g. "Lectin_legB" and "Pkinase". See also the protein with amino acids of SEQ ID NO: 817 which is characterized by four copies of the Pfam domain "Arm". In Table 21 "score" is the gathering score for the Hidden Markov Model of the domain which exceeds the gathering cutoff reported in Table 22.

TABLE 20

| PEP Seq ID No. | Construct ID | Pfam module | Position |
| --- | --- | --- | --- |
| 804 | CGPG10.pep | p450 | 31-495 |
| 805 | CGPG1008.pep | Tryp_alpha_amyl | 23-95 |
| 806 | CGPG1023.pep | Na_Ca_ex::Na_Ca_ex | 104-255::299-432 |
| 807 | CGPG1038.pep | DUF1475 | 1-256 |
| 812 | CGPG1113.pep | DUF1350 | 49-370 |

TABLE 20-continued

| PEP Seq ID No. | Construct ID | Pfam module | Position |
|---|---|---|---|
| 814 | CGPG1163.pep | DSPc | 49-182 |
| 817 | CGPG1205.pep | Arm::Arm::Arm::Arm | 94-134::135-175::176-216::258-298 |
| 818 | CGPG1207.pep | NifU_N | 26-105 |
| 820 | CGPG1223.pep | ATP_bind_1 | 7-250 |
| 821 | CGPG1250.pep | DUF822 | 12-160 |
| 824 | CGPG1319.pep | DUF599 | 10-233 |
| 826 | CGPG1329.pep | Cullin | 29-631 |
| 827 | CGPG133.pep | Cyclin_N::Cyclin_C | 168-293::295-422 |
| 828 | CGPG1332.pep | Cullin | 12-646 |
| 829 | CGPG1343.pep | LRR_1 | 389-412 |
| 830 | CGPG1348.pep | Lectin_legB::Pkinase | 27-248::334-604 |
| 831 | CGPG1349.pep | B_lectin::S_locus_glycop::PAN_1::Pkinase | 65-171::180-312::327-404::484-731 |
| 832 | CGPG1373.pep | Pkinase | 12-291 |
| 833 | CGPG1377.pep | Pkinase | 4-258 |
| 834 | CGPG1412.pep | TPP_enzyme_N::TPP_enzyme_M::TPP_enzyme_C | 45-221::243-376::431-578 |
| 835 | CGPG1421.pep | Biotin_lipoyl::E3_binding::2-oxoacid_dh | 76-149::180-218::249-480 |
| 836 | CGPG1426.pep | Aminotran_1_2 | 48-432 |
| 837 | CGPG1433.pep | Pyr_redox_2::Pyr_redox_dim | 45-359::388-497 |
| 838 | CGPG1453.pep | malic::Malic_M | 171-360::362-615 |
| 839 | CGPG1454.pep | Ribul_P_3_epim | 7-207 |
| 840 | CGPG1463.pep | Alpha-amylase::Alpha-amyl_C2 | 26-361::362-422 |
| 841 | CGPG1464.pep | Glycolytic | 11-358 |
| 842 | CGPG1471.pep | IF4E | 1-198 |
| 843 | CGPG1481.pep | Pkinase | 4-260 |
| 844 | CGPG1499.pep | PPDK_N::PEP-utilizers::PEP-utilizers_C | 85-445::496-586::598-955 |
| 845 | CGPG150.pep | p450 | 30-507 |
| 846 | CGPG1536.pep | CRAL_TRIO_N::CRAL_TRIO | 73-142::159-345 |
| 847 | CGPG1539.pep | UPF0139 | 8-107 |
| 848 | CGPG155.pep | GlutR_N::Shikimate_DH::GlutR_dimer | 100-251::255-407::420-526 |
| 849 | CGPG1583.pep | PLAC8 | 88-187 |
| 850 | CGPG1588.pep | PLAC8 | 75-214 |
| 851 | CGPG16.pep | MIP | 14-235 |
| 852 | CGPG1609.pep | MMR_HSR1::DUF933 | 54-190::337-420 |
| 853 | CGPG1629.pep | WD40::WD40::WD40 | 262-301::307-346::356-395 |
| 854 | CGPG1637.pep | DUF220 | 163-262 |
| 855 | CGPG1653.pep | TBC | 200-415 |
| 856 | CGPG1658pep | Nodulin-like | 14-260 |
| 857 | CGPG1663.pep | BT1 | 30-441 |
| 858 | CGPG1682.pep | OPT | 62-685 |
| 859 | CGPG1701.pep | Glyco_transf_8 | 76-299 |
| 861 | CGPG1724.pep | Per1 | 63-334 |
| 862 | CGPG1726.pep | DUF607 | 111-291 |
| 863 | CGPG1736.pep | Usp | 1-148 |
| 864 | CGPG1741.pep | mTERF | 279-627 |
| 865 | CGPG1783.pep | PB1 | 42-132 |
| 866 | CGPG1790.pep | PB1 | 59-153 |
| 868 | CGPG1845.pep | TFIID-18 kDa | 29-119 |
| 869 | CGPG1855.pep | CAF1 | 3-227 |
| 870 | CGPG1870.pep | Pkinase | 406-572 |
| 871 | CGPG1879.pep | Pkinase::NAF | 21-277::303-364 |
| 872 | CGPG1886.pep | Pkinase | 26-325 |
| 873 | CGPG1903.pep | F-box | 320-367 |
| 874 | CGPG1905.pep | F-box::Kelch_2::Kelch_2 | 4-51::104-150::255-306 |
| 875 | CGPG1914.pep | F-box::Kelch_1::Kelch_1 | 42-89::170-215::217-266 |
| 876 | CGPG193.pep | WD40::WD40::WD40::WD40 | 167-205::268-307::318-355::363-401 |
| 877 | CGPG1939.pep | F-box::WD40::WD40::WD40 | 66-113::152-190::247-283::325-364 |
| 878 | CGPG1949.pep | YDG_SRA::Pre-SET::SET | 360-519::543-639::641-771 |
| 879 | CGPG1959.pep | PHD::SET | 34-82::208-344 |
| 880 | CGPG197.pep | p450 | 40-481 |
| 882 | CGPG1981.pep | MT-A70 | 476-636 |
| 883 | CGPG1999.pep | Nfu_N::NifU | 78-193::221-291 |
| 884 | CGPG2.pep | p450 | 71-531 |

TABLE 20-continued

| PEP Seq ID No. | Construct ID | Pfam module | Position |
|---|---|---|---|
| 885 | CGPG2006.pep | RCC1::RCC1::RCC1::RCC1 | 32-82::138-187::190-239::294-343 |
| 886 | CGPG2010.pep | Aminotran_5 | 74-448 |
| 887 | CGPG2011.pep | X8 | 128-209 |
| 888 | CGPG2014.pep | Pkinase::NAF | 28-282::341-398 |
| 889 | CGPG2023.pep | Zip | 48-352 |
| 890 | CGPG2026.pep | Pkinase | 38-324 |
| 892 | CGPG2064.pep | Cenp-O | 123-201 |
| 894 | CGPG2077.pep | NAC::UBA | 88-147::195-232 |
| 895 | CGPG2095.pep | AARP2CN::DUF663 | 228-309::483-780 |
| 896 | CGPG2105.pep | Pkinase::Pkinase_C | 102-404::422-471 |
| 897 | CGPG2108.pep | Response_reg::CCT | 64-180::442-484 |
| 898 | CGPG2111.pep | polyprenyl_synt | 74-324 |
| 899 | CGPG2124.pep | UIM::efhand | 139-156::220-248 |
| 900 | CGPG2125.pep | Glutaredoxin | 44-110 |
| 903 | CGPG2134.pep | ATP-synt_G | 8-122 |
| 904 | CGPG2139.pep | DUF1517 | 94-391 |
| 905 | CGPG2140.pep | PhzC-PhzF | 6-282 |
| 907 | CGPG2163.pep | Cupin_1::Cupin_1 | 5-157::190-339 |
| 908 | CGPG2165.pep | ClpS | 76-152 |
| 910 | CGPG2218.pep | Spc97_Spc98 | 67-555 |
| 912 | CGPG2225.pep | EMP24_GP25L | 52-116 |
| 913 | CGPG2229.pep | Subtilisin_N::PA | 30-106::362-461 |
| 915 | CGPG2254.pep | Ribosomal_L7Ae | 20-114 |
| 916 | CGPG2268.pep | CBS | 66-188 |
| 917 | CGPG227.pep | p450 | 37-494 |
| 918 | CGPG2312.pep | UPF0061 | 75-571 |
| 919 | CGPG2315.pep | SIP1 | 286-514 |
| 920 | CGPG2316.pep | PTPA | 98-396 |
| 922 | CGPG235.pep | p450 | 74-510 |
| 923 | CGPG2358 pep | Branch | 54-278 |
| 925 | CGPG2361.pep | Metallophos | 9-231 |
| 926 | CGPG2365.pep | Epimerase | 3-211 |
| 927 | CGPG2372.pep | Pribosyltran | 29-169 |
| 928 | CGPG2374.pep | Aminotran_5 | 8-370 |
| 929 | CGPG2377.pep | DAO | 69-466 |
| 930 | CGPG2387.pep | H_PPase | 1-239 |
| 931 | CGPG2389.pep | Carb_anhydrase | 52-275 |
| 932 | CGPG2395.pep | AA_permease | 89-526 |
| 934 | CGPG2409.pep | DUF862 | 17-154 |
| 935 | CGPG2410.pep | GST_N::GST_C | 5-79::101-204 |
| 937 | CGPG2416.pep | Hin1 | 97-235 |
| 938 | CGPG2441.pep | Sina | 5-205 |
| 939 | CGPG2450.pep | Epimerase | 114-371 |
| 940 | CGPG2451.pep | RALF | 57-129 |
| 941 | CGPG2492.pep | Pribosyltran | 80-216 |
| 942 | CGPG2495.pep | ADH_N::ADH_zinc_N | 25-134::165-307 |
| 943 | CGPG2506.pep | PfkB | 5-289 |
| 944 | CGPG2515.pep | TIM | 5-244 |
| 945 | CGPG2531.pep | AhpC-TSA | 5-138 |
| 946 | CGPG2581.pep | SelR | 12-133 |
| 947 | CGPG2584.pep | zf-Tim10_DDP | 22-86 |
| 948 | CGPG2592.pep | TFIID_30 kDa | 30-80 |
| 949 | CGPG2612.pep | RRM_1::RRM_1::RRM_1 | 65-132::150-225::275-343 |
| 950 | CGPG2660.pep | B3::B3 | 17-115::211-301 |
| 951 | CGPG2663.pep | NTF2::RRM_1 | 15-131::295-365 |
| 952 | CGPG2679.pep | ACBP::Ank::Ank | 104-190::265-297::298-330 |
| 953 | CGPG2696.pep | zf-C3HC4 | 177-218 |
| 954 | CGPG2772.pep | Mov34 | 6-136 |
| 955 | CGPG2773.pep | Asp | 161-498 |
| 956 | CGPG281.pep | TLC | 91-574 |
| 957 | CGPG2846.pep | Aldo_ket_red | 49-365 |
| 958 | CGPG2852.pep | Glyoxalase | 9-132 |
| 960 | CGPG2870.pep | zf-CCCH::zf-CCCH::zf-CCCH::zf-CCCH::zf-CCCH | 111-137::159-185::205-231::347-373::393-419 |
| 961 | CGPG2877.pep | LAG1 | 96-307 |
| 962 | CGPG289.pep | Cellulose_synt | 243-1060 |
| 963 | CGPG2924.pep | zf-C3HC4 | 138-179 |
| 964 | CGPG2947.pep | Acetyltransf_1::Bromodomain | 265-343::460-548 |
| 965 | CGPG2963.pep | C1_2::C1_3::C1_3::C1_2::C1_3::C1_3::C1_2 | 81-108::136-164::194-223::305-335::391-420::494-522::552-581 |
| 966 | CGPG2987.pep | SRF-TF | Nov-66 |

TABLE 20-continued

| PEP Seq ID No. | Construct ID | Pfam module | Position |
|---|---|---|---|
| 968 | CGPG3045.pep | Pkinase_Tyr | 82-356 |
| 969 | CGPG3046.pep | AAA | 121-305 |
| 970 | CGPG3060.pep | p450 | 67-528 |
| 971 | CGPG3075.pep | Auxin_inducible | 7-106 |
| 972 | CGPG310.pep | Cyclin_N | 18-143 |
| 973 | CGPG3103.pep | PPR::PPR::PPR::PPR::PPR::PPR::PPR::PPR::PPR::PPR::PPR | 14-48::49-83::84-118::119-153::155-188::189-223::224-258::259-293::295-329::330-364::365-398 |
| 974 | CGPG315.pep | p450 | 29-491 |
| 976 | CGPG3189.pep | RRM_1::RRM_1 | 115-186::209-280 |
| 977 | CGPG3204.pep | KH_1::KH_1::KH_1::KH_1::KH_1 | 45-104::151-221::318-381::400-467::575-637 |
| 978 | CGPG3208.pep | MATH::MATH | 26-153::180-302 |
| 979 | CGPG3219.pep | 2OG-FeII_Oxy | 220-320 |
| 980 | CGPG3233.pep | PPR::PPR::PPR::PPR::PPR::PPR::PPR::PPR | 160-194::195-229::231-265::266-300::301-335::336-370::371-405::406-440 |
| 981 | CGPG3263.pep | Tryp_alpha_amyl | 28-104 |
| 982 | CGPG3276.pep | ECH | 11-186 |
| 984 | CGPG3282.pep | Steroid_dh | 117-268 |
| 985 | CGPG3300.pep | zf-CCHC::zf-CCHC::zf-CCHC::zf-CCHC::zf-CCHC::zf-CCHC::zf-CCHC | 55-72::74-91::93-110::112-129::138-155::157-174::229-246 |
| 986 | CGPG3318.pep | Peptidase_C14 | 3-416 |
| 987 | CGPG3319.pep | AP2 | 28-79 |
| 988 | CGPG3326.pep | zf-C3HC4 | 259-299 |
| 989 | CGPG333.pep | PTS_2-RNA | 48-239 |
| 990 | CGPG3338.pep | Alba | 17-87 |
| 991 | CGPG334.pep | Mov34 | 20-128 |
| 992 | CGPG3374.pep | peroxidase | 42-286 |
| 993 | CGPG3402.pep | Dimerisation::Methyltransf_2 | 30-89::99-342 |
| 995 | CGPG3413.pep | WD40::U3_snoRNA_C | 168-207::377-523 |
| 996 | CGPG3422.pep | WD40::WD40::WD40 | 241-279::387-425::519-559 |
| 997 | CGPG3436.pep | DUF6::DUF6 | 17-144::198-327 |
| 998 | CGPG3539.pep | Mito_carr::Mito_carr::Mito_carr | 11-105::113-209::214-303 |
| 999 | CGPG3550.pep | FAE1_CUT1_RppA::ACP_syn_III_C | 81-370::384-468 |
| 1000 | CGPG3551.pep | Pkinase | 9-273 |
| 1001 | CGPG3552.pep | Aldedh | 23-441 |
| 1002 | CGPG3572.pep | FA_hydroxylase | 112-225 |
| 1004 | CGPG3599.pep | DUF579 | 51-289 |
| 1008 | CGPG364.pep | zf-C3HC4 | 97-137 |
| 1010 | CGPG3679.pep | malic::Malic_M::PTA_PTB | 36-179::181-418::446-768 |
| 1011 | CGPG3686.pep | Gp_dh_N::Gp_dh_C | 2-150::155-312 |
| 1012 | CGPG3694.pep | LRRNT_2::LRR_1::LRR_1::LRR_1::LRR_1::Pkinase_Tyr | 38-78::106-128::130-152::154-176::178-201::312-583 |
| 1013 | CGPG3696.pep | MMR_HSR1 | 136-257 |
| 1014 | CGPG3698.pep | WD40::WD40 | 104-142::234-272 |
| 1015 | CGPG3699.pep | adh_short | 19-187 |
| 1016 | CGPG3702.pep | SAM_1 | 228-291 |
| 1017 | CGPG3703.pep | ENOD93 | 25-103 |
| 1018 | CGPG3707.pep | Pkinase | 42-333 |
| 1019 | CGPG3710.pep | VQ | 118-148 |
| 1020 | CGPG3730.pep | DUF167 | 140-216 |
| 1021 | CGPG3731.pep | DUF616 | 194-508 |
| 1022 | CGPG3734.pep | PRK::Pribosyltran | 46-233::280-425 |
| 1023 | CGPG3745.pep | RRM_1::RRM_1 | 386-455::481-553 |
| 1024 | CGPG3764.pep | Response_reg | 20-145 |
| 1026 | CGPG3851.pep | SH3_1 | 284-338 |
| 1027 | CGPG3911.pep | Aldedh | 104-587 |
| 1028 | CGPG3948.pep | NAP | 50-295 |
| 1031 | CGPG3996.pep | Inositol_P | 6-267 |
| 1032 | CGPG4006.pep | ENT | 1-74 |
| 1033 | CGPG4025.pep | SQS_PSY | 44-331 |
| 1034 | CGPG4028.pep | Transket_pyr::Transketolase_C | 398-565::579-702 |
| 1035 | CGPG403.pep | Pkinase | 78-336 |
| 1036 | CGPG4041.pep | DEAD::Helicase_C | 141-315::386-462 |

TABLE 20-continued

| PEP Seq ID No. | Construct ID | Pfam module | Position |
|---|---|---|---|
| 1037 | CGPG4078.pep | GST_C | 180-283 |
| 1038 | CGPG4079.pep | RRS1 | 1-178 |
| 1041 | CGPG4104.pep | LRRNT_2::LRR_1::LRR_1::LRR_1::LRR_1::Pkinase | 30-67::95-117::119-141::143-165::167-188::367-633 |
| 1042 | CGPG4127.pep | Hydrolase | 43-239 |
| 1043 | CGPG4135.pep | Pkinase::efhand::efhand::efhand::efhand | 118-376::423-451::459-487::495-523::529-557 |
| 1044 | CGPG4161.pep | Methyltransf_11 | 56-159 |
| 1045 | CGPG4180.pep | GHMP_kinases_N::GHMP_kinases_C | 152-219::382-466 |
| 1046 | CGPG4191.pep | Bombesin | 163-176 |
| 1047 | CGPG4199.pep | Copine::zf-C3HC4 | 117-265::385-417 |
| 1048 | CGPG4241.pep | GASA | 3-99 |
| 1049 | CGPG427.pep | Pkinase_Tyr | 8-262 |
| 1050 | CGPG4273.pep | dsrm::dsrm | 2-68::88-153 |
| 1051 | CGPG4301.pep | 2OG-FeII_Oxy | 151-253 |
| 1052 | CGPG4303.pep | Rhodanese | 13-114 |
| 1053 | CGPG4313.pep | G6PD_N::G6PD_C | 94-273::276-573 |
| 1054 | CGPG4314.pep | AWPM-19 | 15-156 |
| 1055 | CGPG4329.pep | AA_kinase | 86-324 |
| 1056 | CGPG4330.pep | PALP | 53-341 |
| 1057 | CGPG4338.pep | Proteasome | 21-217 |
| 1058 | CGPG4341.pep | Mito_carr::Mito_carr::Mito_carr | 51-134::158-246::252-343 |
| 1061 | CGPG4386.pep | GHMP_kinases_N::GHMP_kinases_C | 113-171::245-338 |
| 1062 | CGPG4394.pep | p450 | 39-503 |
| 1063 | CGPG4396.pep | p450 | 39-504 |
| 1064 | CGPG4400.pep | p450 | 32-474 |
| 1065 | CGPG4401.pep | p450 | 47-51 |
| 1066 | CGPG441.pep | Chalcone | 14-225 |
| 1067 | CGPG4413.pep | p450 | 32-547 |
| 1068 | CGPG4427.pep | p450 | 57-530 |
| 1069 | CGPG4446.pep | p450 | 43-504 |
| 1070 | CGPG4448.pep | p450 | 32-486 |
| 1071 | CGPG4474.pep | Band_7 | 33-212 |
| 1072 | CGPG4482.pep | peroxidase | 47-291 |
| 1073 | CGPG4511.pep | VHS::GAT | 36-166::227-315 |
| 1074 | CGPG4517.pep | Aldo_ket_red | 5-292 |
| 1075 | CGPG4551.pep | XS::XH | 30-148::418-557 |
| 1077 | CGPG4567.pep | SRF-TF | 3-53 |
| 1078 | CGPG4586.pep | RRM_1 | 8-73 |
| 1079 | CGPG4600.pep | zf-CCCH::zf-CCCH | 13-39::149-174 |
| 1080 | CGPG4631.pep | C1_2::C1_2::C1_3::C1_2::C1_3::C1_2 | 88-115::209-237::264-292::319-349::404-433::566-595 |
| 1081 | CGPG4642.pep | Pyridoxal_deC | 63-412 |
| 1082 | CGPG4645.pep | Cu-oxidase_3::Cu-oxidase::Cu-oxidase_2 | 31-148::157-325::414-551 |
| 1083 | CGPG4646.pep | efhand_like::PI-PLC-X::PI-PLC-Y::C2 | 27-105::108-251::332-450::471-563 |
| 1084 | CGPG4649.pep | SMP::SMP::SMP | 14-72::130-191::195-256 |
| 1085 | CGPG4653.pep | DUF1637 | 47-280 |
| 1087 | CGPG4668.pep | SYF2 | 140-306 |
| 1088 | CGPG469.pep | tRNA-synt_1c::tRNA-synt_1c_C | 213-518::520-697 |
| 1089 | CGPG4708.pep | Sulfate_transp::STAS | 172-482::505-623 |
| 1090 | CGPG4712.pep | Mem_trans | 9-565 |
| 1091 | CGPG4714.pep | DUF231 | 248-423 |
| 1092 | CGPG4719.pep | Response_reg::CCT | 37-153::417-461 |
| 1093 | CGPG473.pep | Peptidase_M16::Peptidase_M16_C | 88-234::239-423 |
| 1094 | CGPG4734.pep | Auxin_inducible | 19-119 |
| 1095 | CGPG4736.pep | Pribosyltran | 225-358 |
| 1096 | CGPG474.pep | Pro_isomerase | 6-172 |
| 1102 | CGPG4850.pep | PMEI | 25-174 |
| 1103 | CGPG4868.pep | PsbW | 1-133 |
| 1104 | CGPG4871.pep | Tryp_alpha_amyl | 52-133 |
| 1105 | CGPG488.pep | Histone | 19-92 |
| 1106 | CGPG4908.pep | WD40::WD40 | 16-54::63-101 |
| 1108 | CGPG4921.pep | WD40::WD40::WD40::WD40::WD40 | 202-241::253-291::295-333::337-375::472-510 |
| 1109 | CGPG4954.pep | LRRNT_2::LRR_1::LRR_1::LRR_1 | 33-72::76-98::100-122::124-145 |

TABLE 20-continued

| PEP Seq ID No. | Construct ID | Pfam module | Position |
|---|---|---|---|
| 1110 | CGPG4956.pep | Asp | 141-482 |
| 1111 | CGPG4959.pep | adh_short | 15-183 |
| 1112 | CGPG4965.pep | zf-A20::zf-AN1 | 15-39::114-154 |
| 1113 | CGPG4970.pep | GASA | 1-108 |
| 1114 | CGPG4980.pep | U-box::Arm::Arm | 73-147::246-287::288-328 |
| 1115 | CGPG4982.pep | F-box::FBA_1 | 2-49::209-387 |
| 1116 | CGPG4985.pep | CPSase_sm_chain::GATase | 56-203::245-422 |
| 1117 | CGPG4990.pep | LRRNT_2::LRR_1::LRR_1::LRR_1::LRR_1::LRR_1 | 73-112::139-161::163-183::187-206::210-232::306-328 |
| 1118 | CGPG4991.pep | PALP | 164-473 |
| 1119 | CGPG5007.pep | adh_short | 21-192 |
| 1120 | CGPG5015.pep | adh_short | 13-126 |
| 1121 | CGPG5026.pep | adh_short | 46-221 |
| 1122 | CGPG5029.pep | adh_short | 80-252 |
| 1123 | CGPG5046.pep | LRRNT_2::LRR_1::LRR_1::LRR_1::Pkinase | 30-70::99-121::123-145::147-169::306-573 |
| 1124 | CGPG508.pep | Na_sulph_symp | 93-563 |
| 1125 | CGPG5103.pep | C2 | 9-95 |
| 1126 | CGPG511.pep | Rho_GDI | 22-222 |
| 1127 | CGPG5121.pep | efhand_like::PI-PLC-X::PI-PLC-Y::C2 | 30-113::116-258::331-449::470-562 |
| 1128 | CGPG5126.pep | peroxidase | 54-303 |
| 1129 | CGPG5136.pep | p450 | 35-500 |
| 1130 | CGPG5146.pep | p450 | 45-501 |
| 1131 | CGPG5149.pep | p450 | 31-478 |
| 1132 | CGPG5181.pep | Pkinase | 278-540 |
| 1133 | CGPG52.pep | Sugar_tr | 32-472 |
| 1134 | CGPG5206.pep | UDPG_MGDP_dh_N::UDPG_MGDP_dh::UDPG_MGDP_dh_C | 2-200::209-306::328-452 |
| 1136 | CGPG5232.pep | Pkinase | 71-328 |
| 1137 | CGPG5239.pep | Copine | 136-284 |
| 1138 | CGPG5246.pep | ABC_tran::ABC_tran | 94-285::406-571 |
| 1139 | CGPG525.pep | CDP-OH_P_transf | 138-277 |
| 1140 | CGPG5268.pep | CDC50 | 65-368 |
| 1141 | CGPG5272.pep | AA_permease | 153-621 |
| 1142 | CGPG5333.pep | MFS_1 | 55-468 |
| 1143 | CGPG5338.pep | RRM_1::RRM_1 | 8-77::108-178 |
| 1144 | CGPG5341.pep | F-box | 33-79 |
| 1145 | CGPG5369.pep | AA_kinase::ACT::ACT | 83-366::400-469::477-539 |
| 1146 | CGPG5372.pep | SBF | 142-322 |
| 1147 | CGPG5380.pep | Tyr-DNA_phospho | 137-581 |
| 1148 | CGPG5386.pep | MOSC_N::MOSC | 4-132::138-296 |
| 1149 | CGPG5396.pep | PALP | 9-297 |
| 1150 | CGPG5397.pep | PDT | 128-307 |
| 1151 | CGPG5421.pep | Pre-SET::SET | 119-267::269-414 |
| 1152 | CGPG5433.pep | MtN3_slv::MtN3_slv | 10-98::132-218 |
| 1153 | CGPG5439.pep | LANC_like | 69-410 |
| 1154 | CGPG5453.pep | Mito_carr::Mito_carr::Mito_carr | 14-116::125-215::233-334 |
| 1155 | CGPG5456.pep | Mito_carr::Mito_carr::Mito_carr | 78-175::183-279::283-373 |
| 1156 | CGPG5483.pep | PP2C | 66-369 |
| 1157 | CGPG5492.pep | FAE1_CUT1_RppA::ACP_syn_III_C | 61-358::372-456 |
| 1158 | CGPG5508.pep | RCC1::RCC1::RCC1::RCC1::FYVE::DZC | 310-359::413-462::478-526::582-630::633-701::967-1002 |
| 1159 | CGPG5520.pep | TFIID-31 kDa | 19-152 |
| 1160 | CGPG5525.pep | PRMT5 | 187-679 |
| 1161 | CGPG5526.pep | Pkinase | 8-295 |
| 1162 | CGPG5530.pep | Response_reg | 504-644 |
| 1163 | CGPG5534.pep | Y_phosphatase2 | 3-169 |
| 1164 | CGPG5537.pep | TBP::TBP | 62-147::152-238 |
| 1165 | CGPG5545.pep | CBS::CBS | 35-175::193-318 |
| 1166 | CGPG555.pep | PALP::Thr_dehydrat_C::Thr_dehydrat_C | 104-396::409-498::504-591 |
| 1167 | CGPG5558.pep | Cyclin_N::Cyclin_C | 212-337::339-458 |
| 1168 | CGPG5559.pep | Suc_Fer-like | 69-311 |
| 1169 | CGPG5562.pep | Suc_Fer-like | 59-308 |
| 1170 | CGPG5592.pep | Rho_GDI | 35-239 |
| 1171 | CGPG5625.pep | LRR_1::LRR_1::Pkinase | 433-455::457-476::586-854 |

TABLE 20-continued

| PEP Seq ID No. | Construct ID | Pfam module | Position |
|---|---|---|---|
| 1172 | CGPG5631.pep | WAK::Pkinase | 171-270::390-658 |
| 1173 | CGPG5632.pep | Aldedh | 29-491 |
| 1174 | CGPG5636.pep | Aldedh | 15-476 |
| 1175 | CGPG5637.pep | Aldedh | 32-493 |
| 1176 | CGPG564.pep | Aminotran_3 | 80-413 |
| 1177 | CGPG5641.pep | Aldedh | 14-472 |
| 1178 | CGPG5650.pep | Aminotran_3 | 32-374 |
| 1179 | CGPG5653.pep | Aminotran_1_2 | 32-383 |
| 1180 | CGPG5657.pep | Aldedh | 15-474 |
| 1181 | CGPG5671.pep | Gp_dh_N::Gp_dh_C | 3-151::156-313 |
| 1182 | CGPG5672.pep | Glutaminase | 24-309 |
| 1183 | CGPG5677.pep | PGAM | 4-165 |
| 1184 | CGPG5678.pep | Aminotran_1_2 | 35-385 |
| 1185 | CGPG5679.pep | TIM | 7-248 |
| 1186 | CGPG5682.pep | Aminotran_3 | 31-384 |
| 1187 | CGPG5691.pep | PK::PK_C | 5-350::362-478 |
| 1188 | CGPG5699.pep | Gp_dh_N::Gp_dh_C | 3-155::160-316 |
| 1189 | CGPG5705.pep | NDK | 3-137 |
| 1190 | CGPG5722.pep | Pyrophosphatase | 17-175 |
| 1191 | CGPG5734.pep | Cyclin_N::Cyclin_C | 232-357::359-478 |
| 1192 | CGPG5736.pep | PP2C | 22-280 |
| 1193 | CGPG5744.pep | CDC50 | 63-365 |
| 1194 | CGPG5747.pep | Pkinase | 23-318 |
| 1195 | CGPG5748.pep | NAD_Gly3P_dh_N::NAD_Gly3P_dh_C | 84-259::282-432 |
| 1198 | CGPG577.pep | Thioredoxin | 7-111 |
| 1199 | CGPG5780.pep | AA_permease | 68-517 |
| 1200 | CGPG5793.pep | AA_permease | 285-815 |
| 1201 | CGPG5795.pep | Sugar_tr | 123-565 |
| 1202 | CGPG5796.pep | Sugar_tr | 43-466 |
| 1203 | CGPG5800.pep | AA_permease | 86-546 |
| 1204 | CGPG5812.pep | Pkinase | 22-273 |
| 1205 | CGPG5815.pep | Pkinase | 9-272 |
| 1206 | CGPG5838.pep | Pkinase | 1-264 |
| 1207 | CGPG5844.pep | Pkinase | 78-351 |
| 1208 | CGPG5846.pep | Pkinase | 99-376 |
| 1209 | CGPG5851.pep | Pkinase | 121-401 |
| 1210 | CGPG5857.pep | Pkinase | 19-273 |
| 1211 | CGPG5862.pep | Pkinase | 181-447 |
| 1212 | CGPG5863.pep | Pkinase | 52-330 |
| 1213 | CGPG5867.pep | Pkinase | 142-423 |
| 1214 | CGPG5872.pep | Pkinase | 18-288 |
| 1215 | CGPG5913.pep | ADH_N::ADH_zinc_N | 28-109::140-284 |
| 1217 | CGPG5961.pep | Biotin_lipoyl::2-oxoacid_dh | 94-167::232-462 |
| 1219 | CGPG5968.pep | Pribosyltran | 36-172 |
| 1220 | CGPG5984.pep | Pkinase | 115-443 |
| 1221 | CGPG5991.pep | LRR_1 | 266-293 |
| 1222 | CGPG6006.pep | RRM_1 | 19-89 |
| 1223 | CGPG6015.pep | La::RRM_1::RRM_3 | 14-85::118-188::302-404 |
| 1224 | CGPG603.pep | G6PD_N::G6PD_C | 35-222::224-508 |
| 1225 | CGPG6046.pep | Str_synth | 179-266 |
| 1226 | CGPG6063.pep | Nramp | 88-451 |
| 1228 | CGPG6092.pep | SRPRB | 53-235 |
| 1229 | CGPG6104.pep | Steroid_dh | 111-262 |
| 1230 | CGPG6106.pep | LEA_5 | 1-92 |
| 1231 | CGPG6111.pep | PP-binding | 48-115 |
| 1232 | CGPG6113.pep | UQ_con | 7-143 |
| 1234 | CGPG6132.pep | SMP::SMP::SMP | 13-71::135-196::200-262 |
| 1236 | CGPG6147.pep | Redoxin | 74-234 |
| 1237 | CGPG6152.pep | Arf | 5-177 |
| 1238 | CGPG6154.pep | Ion_trans_2::Ion_trans_2 | 122-204::253-328 |
| 1239 | CGPG6170.pep | UQ_con | 19-158 |
| 1240 | CGPG6171.pep | Thioredoxin | 120-227 |
| 1241 | CGPG6177.pep | AIG1 | 39-236 |
| 1242 | CGPG6181.pep | Peptidase_C12 | 2-214 |
| 1243 | CGPG6188.pep | Di19 | 10-217 |
| 1244 | CGPG6202.pep | TB2_DP1_HVA22 | 9-106 |
| 1245 | CGPG6217.pep | MFS_1::Sugar_tr | 40-460::90-507 |
| 1246 | CGPG623.pep | SATase_N::Hexapep::Hexapep::Hexapep | 45-149::203-220::229-246::247-264 |
| 1247 | CGPG6239.pep | Sugar_tr | 27-458 |
| 1248 | CGPG6244.pep | Pkinase | 39-303 |
| 1249 | CGPG6254.pep | Pkinase::NAF | 12-264::292-352 |
| 1251 | CGPG627.pep | His_biosynth | 48-289 |
| 1252 | CGPG6271.pep | Pkinase | 191-527 |
| 1253 | CGPG6278.pep | Pkinase | 86-368 |

TABLE 20-continued

| PEP Seq ID No. | Construct ID | Pfam module | Position |
|---|---|---|---|
| 1254 | CGPG6288.pep | Pkinase_Tyr | 207-463 |
| 1255 | CGPG6309.pep | PRA1 | 29-181 |
| 1256 | CGPG633.pep | DCP1 | 12-134 |
| 1257 | CGPG635.pep | Epimerase | 9-273 |
| 1258 | CGPG6350.pep | LRRNT_2::LRR_1::LRR_1::LRR_1::LRR_1 | 32-78::105-127::129-151::153-175::177-196 |
| 1260 | CGPG6365.pep | Aminotran_1_2 | 32-384 |
| 1261 | CGPG6374.pep | Gln-synt_C | 120-380 |
| 1262 | CGPG6377.pep | PGK | 2-383 |
| 1263 | CGPG638.pep | PA | 51-163 |
| 1264 | CGPG6397.pep | F420_oxidored | 3-246 |
| 1265 | CGPG6398.pep | Enolase_N::Enolase_C | 5-135::140-430 |
| 1266 | CGPG6408.pep | ADH_N::ADH_zinc_N | 25-155::185-350 |
| 1267 | CGPG6415.pep | NTP_transferase | 4-271 |
| 1268 | CGPG6421.pep | ADH_N::ADH_zinc_N | 25-148::179-318 |
| 1269 | CGPG6442.pep | iPGM_N::Metalloenzyme | 2-363::373-488 |
| 1270 | CGPG6443.pep | PGK | 1-391 |
| 1271 | CGPG6446.pep | PK::PK_C | 106-453::467-587 |
| 1272 | CGPG6453.pep | Aminotran_1_2 | 41-402 |
| 1273 | CGPG6466.pep | ADH_N::ADH_zinc_N | 27-153::184-322 |
| 1274 | CGPG6467.pep | Aminotran_3 | 19-366 |
| 1275 | CGPG6470.pep | PfkB | 1-302 |
| 1276 | CGPG6475.pep | NTP_transferase | 10-282 |
| 1277 | CGPG6477.pep | NDK | 4-138 |
| 1278 | CGPG6478.pep | PfkB | 1-308 |
| 1279 | CGPG6493.pep | AA_permease | 94-561 |
| 1280 | CGPG6506.pep | Asparaginase | 140-457 |
| 1281 | CGPG6518.pep | NAD_binding_2::6PGD | 2-173::177-467 |
| 1282 | CGPG6546.pep | PK::PK_C | 3-348::360-477 |
| 1283 | CGPG6556.pep | Aminotran_1_2 | 124-475 |
| 1284 | CGPG6562.pep | Aminotran_3 | 116-451 |
| 1285 | CGPG6566.pep | NTP_transferase::Hexapep::Hexapep::Hexapep | 95-350::398-415::432-449::460-477 |
| 1286 | CGPG6571.pep | Aldedh | 102-560 |
| 1287 | CGPG6576.pep | Aldedh | 99-565 |
| 1288 | CGPG659.pep | G_glu_transpept | 48-567 |
| 1289 | CGPG6594.pep | Pyr_redox_2::Pyr_redox_dim | 94-419::450-559 |
| 1290 | CGPG6603.pep | Pyr_redox_2::Pyr_redox_dim | 94-397::427-538 |
| 1291 | CGPG6608.pep | Pyr_redox_2::Pyr_redox_dim | 93-394::423-532 |
| 1292 | CGPG6634.pep | DUF177 | 100-252 |
| 1294 | CGPG6667.pep | Invertase_neut | 89-577 |
| 1295 | CGPG6678.pep | Biotin_lipoyl::E3_binding::2-oxoacid_dh | 92-165::225-263::281-512 |
| 1296 | CGPG6695.pep | Pyr_redox_2::Pyr_redox_dim | 97-408::436-545 |
| 1297 | CGPG6699.pep | Ribul_P_3_epim | 94-295 |
| 1298 | CGPG670.pep | Fer2 | 60-135 |
| 1299 | CGPG6705.pep | PK::PK_C::PEP-utilizers | 89-433::445-559::584-663 |
| 1300 | CGPG6735.pep | FBPase | 93-413 |
| 1301 | CGPG6744.pep | Glycolytic | 92-429 |
| 1302 | CGPG6753.pep | Pyr_redox_2 | 236-538 |
| 1303 | CGPG6757.pep | Aminotran_1_2 | 127-473 |
| 1305 | CGPG6806.pep | mTERF | 110-457 |
| 1306 | CGPG6811.pep | GH3 | 10-567 |
| 1308 | CGPG6815.pep | V-ATPase_G | 5-109 |
| 1310 | CGPG6830.pep | Tbf5 | 13-76 |
| 1313 | CGPG6864.pep | DUF620 | 190-438 |
| 1314 | CGPG6877.pep | Hep_59 | 101-194 |
| 1315 | CGPG6878.pep | Peptidase_M24 | 107-343 |
| 1316 | CGPG6880.pep | PAP_fibrillin | 72-232 |
| 1318 | CGPG6887.pep | AIG2 | 12-111 |
| 1319 | CGPG6895.pep | zf-CCHC::zf-CCHC::zf-CCHC::zf CCHC | 166-183::208-225::325-342::356-373 |
| 1322 | CGPG6912.pep | zf-DHHC | 149-213 |
| 1324 | CGPG6942.pep | RNA_pol_Rpb5_N::RNA_pol_Rpb5_C | 18-108::149-222 |
| 1327 | CGPG6969.pep | 2OG-FeII_Oxy | 223-323 |
| 1329 | CGPG6991.pep | Glyco_tran_28_C | 11-170 |
| 1332 | CGPG7037.pep | Sad1_UNC | 313-416 |
| 1333 | CGPG7051.pep | PAP_fibrillin | 84-236 |
| 1336 | CGPG7086.pep | SFT2 | 44-163 |
| 1339 | CGPG7136.pep | NOI | 1-72 |
| 1340 | CGPG7147.pep | RAMP4 | 1-64 |
| 1343 | CGPG7222.pep | Branch | 49-274 |
| 1345 | CGPG7233.pep | eIF2A | 214-407 |
| 1346 | CGPG7238.pep | UPF0185 | 5-80 |

TABLE 20-continued

| PEP Seq ID No. | Construct ID | Pfam module | Position |
|---|---|---|---|
| 1347 | CGPG7253.pep | ArfGap | 15-117 |
| 1348 | CGPG7255.pep | Arf | 5-177 |
| 1349 | CGPG7286.pep | ORC2 | 20-345 |
| 1350 | CGPG7292.pep | Methyltransf_11 | 38-135 |
| 1351 | CGPG7301.pep | ELFV_dehydrog_N::ELFV_dehydrog | 57-187::202-445 |
| 1352 | CGPG7305.pep | Pyr_redox_2 | 126-386 |
| 1353 | CGPG7307.pep | Gp_dh_N::Gp_dh_C | 11-163::168-324 |
| 1354 | CGPG7318.pep | MIP | 1-142 |
| 1355 | CGPG7319.pep | SNF5 | 172-400 |
| 1356 | CGPG7345.pep | Lipase_3 | 97-237 |
| 1357 | CGPG7368.pep | MT-A70 | 516-676 |
| 1358 | CGPG7385.pep | FHA | 32-107 |
| 1359 | CGPG7391.pep | G-patch | 6-50 |
| 1360 | CGPG7405.pep | TATA_RF | 1-216 |
| 1361 | CGPG7415.pep | IU_nuc_hydro | 1-312 |
| 1362 | CGPG7416.pep | GLTP | 52-233 |
| 1363 | CGPG7420.pep | PRK | 95-302 |
| 1366 | CGPG7445.pep | PRC::PRC | 92-169::171-252 |
| 1367 | CGPG7465.pep | Aldedh | 103-567 |
| 1368 | CGPG7473.pep | F-box::WD40::WD40::WD40::WD40 | 273-320::412-449::453-493::520-556::560-598 |
| 1369 | CGPG7489.pep | UBX | 295-376 |
| 1370 | CGPG7492.pep | Pescadillo_N::BRCT | 8-291::337-414 |
| 1371 | CGPG7499.pep | G-alpha | 423-839 |
| 1374 | CGPG7508.pep | Smg4_UPF3 | 1-170 |
| 1375 | CGPG7509.pep | SSB | 76-187 |
| 1376 | CGPG7511.pep | GFA | 31-125 |
| 1377 | CGPG7515.pep | Brix | 45-297 |
| 1378 | CGPG7521.pep | G-alpha | 23-386 |
| 1380 | CGPG7547.pep | PAD_porph | 14-368 |
| 1381 | CGPG7561.pep | Snf7 | 17-187 |
| 1382 | CGPG7562.pep | Sybindin | 6-136 |
| 1383 | CGPG7563.pep | DUF887 | 40-279 |
| 1384 | CGPG7567.pep | Peptidase_M18 | 14-461 |
| 1389 | CGPG7597.pep | zf-AN1 | 76-116 |
| 1390 | CGPG7606.pep | Pentapeptide::Pentapeptide | 127-166::172-211 |
| 1392 | CGPG7637.pep | DAD | 2-112 |
| 1393 | CGPG7649.pep | YgbB | 71-227 |
| 1394 | CGPG7658.pep | Cyclase | 56-256 |
| 1395 | CGPG7664.pep | Aldedh | 9-463 |
| 1396 | CGPG7666.pep | Aminotran_1_2 | 26-392 |
| 1397 | CGPG7668.pep | DUF594 | 660-719 |
| 1399 | CGPG7746.pep | UPF0153 | 49-139 |
| 1400 | CGPG7747.pep | Copine | 113-261 |
| 1401 | CGPG7752.pep | zf-MYND::PDCD2_C | 176-214::241-403 |
| 1403 | CGPG7770.pep | YTH | 263-353 |
| 1406 | CGPG7778.pep | Ubie_methyltran | 51-304 |
| 1407 | CGPG7786.pep | KH_1 | 141-193 |
| 1408 | CGPG7788.pep | YIF1 | 34-263 |
| 1410 | CGPG78.pep | Hpt | 46-132 |
| 1411 | CGPG7783.pep | RRM_1::RRM_2 | 288-354::682-778 |
| 1412 | CGPG7832.pep | STT3 | 26-670 |
| 1413 | CGPG7841.pep | ECH::3HCDH_N::3HCDH | 17-186::311-490::492-585 |
| 1414 | CGPG7845.pep | LRRNT_2::LRR_1::LRR_1::LRR_1::LRR_1::LRR_1 | 23-64::97-119::121-143::145-167::169-192::194-216 |
| 1415 | CGPG7847.pep | Peptidase_C48 | 30-225 |
| 1417 | CGPG7853.pep | LRR_1::LRR_1::LRR_1::LRR_1::LRR_1::LRR_1 | 142-164::166-188::190-212::214-235::258-280::282-304::306-325 |
| 1418 | CGPG7857.pep | Response_reg::CCT | 79-195::689-736 |
| 1420 | CGPG7869.pep | Acyltransferase | 117-264 |
| 1421 | CGPG7891.pep | FMO-like | 11-427 |
| 1422 | CGPG7892.pep | FMO-like | 9-416 |
| 1423 | CGPG7906.pep | Skp1_POZ::Skp1 | 4-65::76-153 |
| 1424 | CGPG7924.pep | AAA | 249-462 |
| 1428 | CGPG7964.pep | IQ::IQ | 108-128::130-150 |
| 1429 | CGPG7968.pep | FMO-like | 13-427 |
| 1431 | CGPG7972.pep | FAD_binding_3 | 5-372 |
| 1432 | CGPG7982.pep | Tetraspannin | 4-241 |
| 1433 | CGPG7985.pep | BT1 | 57-469 |
| 1434 | CGPG7993.pep | F-box::LRR_2 | 27-73::278-304 |
| 1435 | CGPG8.pep | p450 | 39-503 |
| 1436 | CGPG80.pep | Pkinase | 68-328 |

TABLE 20-continued

| PEP Seq ID No. | Construct ID | Pfam module | Position |
|---|---|---|---|
| 1437 | CGPG8001.pep | FMO-like | 13-433 |
| 1438 | CGPG8009.pep | BT1 | 41-511 |
| 1440 | CGPG8049.pep | BT1 | 1-436 |
| 1441 | CGPG806.pep | Synaptobrevin | 127-215 |
| 1442 | CGPG8060.pep | DUF829 | 161-425 |
| 1446 | CGPG81.pep | Pkinase | 70-330 |
| 1452 | CGPG8125.pep | zf-C3HC4 | 46-86 |
| 1453 | CGPG8134.pep | DEK_C::SWIB::SWIB | 3-57::197-272::305-382 |
| 1455 | CGPG8156.pep | PCI | 258-362 |
| 1456 | CGPG8159.pep | ACT::ACT | 77-141::308-374 |
| 1458 | CGPG8179.pep | WD::WD40 | 138-177::264-305 |
| 1459 | CGPG8193.pep | Ank::Ank | 22-54::55-87 |
| 1460 | CGPG8197.pep | F-box | 5-53 |
| 1461 | CGPG8198.pep | F-box::Kelch_2::Kelch_1::Kelch_2 | 74-119::174-221::223-278::329-369 |
| 1463 | CGPG8211.pep | F-box::WD40::WD40::WD40::WD40::WD40::WD40 | 182-229::292-328::332-368::372-408::411-449::453-538::542-578 |
| 1464 | CGPG823.pep | Ribosomal_S6e | 1-129 |
| 1466 | CGPG8238.pep | PGI | 49-537 |
| 1467 | CGPG8260.pep | Iso_dh | 4-331 |
| 1468 | CGPG8267.pep | Pyridoxal_deC | 34-383 |
| 1469 | CGPG8268.pep | NIR_SIR_ferr::NIR_SIR::NIR_SIR_ferr | 62-131::164-345::360-432 |
| 1470 | CGPG8274.pep | PK::PK_C | 5-347::363-476 |
| 1471 | CGPG8277.pep | Rib_5-P_isom_A | 55-229 |
| 1472 | CGPG8279.pep | F-box::Kelch_1::Kelch_1 | 22-69::124-168::170-213 |
| 1475 | CGPG8408.pep | DUF641 | 60-192 |
| 1476 | CGPG842.pep | Redoxin | 5-162 |
| 1477 | CGPG8421.pep | NOSIC::Nop | 121-173::213-361 |
| 1478 | CGPG8435.pep | NHL::NHL | 55-82::115-142 |
| 1479 | CGPG8440.pep | U-box::Arm::Arm::Arm::Arm | 242-316::372-413::455-495::496-537::538-578 |
| 1480 | CGPG8453.pep | ACT::ACT::ACT::ACT | 36-99::129-201::265-332::343-406 |
| 1481 | CGPG8470.pep | DUF89 | 18-357 |
| 1482 | CGPG8479.pep | F-box::Kelch_1::Kelch_1 | 31-78::124-170::172-216 |
| 1483 | CGPG8489.pep | F-box::FBA_1 | 3-50::219-384 |
| 1484 | CGPG8498.pep | Fcf1 | 87-185 |
| 1485 | CGPG85.pep | Aa_trans | 19-454 |
| 1486 | CGPG8501.pep | PPR::PPR::PPR::PPR::PPR::PPR | 149-183::189-223::224-258::259-292::330-364::401-435 |
| 1487 | CGPG8507.pep | DUF588 | 31-185 |
| 1488 | CGPG8509.pep | Pro_isomerase | 80-233 |
| 1490 | CGPG8517.pep | B_lectin::S_locus_glycop::PAN_2 | 84-197::211-339::356-422 |
| 1492 | CGPG852.pep | Ribosomal_S5::Ribosomal_S5_C | 94-160::177-250 |
| 1498 | CGPG8567.pep | TB2_DP1_HVA22 | 3-98 |
| 1499 | CGPG8580.pep | Caleosin | 22-195 |
| 1501 | CGPG8590.pep | DUF579 | 42-289 |
| 1503 | CGPG8594.pep | DUF584 | 1-139 |
| 1504 | CGPG8606.pep | Exo_endo_phos | 56-327 |
| 1505 | CGPG8628.pep | DUF584 | 32-203 |
| 1507 | CGPG8654.pep | PPR::PPR | 73-107::141-175 |
| 1508 | CGPG8668.pep | TATA_RF | 1-200 |
| 1511 | CGPG8702.pep | RPE65 | 50-622 |
| 1514 | CGPG8748.pep | AAA | 201-357 |
| 1516 | CGPG8770.pep | DUF543 | 1-73 |
| 1517 | CGPG8777.pep | DUF569::DUF569 | 1-144::227-368 |
| 1519 | CGPG8786.pep | DUF260 | 13-113 |
| 1520 | CGPG8792.pep | Abhydrolase_3 | 75-290 |
| 1521 | CGPG8801.pep | PPR::PPR::PPR::PPR::PPR::PPR::PPR | 110-144::145-179::181-215::216-250::251-285::286-320::321-355 |
| 1522 | CGPG8809.pep | Ribosomal_L12 | 141-208 |
| 1523 | CGPG8840.pep | CLP_protease | 115-289 |

TABLE 20-continued

| PEP Seq ID No. | Construct ID | Pfam module | Position |
|---|---|---|---|
| 1524 | CGPG8850.pep | PPR::PPR::PPR::PPR::PPR::PPR::PPR::PPR::PPR::PPR | 189-223::224-258::297-331::332-366::367-401::402-436::437-470::471-505::506-540::542-576 |
| 1525 | CGPG8870.pep | Fructosamin_kin | 54-339 |
| 1526 | CGPG8871.pep | DUF59 | 36-115 |
| 1527 | CGPG8872.pep | RRM_1::RRM_1::RRM_1 | 138-205::214-288::308-378 |
| 1528 | CGPG8876.pep | SFT2 | 43-162 |
| 1529 | CGPG8902.pep | RNA_pol_I_A49 | 31-415 |
| 1530 | CGPG8904.pep | G-alpha | 103-447 |
| 1531 | CGPG8907.pep | DnaJ::zf-C2H2 | 4-67::338-362 |
| 1532 | CGPG8914.pep | Whi5 | 181-205 |
| 1533 | CGPG8931.pep | eIF3_subunit | 1-231 |
| 1534 | CGPG8933.pep | MACPF | 126-322 |
| 1535 | CGPG8935.pep | Pkinase | 33-324 |
| 1536 | CGPG8938.pep | Pkinase | 71-348 |
| 1537 | CGPG8944.pep | PH | 31-134 |
| 1538 | CGPG895.pep | DUF231 | 251-427 |
| 1540 | CGPG8961.pep | Dus | 59-392 |
| 1541 | CGPG8963.pep | Pkinase | 319-612 |
| 1542 | CGPG898.pep | DUF231 | 276-448 |
| 1543 | CGPG8993.pep | AAA::Rep_fac_C | 44-226::237-326 |
| 1544 | CGPG8994.pep | Brix | 86-262 |
| 1545 | CGPG8995.pep | Porin_3 | 54-326 |
| 1546 | CGPG90.pep | MFS_1 | 68-427 |
| 1547 | CGPG900.pep | DUF231 | 241-420 |
| 1548 | CGPG9002.pep | CTP_transf_1 | 51-382 |
| 1549 | CGPG9009.pep | Alg6_Alg8 | 22-514 |
| 1550 | CGPG9011.pep | OTCace_N::OTCace | 70-212::216-369 |
| 1551 | CGPG9012.pep | FolB | 16-129 |
| 1552 | CGPG9017.pep | DMRL_synthase | 70-213 |
| 1553 | CGPG9025.pep | Glyco_transf_29 | 105-355 |
| 1554 | CGPG9026.pep | Adap_comp_sub | 160-428 |
| 1555 | CGPG9032.pep | RNase_PH::RNase_PH_C | 33-165::194-262 |
| 1556 | CGPG9040.pep | Sec1 | 35-592 |
| 1557 | CGPG9044.pep | Syntaxin::SNARE | 57-163::256-318 |
| 1558 | CGPG9048.pep | RNase_PH | 15-135 |
| 1559 | CGPG9049.pep | Glycos_transf_1 | 244-442 |
| 1560 | CGPG9058.pep | RNA_pol_N | 1-60 |
| 1561 | CGPG906.pep | PPR::PPR | 210-244::245-279 |
| 1562 | CGPG9070.pep | ATP-synt_C::ATP-synt_C | 20-85::104-169 |
| 1564 | CGPG9084.pep | CH::EB1 | 15-116::209-255 |
| 1566 | CGPG9098.pep | DUF6::DUF6 | 32-165::208-337 |
| 1567 | CGPG9099.pep | Rick_17_kDa_Anti | 66-110 |
| 1568 | CGPG9110.pep | RALF | 53-118 |
| 1569 | CGPG9119.pep | PTR2 | 115-504 |
| 1570 | CGPG9125.pep | ThiF | 98-233 |
| 1571 | CGPG913.pep | PPR::PPR::PPR::PPR::PPR::PPR | 86-120::188-222::223-257::289-323::325-358::361-395 |
| 1574 | CGPG9164.pep | DHBP_synthase::GTP_cyclohydro2 | 5-202::207-377 |
| 1575 | CGPG9172.pep | Sec61_beta | 32-77 |
| 1577 | CGPG9185.pep | DUF423 | 10-115 |
| 1578 | CGPG9187.pep | Pkinase | 12-263 |
| 1579 | CGPG9190.pep | DREPP | 2-203 |
| 1580 | CGPG9193.pep | GATase::GMP_synt_C | 11-196::432-524 |
| 1581 | CGPG9195.pep | DUF1279 | 91-193 |
| 1582 | CGPG9203.pep | Na_H_Exchanger::TrkA_C | 13-391::418-486 |
| 1583 | CGPG9209.pep | GATase::GMP_synt_C | 9-197::423-515 |
| 1585 | CGPG9210.pep | Na_H_Exchanger::TrkA_N | 10-376::402-517 |
| 1586 | CGPG9211.pep | NTP_transferase::MannoseP_isomer | 7-296::307-473 |
| 1587 | CGPG9212.pep | ATP-synt_ab_N::ATP-synt_ab | 22-87::143-353 |
| 1588 | CGPG9216.pep | DHBP_synthase::GTP_cyclohydro2 | 10-206::211-379 |
| 1589 | CGPG9226.pep | Carboxyl_trans | 40-541 |
| 1590 | CGPG9252.pep | CDC48_N::AAA::AAA | 28-114::245-429::518-705 |
| 1592 | CGPG9289.pep | LSM | 10-75 |
| 1593 | CGPG9298.pep | p450 | 41-516 |
| 1594 | CGPG9299.pep | ThiF | 82-227 |
| 1597 | CGPG9316.pep | ATP-grasp_2::Ligase_CoA | 34-242::285-421 |
| 1598 | CGPG9317.pep | DUF163 | 43-196 |
| 1599 | CGPG9318.pep | Aldo_ket_red | 20-285 |
| 1600 | CGPG9324.pep | Pkinase | 158-706 |
| 1601 | CGPG9357.pep | Raffinose_syn | 7-757 |

TABLE 20-continued

| PEP Seq ID No. | Construct ID | Pfam module | Position |
|---|---|---|---|
| 1602 | CGPG965.pep | Hexapep::Hexapep::Hexapep::Hexapep | 70-87::119-136::142-159::160-177 |
| 1603 | CGPG970.pep | NPH3 | 206-441 |
| 1604 | CGPG982.pep | p450 | 29-495 |
| 1605 | CGPG994.pep | adh_short | 50-218 |
| 1606 | CGPG996.pep | DUF866 | 1-167 |

TABLE 21

| PEP Seq ID No. | Construct ID | Pfam domain name | Begin | Stop | score | E-value |
|---|---|---|---|---|---|---|
| 806 | CGPG1023.pep | Na_Ca_ex | 104 | 255 | 94.2 | 4.10E−25 |
| 806 | CGPG1023.pep | Na_Ca_ex | 299 | 432 | 128.4 | 2.10E−35 |
| 807 | CGPG1038.pep | DUF1475 | 1 | 256 | 709.5 | 2.40E−210 |
| 812 | CGPG1113.pep | DUF1350 | 49 | 370 | 64.5 | 3.50E−16 |
| 814 | CGPG1163.pep | DSPc | 49 | 182 | 103 | 9.00E−28 |
| 817 | CGPG1205.pep | Arm | 94 | 134 | 37.2 | 5.90E−08 |
| 817 | CGPG1205.pep | Arm | 135 | 175 | 32.9 | 1.10E−06 |
| 817 | CGPG1205.pep | Arm | 176 | 216 | 31.7 | 2.60E−06 |
| 817 | CGPG1205.pep | Arm | 258 | 298 | 18.8 | 0.02 |
| 818 | CGPG1207.pep | NifU_N | 26 | 105 | 78.3 | 2.60E−20 |
| 820 | CGPG1223.pep | ATP_bind_1 | 7 | 250 | 425.9 | 5.70E−125 |
| 821 | CGPG1250.pep | DUF822 | 12 | 160 | 323.6 | 3.70E−94 |
| 824 | CGPG1319.pep | DUF599 | 10 | 233 | 464.2 | 1.70E−136 |
| 826 | CGPG1329.pep | Cullin | 29 | 631 | 966.3 | 1.20E−287 |
| 827 | CGPG133.pep | Cyclin_N | 168 | 293 | 232.6 | 9.20E−67 |
| 827 | CGPG133.pep | Cyclin_C | 295 | 422 | 170.5 | 4.50E−48 |
| 828 | CGPG1332.pep | Cullin | 12 | 646 | 709.1 | 3.20E−210 |
| 829 | CGPG1343.pep | LRR_1 | 389 | 412 | 9.2 | 6 |
| 830 | CGPG1348.pep | Lectin_legB | 27 | 248 | 295 | 1.40E−85 |
| 830 | CGPG1348.pep | Pkinase | 334 | 604 | 170.2 | 5.30E−48 |
| 830 | CGPG1348.pep | Pkinase_Tyr | 334 | 604 | 134.8 | 2.50E−37 |
| 831 | CGPG1349.pep | B_lectin | 65 | 171 | 95.8 | 1.30E−25 |
| 831 | CGPG1349.pep | S_locus_glycop | 180 | 312 | 105 | 2.40E−28 |
| 831 | CGPG1349.pep | PAN_1 | 327 | 404 | 38.5 | 2.40E−08 |
| 831 | CGPG1349.pep | Pkinase | 484 | 731 | 167.1 | 4.70E−47 |
| 831 | CGPG1349.pep | Pkinase_Tyr | 484 | 731 | 89.6 | 1.00E−23 |
| 832 | CGPG1373.pep | Pkinase | 12 | 291 | 356.7 | 3.80E−104 |
| 833 | CGPG1377.pep | Pkinase | 4 | 258 | 247.3 | 3.30E−71 |
| 834 | CGPG1412.pep | TPP_enzyme_N | 45 | 221 | 286.5 | 5.40E−83 |
| 834 | CGPG1412.pep | TPP_enzyme_M | 243 | 376 | 82.9 | 1.00E−21 |
| 834 | CGPG1412.pep | TPP_enzyme_C | 431 | 578 | 35 | 3.50E−09 |
| 835 | CGPG1421.pep | Biotin_lipoyl | 76 | 149 | 85.1 | 2.30E−22 |
| 835 | CGPG1421.pep | E3_binding | 180 | 218 | 58.5 | 2.20E−14 |
| 835 | CGPG1421.pep | 2-oxoacid_dh | 249 | 480 | 358.5 | 1.10E−104 |
| 836 | CGPG1426.pep | Aminotran_1_2 | 48 | 432 | 525 | 8.50E−155 |
| 837 | CGPG1433.pep | HI0933_like | 44 | 365 | −247.2 | 0.002 |
| 837 | CGPG1433.pep | GIDA | 45 | 369 | −206 | 0.00022 |
| 837 | CGPG1433.pep | Pyr_redox_2 | 45 | 359 | 241.5 | 1.90E−69 |
| 837 | CGPG1433.pep | Pyr_redox | 216 | 313 | 115.7 | 1.40E−31 |
| 837 | CGPG1433.pep | Pyr_redox_dim | 388 | 497 | 213.1 | 6.50E−61 |
| 838 | CGPG1453.pep | malic | 171 | 360 | 412.3 | 7.10E−121 |
| 838 | CGPG1453.pep | Malic_M | 362 | 615 | 468.8 | 7.10E−138 |
| 839 | CGPG1454.pep | Ribul_P_3_epim | 7 | 207 | 331.5 | 1.50E−96 |
| 840 | CGPG1463.pep | Alpha-amylase | 26 | 361 | 224.3 | 2.80E−64 |
| 840 | CGPG1463.pep | Alpha-amyl_C2 | 362 | 422 | 132.9 | 9.40E−37 |
| 841 | CGPG1464.pep | Glycolytic | 11 | 358 | 852.5 | 2.20E−253 |
| 842 | CGPG1471.pep | IF4E | 1 | 198 | 287.7 | 2.20E−83 |
| 843 | CGPG1481.pep | Pkinase | 4 | 260 | 292.7 | 7.40E−85 |
| 844 | CGPG1499.pep | PPDK_N | 85 | 445 | 654.8 | 6.90E−194 |
| 844 | CGPG1499.pep | PEP-utilizers | 496 | 586 | 165.9 | 1.10E−46 |
| 844 | CGPG1499.pep | PEP-utilizers_C | 598 | 955 | 688.7 | 4.30E−204 |
| 845 | CGPG150.pep | p450 | 30 | 507 | 128 | 2.80E−35 |
| 846 | CGPG1536.pep | CRAL_TRIO_N | 73 | 142 | 46.4 | 1.00E−10 |
| 846 | CGPG1536.pep | CRAL_TRIO | 159 | 345 | 145.1 | 2.00E−40 |
| 847 | CGPG1539.pep | UPF0139 | 8 | 107 | 215.9 | 9.60E−62 |
| 848 | CGPG155.pep | GlutR_N | 100 | 251 | 288.2 | 1.70E−83 |
| 848 | CGPG155.pep | Shikimate_DH | 255 | 407 | 208.3 | 1.80E−59 |
| 848 | CGPG155.pep | GlutR_dimer | 420 | 526 | 180.6 | 4.10E−51 |
| 849 | CGPG1583.pep | PLAC8 | 88 | 187 | 176.8 | 5.40E−50 |
| 850 | CGPG1588.pep | PLAC8 | 75 | 214 | 156.3 | 8.30E−44 |
| 851 | CGPG16.pep | MIP | 14 | 235 | 396.7 | 3.60E−116 |
| 852 | CGPG1609.pep | MMR_HSR1 | 54 | 190 | 118.9 | 1.50E−32 |
| 852 | CGPG1609.pep | DUF933 | 337 | 420 | 205.4 | 1.40E−58 |

TABLE 21-continued

| PEP Seq ID No. | Construct ID | Pfam domain name | Begin | Stop | score | E-value |
|---|---|---|---|---|---|---|
| 853 | CGPG1629.pep | WD40 | 262 | 301 | 31.1 | 4.20E−06 |
| 853 | CGPG1629.pep | WD40 | 307 | 346 | 36 | 1.30E−07 |
| 853 | CGPG1629.pep | WD40 | 356 | 395 | 41.3 | 3.50E−09 |
| 854 | CGPG1637.pep | DUF220 | 163 | 262 | 148.5 | 1.80E−41 |
| 855 | CGPG1653.pep | TBC | 200 | 415 | −15 | 1.60E−06 |
| 856 | CGPG1658.pep | Nodulin-like | 14 | 260 | 516.4 | 3.30E−152 |
| 857 | CGPG1663.pep | MFS_1 | 22 | 387 | 26.3 | 0.00011 |
| 857 | CGPG1663.pep | BT1 | 30 | 441 | 633.5 | 1.90E−187 |
| 858 | CGPG1682.pep | OPT | 62 | 685 | 688.8 | 4.20E−204 |
| 859 | CGPG1701.pep | Glyco_transf_8 | 76 | 299 | 13.5 | 1.90E−07 |
| 861 | CGPG1724.pep | Per1 | 63 | 334 | 669.6 | 2.50E−198 |
| 862 | CGPG1726.pep | DUF607 | 111 | 291 | 388.6 | 9.80E−114 |
| 863 | CGPG1736.pep | Usp | 1 | 148 | 64.9 | 2.70E−16 |
| 864 | CGPG1741.pep | mTERF | 279 | 627 | 84.1 | 4.40E−22 |
| 865 | CGPG1783.pep | PB1 | 42 | 132 | 85 | 2.40E−22 |
| 866 | CGPG1790.pep | PB1 | 59 | 153 | 109.6 | 9.20E−30 |
| 868 | CGPG1845.pep | TFIID-18 kDa | 29 | 119 | 145.5 | 1.50E−40 |
| 869 | CGPG1855.pep | CAF1 | 3 | 227 | 330.9 | 2.30E−96 |
| 870 | CGPG1870.pep | Pkinase | 406 | 572 | 74.8 | 2.90E−19 |
| 871 | CGPG1879.pep | Pkinase | 21 | 277 | 357.5 | 2.30E−104 |
| 871 | CGPG1879.pep | Pkinase_Tyr | 21 | 275 | 88.2 | 2.60E−23 |
| 871 | CGPG1879.pep | NAF | 303 | 364 | 98.7 | 1.80E−26 |
| 872 | CGPG1886.pep | Pkinase | 26 | 325 | 337.3 | 2.70E−98 |
| 873 | CGPG1903.pep | F-box | 320 | 367 | 41 | 4.30E−09 |
| 874 | CGPG1905.pep | F-box | 4 | 51 | 41.7 | 2.60E−09 |
| 874 | CGPG1905.pep | Kelch_2 | 104 | 150 | 27.4 | 5.30E−05 |
| 874 | CGPG1905.pep | Kelch_2 | 255 | 306 | 41.6 | 2.80E−09 |
| 875 | CGPG1914.pep | F-box | 42 | 89 | 39.8 | 9.50E−09 |
| 875 | CGPG1914.pep | Kelch_2 | 170 | 215 | 26.3 | 0.00011 |
| 875 | CGPG1914.pep | Kelch_1 | 170 | 215 | 52.2 | 1.80E−12 |
| 875 | CGPG1914.pep | Kelch_2 | 217 | 266 | 31.3 | 3.60E−06 |
| 875 | CGPG1914.pep | Kelch_1 | 217 | 266 | 59.1 | 1.50E−14 |
| 876 | CGPG193.pep | WD40 | 167 | 205 | 28.5 | 2.40E−05 |
| 876 | CGPG193.pep | WD40 | 268 | 307 | 24.4 | 0.00041 |
| 876 | CGPG193.pep | WD40 | 318 | 355 | 25.1 | 0.00026 |
| 876 | CGPG193.pep | WD40 | 363 | 401 | 39.3 | 1.40E−08 |
| 877 | CGPG1939.pep | F-box | 66 | 113 | 36.2 | 1.20E−07 |
| 877 | CGPG1939.pep | WD40 | 152 | 190 | 26.2 | 0.00012 |
| 877 | CGPG1939.pep | WD40 | 247 | 283 | 33.6 | 7.10E−07 |
| 877 | CGPG1939.pep | WD40 | 325 | 364 | 22.9 | 0.0012 |
| 878 | CGPG1949.pep | YDG_SRA | 360 | 519 | 403.5 | 3.10E−118 |
| 878 | CGPG1949.pep | Pre-SET | 543 | 639 | 156.7 | 6.30E−44 |
| 878 | CGPG1949.pep | SET | 641 | 771 | 178.4 | 1.80E−50 |
| 879 | CGPG1959.pep | PHD | 34 | 82 | 54.3 | 4.30E−13 |
| 879 | CGPG1959.pep | SET | 208 | 344 | 105.1 | 2.20E−28 |
| 880 | CGPG197.pep | p450 | 40 | 481 | 169.2 | 1.10E−47 |
| 882 | CGPG1981.pep | MT-A70 | 476 | 636 | 321.4 | 1.70E−93 |
| 883 | CGPG1999.pep | Nfu_N | 78 | 193 | 145 | 2.10E−40 |
| 883 | CGPG1999.pep | NifU | 221 | 291 | 121.1 | 3.30E−33 |
| 884 | CGPG2.pep | p450 | 71 | 531 | 324.3 | 2.20E−94 |
| 885 | CGPG2006.pep | RCC1 | 32 | 82 | 31.3 | 3.60E−06 |
| 885 | CGPG2006.pep | RCC1 | 138 | 187 | 40 | 8.30E−09 |
| 885 | CGPG2006.pep | RCC1 | 190 | 239 | 33 | 1.10E−06 |
| 885 | CGPG2006.pep | RCC1 | 294 | 343 | 42.8 | 1.20E−09 |
| 886 | CGPG2010.pep | Aminotran_5 | 74 | 448 | 681.1 | 8.90E−202 |
| 886 | CGPG2010.pep | Beta_elim_lyase | 77 | 389 | −107.3 | 0.0021 |
| 887 | CGPG2011.pep | X8 | 128 | 209 | 153.5 | 5.60E−43 |
| 888 | CGPG2014.pep | Pkinase | 28 | 282 | 339.2 | 7.00E−99 |
| 888 | CGPG2014.pep | NAF | 341 | 398 | 86.9 | 6.70E−23 |
| 889 | CGPG2023.pep | Zip | 48 | 352 | 371 | 1.90E−108 |
| 890 | CGPG2026.pep | Pkinase | 38 | 324 | 328.9 | 9.40E−96 |
| 892 | CGPG2064.pep | Cenp-O | 123 | 201 | 107.6 | 3.80E−29 |
| 894 | CGPG2077.pep | NAC | 88 | 147 | 81.6 | 2.50E−21 |
| 894 | CGPG2077.pep | UBA | 195 | 232 | 29.8 | 1.00E−05 |
| 895 | CGPG2095.pep | AARP2CN | 228 | 309 | 121.6 | 2.30E−33 |
| 895 | CGPG2095.pep | DUF663 | 483 | 780 | 615.9 | 3.60E−182 |
| 896 | CGPG2105.pep | Pkinase | 102 | 404 | 274.6 | 2.00E−79 |
| 896 | CGPG2105.pep | Pkinase_C | 422 | 471 | 39.6 | 1.10E−08 |
| 897 | CGPG2108.pep | Response_reg | 64 | 180 | 86.8 | 6.80E−23 |
| 897 | CGPG2108.pep | CCT | 442 | 484 | 65 | 2.50E−16 |
| 898 | CGPG2111.pep | polyprenyl_synt | 74 | 324 | 156.4 | 7.70E−44 |
| 899 | CGPG2124.pep | UIM | 139 | 156 | 20.6 | 0.0057 |
| 899 | CGPG2124.pep | efhand | 220 | 248 | 35.7 | 1.70E−07 |
| 900 | CGPG2125.pep | Glutaredoxin | 44 | 110 | 40.7 | 5.10E−09 |
| 903 | CGPG2134.pep | ATP-synt_G | 8 | 122 | 170.2 | 5.30E−48 |
| 904 | CGPG2139.pep | DUF1517 | 94 | 391 | 709.7 | 2.10E−210 |
| 905 | CGPG2140.pep | PhzC-PhzF | 6 | 282 | 506.2 | 3.90E−149 |
| 907 | CGPG2163.pep | Cupin_1 | 5 | 157 | 105.9 | 1.20E−28 |

TABLE 21-continued

| PEP Seq ID No. | Construct ID | Pfam domain name | Begin | Stop | score | E-value |
|---|---|---|---|---|---|---|
| 907 | CGPG2163.pep | Cupin_1 | 190 | 339 | 83.5 | 6.80E−22 |
| 908 | CGPG2165.pep | ClpS | 76 | 152 | 131.5 | 2.40E−36 |
| 910 | CGPG2218.pep | Spc97_Spc98 | 67 | 555 | 750.6 | 1.10E−222 |
| 912 | CGPG2225.pep | EMP24_GP25L | 52 | 116 | 55.6 | 1.80E−13 |
| 913 | CGPG2229.pep | Subtilisin_N | 30 | 106 | 89.6 | 9.70E−24 |
| 913 | CGPG2229.pep | Peptidase_S8 | 119 | 600 | 52.4 | 1.60E−12 |
| 913 | CGPG2229.pep | PA | 362 | 461 | 112 | 1.80E−30 |
| 915 | CGPG2254.pep | Ribosomal_L7Ae | 20 | 114 | 110.3 | 5.80E−30 |
| 916 | CGPG2268.pep | CBS | 66 | 188 | 107.9 | 3.00E−29 |
| 917 | CGPG227.pep | p450 | 37 | 494 | 364.2 | 2.20E−106 |
| 918 | CGPG2312.pep | UPF0061 | 75 | 571 | 361.8 | 1.20E−105 |
| 919 | CGPG2315.pep | SIP1 | 286 | 514 | 516.5 | 3.10E−152 |
| 920 | CGPG2316.pep | PTPA | 98 | 396 | 696.6 | 1.80E−206 |
| 922 | CGPG235.pep | p450 | 74 | 510 | 203.2 | 6.10E−58 |
| 923 | CGPG2358.pep | Branch | 54 | 278 | 425.3 | 8.70E−125 |
| 925 | CGPG2361.pep | Metallophos | 9 | 231 | 49.7 | 1.00E−11 |
| 926 | CGPG2365.pep | Epimerase | 3 | 211 | −25.8 | 3.00E−05 |
| 927 | CGPG2372.pep | Pribosyltran | 29 | 169 | 147.9 | 2.70E−41 |
| 928 | CGPG2374.pep | Aminotran_5 | 8 | 370 | −92.6 | 4.20E−07 |
| 929 | CGPG2377.pep | DAO | 69 | 466 | 243.4 | 5.00E−70 |
| 929 | CGPG2377.pep | FAD_binding_2 | 69 | 457 | −124 | 0.0024 |
| 930 | CGPG2387.pep | H_PPase | 1 | 239 | −188.8 | 6.80E−17 |
| 931 | CGPG2389.pep | Carb_anhydrase | 52 | 275 | 117.4 | 4.30E−32 |
| 932 | CGPG2395.pep | AA_permease | 89 | 526 | −4.2 | 1.30E−05 |
| 934 | CGPG2409.pep | DUF862 | 17 | 154 | 252.5 | 8.90E−73 |
| 935 | CGPG2410.pep | GST_N | 5 | 79 | 68.9 | 1.70E−17 |
| 935 | CGPG2410.pep | GST_C | 101 | 204 | 30.1 | 8.30E−06 |
| 937 | CGPG2416.pep | Hin1 | 97 | 235 | 198.2 | 2.10E−56 |
| 938 | CGPG2441.pep | Sina | 5 | 205 | 188 | 2.30E−53 |
| 939 | CGPG2450.pep | adh_short | 112 | 282 | −38.2 | 0.004 |
| 939 | CGPG2450.pep | Epimerase | 114 | 371 | 191.5 | 2.10E−54 |
| 939 | CGPG2450.pep | 3Beta_HSD | 115 | 402 | −72.8 | 1.60E−05 |
| 939 | CGPG2450.pep | NAD_binding_4 | 116 | 342 | −62.5 | 9.90E−05 |
| 940 | CGPG2451.pep | RALF | 57 | 129 | 123.9 | 4.80E−34 |
| 941 | CGPG2492.pep | Pribosyltran | 80 | 216 | 144.1 | 3.80E−40 |
| 942 | CGPG2495.pep | ADH_N | 25 | 134 | 143.2 | 7.40E−40 |
| 942 | CGPG2495.pep | ADH_zinc_N | 165 | 307 | 138 | 2.60E−38 |
| 943 | CGPG2506.pep | PfkB | 5 | 289 | 140.3 | 5.30E−39 |
| 944 | CGPG2515.pep | TIM | 5 | 244 | 446 | 5.10E−131 |
| 945 | CGPG2531.pep | Redoxin | 4 | 160 | 43.7 | 6.60E−10 |
| 945 | CGPG2531.pep | AhpC-TSA | 5 | 138 | 178.9 | 1.30E−50 |
| 946 | CGPG2581.pep | SeIR | 12 | 133 | 289.3 | 7.50E−84 |
| 947 | CGPG2584.pep | zf-Tim10_DDP | 22 | 86 | 115.1 | 2.00E−31 |
| 948 | CGPG2592.pep | TFIID_30kDa | 30 | 80 | 135.9 | 1.10E−37 |
| 949 | CGPG2612.pep | RRM_1 | 65 | 132 | 43 | 1.10E−09 |
| 949 | CGPG2612.pep | RRM_1 | 150 | 225 | 83.9 | 5.30E−22 |
| 949 | CGPG2612.pep | RRM_1 | 275 | 343 | 53.1 | 9.50E−13 |
| 950 | CGPG2660.pep | B3 | 17 | 115 | 77.8 | 3.60E−20 |
| 950 | CGPG2660.pep | B3 | 211 | 301 | 61.4 | 3.10E−15 |
| 951 | CGPG2663.pep | NTF2 | 15 | 131 | 168.8 | 1.50E−47 |
| 951 | CGPG2663.pep | RRM_1 | 295 | 365 | 45.3 | 2.10E−10 |
| 952 | CGPG2679.pep | ACBP | 104 | 190 | 54.4 | 3.80E−13 |
| 952 | CGPG2679.pep | Ank | 265 | 297 | 49.7 | 1.00E−11 |
| 952 | CGPG2679.pep | Ank | 298 | 330 | 35.5 | 2.00E−07 |
| 953 | CGPG2696.pep | zf-C3HC4 | 177 | 218 | 43.9 | 5.70E−10 |
| 954 | CGPG2772.pep | Mov34 | 6 | 136 | 111.9 | 1.90E−30 |
| 955 | CGPG2773.pep | Asp | 161 | 498 | −73.6 | 3.00E−09 |
| 956 | CGPG281.pep | TLC | 91 | 574 | 1046.6 | 0 |
| 957 | CGPG2846.pep | Aldo_ket_red | 49 | 365 | 248 | 2.00E−71 |
| 958 | CGPG2852.pep | Glyoxalase | 9 | 132 | 37.4 | 5.20E−08 |
| 960 | CGPG2870.pep | zf-CCCH | 111 | 137 | 49.3 | 1.30E−11 |
| 960 | CGPG2870.pep | zf-CCCH | 159 | 185 | 34.6 | 3.60E−07 |
| 960 | CGPG2870.pep | zf-CCCH | 205 | 231 | 49.5 | 1.20E−11 |
| 960 | CGPG2870.pep | zf-CCCH | 347 | 373 | 29.9 | 9.60E−06 |
| 960 | CGPG2870.pep | zf-CCCH | 393 | 419 | 42.5 | 1.50E−09 |
| 961 | CGPG2877.pep | LAG1 | 96 | 307 | 430.8 | 1.90E−126 |
| 962 | CGPG289.pep | Cellulose_synt | 243 | 1060 | 2161.1 | 0 |
| 963 | CGPG2924.pep | zf-C3HC4 | 138 | 179 | 33.3 | 9.10E−07 |
| 964 | CGPG2947.pep | Acetyltransf_1 | 265 | 343 | 50.6 | 5.60E−12 |
| 964 | CGPG2947.pep | Bromodomain | 460 | 548 | 122.2 | 1.50E−33 |
| 965 | CGPG2963.pep | C1_3 | 80 | 108 | 35.7 | 1.60E−07 |
| 965 | CGPG2963.pep | C1_2 | 81 | 108 | 37.1 | 6.10E−08 |
| 965 | CGPG2963.pep | C1_1 | 122 | 172 | 14.3 | 0.00058 |
| 965 | CGPG2963.pep | C1_3 | 136 | 164 | 36.3 | 1.10E−07 |
| 965 | CGPG2963.pep | C1_3 | 194 | 223 | 27.2 | 6.10E−05 |
| 965 | CGPG2963.pep | C1_2 | 305 | 335 | 40.5 | 5.90E−09 |
| 965 | CGPG2963.pep | C1_3 | 391 | 420 | 40.1 | 8.20E−09 |
| 965 | CGPG2963.pep | C1_3 | 494 | 522 | 25.6 | 0.00018 |

TABLE 21-continued

| PEP Seq ID No. | Construct ID | Pfam domain name | Begin | Stop | score | E-value |
|---|---|---|---|---|---|---|
| 965 | CGPG2963.pep | C1_3 | 551 | 581 | 27.5 | 5.00E−05 |
| 965 | CGPG2963.pep | C1_2 | 552 | 581 | 47.9 | 3.50E−11 |
| 966 | CGPG2987.pep | SRF-TF | 11 | 66 | 24.4 | 0.00041 |
| 968 | CGPG3045.pep | Pkinase | 82 | 356 | 192 | 1.50E−54 |
| 968 | CGPG3045.pep | Pkinase_Tyr | 82 | 356 | 254 | 3.20E−73 |
| 969 | CGPG3046.pep | AAA | 121 | 305 | 245.7 | 1.00E−70 |
| 970 | CGPG3060.pep | p450 | 67 | 528 | 268 | 1.90E−77 |
| 971 | CGPG3075.pep | Auxin_inducible | 7 | 106 | 121 | 3.50E−33 |
| 972 | CGPG310.pep | Cyclin_N | 18 | 143 | 31.8 | 1.80E−07 |
| 973 | CGPG3103.pep | PPR | 14 | 48 | 10.8 | 0.4 |
| 973 | CGPG3103.pep | PPR | 49 | 83 | 37.5 | 4.80E−08 |
| 973 | CGPG3103.pep | PPR | 84 | 118 | 38.8 | 1.90E−08 |
| 973 | CGPG3103.pep | PPR | 119 | 153 | 11.8 | 0.31 |
| 973 | CGPG3103.pep | PPR | 155 | 188 | 27.6 | 4.50E−05 |
| 973 | CGPG3103.pep | PPR | 189 | 223 | 34.8 | 3.20E−07 |
| 973 | CGPG3103.pep | PPR | 224 | 258 | 36.8 | 7.80E−08 |
| 973 | CGPG3103.pep | PPR | 259 | 293 | 7.7 | 0.95 |
| 973 | CGPG3103.pep | PPR | 295 | 329 | 39.7 | 1.10E−08 |
| 973 | CGPG3103.pep | PPR | 330 | 364 | 12.6 | 0.25 |
| 973 | CGPG3103.pep | PPR | 365 | 398 | 30.4 | 6.70E−06 |
| 974 | CGPG315.pep | p450 | 29 | 491 | 346.8 | 3.80E−101 |
| 976 | CGPG3189.pep | RRM_1 | 115 | 186 | 101.9 | 2.00E−27 |
| 976 | CGPG3189.pep | RRM_1 | 209 | 280 | 104.9 | 2.40E−28 |
| 977 | CGPG3204.pep | KH_1 | 45 | 104 | 53.4 | 7.60E−13 |
| 977 | CGPG3204.pep | KH_1 | 151 | 221 | 58.6 | 2.20E−14 |
| 977 | CGPG3204.pep | KH_1 | 318 | 381 | 44.6 | 3.60E−10 |
| 977 | CGPG3204.pep | KH_2 | 318 | 365 | 11.3 | 0.019 |
| 977 | CGPG3204.pep | KH_1 | 400 | 467 | 63.4 | 7.50E−16 |
| 977 | CGPG3204.pep | KH_1 | 575 | 637 | 53.3 | 8.70E−13 |
| 978 | CGPG3208.pep | MATH | 26 | 153 | 47.1 | 6.00E−11 |
| 978 | CGPG3208.pep | MATH | 180 | 302 | 18.3 | 0.0015 |
| 979 | CGPG3219.pep | 2OG-FeII_Oxy | 220 | 320 | 161.1 | 2.90E−45 |
| 980 | CGPG3233.pep | PPR | 160 | 194 | 21.8 | 0.0026 |
| 980 | CGPG3233.pep | PPR | 195 | 229 | 9.6 | 0.56 |
| 980 | CGPG3233.pep | PPR | 231 | 265 | 24.1 | 0.00052 |
| 980 | CGPG3233.pep | PPR | 266 | 300 | 40.7 | 5.10E−09 |
| 980 | CGPG3233.pep | PPR | 301 | 335 | 44 | 5.30E−10 |
| 980 | CGPG3233.pep | PPR | 336 | 370 | 45.3 | 2.20E−10 |
| 980 | CGPG3233.pep | PPR | 371 | 405 | 44.7 | 3.30E−10 |
| 980 | CGPG3233.pep | PPR | 406 | 440 | 7.4 | 1 |
| 981 | CGPG3263.pep | Tryp_alpha_amyl | 28 | 104 | 36.6 | 8.90E−08 |
| 982 | CGPG3276.pep | ECH | 11 | 186 | 48.1 | 3.10E−11 |
| 984 | CGPG3282.pep | Steroid_dh | 117 | 268 | 65.5 | 1.80E−16 |
| 985 | CGPG3300.pep | zf-CCHC | 55 | 72 | 30.4 | 6.40E−06 |
| 985 | CGPG3300.pep | zf-CCHC | 74 | 91 | 26.8 | 7.80E−05 |
| 985 | CGPG3300.pep | zf-CCHC | 93 | 110 | 29.8 | 1.00E−05 |
| 985 | CGPG3300.pep | zf-CCHC | 112 | 129 | 27.3 | 5.70E−05 |
| 985 | CGPG3300.pep | zf-CCHC | 138 | 155 | 23.8 | 0.00038 |
| 985 | CGPG3300.pep | zf-CCHC | 157 | 174 | 24.9 | 0.00026 |
| 985 | CGPG3300.pep | zf-CCHC | 229 | 246 | 26.5 | 9.70E−05 |
| 986 | CGPG3318.pep | Peptidase_C14 | 3 | 416 | 273.4 | 4.50E−79 |
| 987 | CGPG3319.pep | AP2 | 28 | 79 | 61.2 | 3.40E−15 |
| 988 | CGPG3326.pep | zf-C3HC4 | 259 | 299 | 36.8 | 7.90E−08 |
| 989 | CGPG333.pep | PTS_2-RNA | 48 | 239 | 409.9 | 3.80E−120 |
| 990 | CGPG3338.pep | Alba | 17 | 87 | 114.8 | 2.50E−31 |
| 991 | CGPG334.pep | Mov34 | 20 | 128 | 65.2 | 2.20E−16 |
| 992 | CGPG3374.pep | peroxidase | 42 | 286 | 426.2 | 4.60E−125 |
| 993 | CGPG3402.pep | Dimerisation | 30 | 89 | 93.1 | 8.60E−25 |
| 993 | CGPG3402.pep | Methyltransf_2 | 99 | 342 | 287.6 | 2.40E−83 |
| 995 | CGPG3413.pep | WD40 | 168 | 207 | 41.5 | 3.10E−09 |
| 995 | CGPG3413.pep | U3_snoRNA_C | 377 | 523 | 212.3 | 1.10E−60 |
| 996 | CGPG3422.pep | WD40 | 241 | 279 | 41.2 | 3.70E−09 |
| 996 | CGPG3422.pep | WD40 | 387 | 425 | 35.3 | 2.20E−07 |
| 996 | CGPG3422.pep | WD40 | 519 | 559 | 21.9 | 0.0024 |
| 997 | CGPG3436.pep | DUF6 | 17 | 144 | 33.8 | 6.40E−07 |
| 997 | CGPG3436.pep | DUF6 | 198 | 327 | 50.4 | 6.10E−12 |
| 998 | CGPG3539.pep | Mito_carr | 11 | 105 | 84.6 | 3.10E−22 |
| 998 | CGPG3539.pep | Mito_carr | 113 | 209 | 115.7 | 1.40E−31 |
| 998 | CGPG3539.pep | Mito_carr | 214 | 303 | 102.2 | 1.60E−27 |
| 999 | CGPG3550.pep | FAE1_CUT1_RppA | 81 | 370 | 700.9 | 9.60E−208 |
| 999 | CGPG3550.pep | Chal_sti_synt_C | 327 | 470 | 2.6 | 0.0011 |
| 999 | CGPG3550.pep | ACP_syn_III_C | 384 | 468 | 21.5 | 8.90E−08 |
| 1000 | CGPG3551.pep | Pkinase | 9 | 273 | 145.9 | 1.10E−40 |
| 1001 | CGPG3552.pep | Aldedh | 23 | 441 | 176.5 | 6.90E−50 |
| 1002 | CGPG3572.pep | FA_hydroxylase | 112 | 225 | 133.2 | 7.50E−37 |
| 1004 | CGPG3599.pep | DUF579 | 51 | 289 | 588.5 | 6.70E−174 |
| 1008 | CGPG364.pep | zf-C3HC4 | 97 | 137 | 51 | 4.30E−12 |
| 1010 | CGPG3679.pep | malic | 36 | 179 | 249.1 | 9.50E−72 |

TABLE 21-continued

| PEP Seq ID No. | Construct ID | Pfam domain name | Begin | Stop | score | E-value |
|---|---|---|---|---|---|---|
| 1010 | CGPG3679.pep | Malic_M | 181 | 418 | 426.3 | 4.30E−125 |
| 1010 | CGPG3679.pep | PTA_PTB | 446 | 768 | 457.7 | 1.60E−134 |
| 1011 | CGPG3686.pep | Gp_dh_N | 2 | 150 | 334.5 | 1.80E−97 |
| 1011 | CGPG3686.pep | Gp_dh_C | 155 | 312 | 388.4 | 1.10E−113 |
| 1012 | CGPG3694.pep | LRRNT_2 | 38 | 78 | 64.2 | 4.40E−16 |
| 1012 | CGPG3694.pep | LRR_1 | 106 | 128 | 11.7 | 2.1 |
| 1012 | CGPG3694.pep | LRR_1 | 130 | 152 | 14.2 | 0.48 |
| 1012 | CGPG3694.pep | LRR_1 | 154 | 176 | 16.7 | 0.089 |
| 1012 | CGPG3694.pep | LRR_1 | 178 | 201 | 11.7 | 2.1 |
| 1012 | CGPG3694.pep | Pkinase | 312 | 583 | 104.7 | 2.80E−28 |
| 1012 | CGPG3694.pep | Pkinase_Tyr | 312 | 583 | 110.8 | 4.20E−30 |
| 1013 | CGPG3696.pep | MMR_HSR1 | 136 | 257 | 120.2 | 5.90E−33 |
| 1014 | CGPG3698.pep | WD40 | 104 | 142 | 31.6 | 2.80E−06 |
| 1014 | CGPG3698.pep | WD40 | 234 | 272 | 22.5 | 0.0016 |
| 1015 | CGPG3699.pep | adh_short | 19 | 187 | 111.6 | 2.30E−30 |
| 1015 | CGPG3699.pep | KR | 19 | 203 | −54.2 | 0.00034 |
| 1016 | CGPG3702.pep | SAM_2 | 227 | 293 | 48.9 | 1.80E−11 |
| 1016 | CGPG3702.pep | SAM_1 | 228 | 291 | 52.7 | 1.30E−12 |
| 1017 | CGPG3703.pep | ENOD93 | 25 | 103 | 190.1 | 5.50E−54 |
| 1018 | CGPG3707.pep | Pkinase | 42 | 333 | 296.2 | 6.30E−86 |
| 1019 | CGPG3710.pep | VQ | 118 | 148 | 45.7 | 1.60E−10 |
| 1020 | CGPG3730.pep | DUF167 | 140 | 216 | 99.7 | 9.10E−27 |
| 1021 | CGPG3731.pep | DUF616 | 194 | 508 | 769.9 | 1.60E−228 |
| 1022 | CGPG3734.pep | PRK | 46 | 233 | 177.1 | 4.40E−50 |
| 1022 | CGPG3734.pep | Pribosyltran | 280 | 425 | 5.8 | 0.00083 |
| 1023 | CGPG3745.pep | RRM_1 | 386 | 455 | 66.7 | 7.80E−17 |
| 1023 | CGPG3745.pep | RRM_1 | 481 | 553 | 49.6 | 1.10E−11 |
| 1024 | CGPG3764.pep | Response_reg | 20 | 145 | 67.1 | 5.90E−17 |
| 1026 | CGPG3851.pep | SH3_1 | 284 | 338 | 42.4 | 1.60E−09 |
| 1026 | CGPG3851.pep | SH3_2 | 285 | 338 | 30.1 | 8.10E−06 |
| 1027 | CGPG3911.pep | Aldedh | 104 | 587 | 526.9 | 2.20E−155 |
| 1028 | CGPG3948.pep | NAP | 50 | 295 | 467.9 | 1.30E−137 |
| 1031 | CGPG3996.pep | Inositol_P | 6 | 267 | 363.1 | 4.60E−106 |
| 1032 | CGPG4006.pep | ENT | 1 | 74 | 140.3 | 5.60E−39 |
| 1033 | CGPG4025.pep | SQS_PSY | 44 | 331 | 455.8 | 5.80E−134 |
| 1034 | CGPG4028.pep | Transket_pyr | 398 | 565 | 233 | 6.90E−67 |
| 1034 | CGPG4028.pep | Transketolase_C | 579 | 702 | 152.2 | 1.40E−42 |
| 1035 | CGPG403.pep | Pkinase | 78 | 336 | 354.1 | 2.40E−103 |
| 1036 | CGPG4041.pep | DEAD | 141 | 315 | 219 | 1.10E−62 |
| 1036 | CGPG4041.pep | Helicase_C | 386 | 462 | 120.8 | 4.10E−33 |
| 1037 | CGPG4078.pep | GST_C | 180 | 283 | 23.1 | 0.00038 |
| 1038 | CGPG4079.pep | RRS1 | 1 | 178 | 271.1 | 2.30E−78 |
| 1041 | CGPG4104.pep | LRRNT_2 | 30 | 67 | 33.1 | 1.00E−06 |
| 1041 | CGPG4104.pep | LRR_1 | 95 | 117 | 11.4 | 2.3 |
| 1041 | CGPG4104.pep | LRR_1 | 119 | 141 | 15.5 | 0.21 |
| 1041 | CGPG4104.pep | LRR_1 | 143 | 165 | 12.1 | 1.8 |
| 1041 | CGPG4104.pep | LRR_1 | 167 | 188 | 16.1 | 0.13 |
| 1041 | CGPG4104.pep | Pkinase | 367 | 633 | 99.2 | 1.30E−26 |
| 1042 | CGPG4127.pep | Hydrolase | 43 | 239 | 93.3 | 7.50E−25 |
| 1043 | CGPG4135.pep | Pkinase | 118 | 376 | 357.9 | 1.70E−104 |
| 1043 | CGPG4135.pep | efhand | 423 | 451 | 41.5 | 3.10E−09 |
| 1043 | CGPG4135.pep | efhand | 459 | 487 | 24.8 | 0.00033 |
| 1043 | CGPG4135.pep | efhand | 495 | 523 | 30.6 | 5.70E−06 |
| 1043 | CGPG4135.pep | efhand | 529 | 557 | 40.3 | 7.00E−09 |
| 1044 | CGPG4161.pep | Methyltransf_11 | 56 | 159 | 48 | 3.30E−11 |
| 1044 | CGPG4161.pep | Methyltransf_12 | 56 | 157 | 31.8 | 2.40E−06 |
| 1045 | CGPG4180.pep | GHMP_kinases_N | 152 | 219 | 64.2 | 4.40E−16 |
| 1045 | CGPG4180.pep | GHMP_kinases_C | 382 | 466 | 58.4 | 2.50E−14 |
| 1046 | CGPG4191.pep | Bombesin | 163 | 176 | 14.8 | 0.16 |
| 1047 | CGPG4199.pep | Copine | 117 | 265 | 295.3 | 1.20E−85 |
| 1047 | CGPG4199.pep | zf-C3HC4 | 385 | 417 | 16.2 | 0.0013 |
| 1048 | CGPG4241.pep | GASA | 3 | 99 | 179.9 | 6.40E−51 |
| 1049 | CGPG427.pep | Pkinase | 8 | 262 | 210 | 5.80E−60 |
| 1049 | CGPG427.pep | Pkinase_Tyr | 8 | 262 | 248 | 2.10E−71 |
| 1050 | CGPG4273.pep | dsrm | 2 | 68 | 70 | 7.70E−18 |
| 1050 | CGPG4273.pep | dsrm | 88 | 153 | 66.9 | 6.90E−17 |
| 1051 | CGPG4301.pep | 2OG-FeII_Oxy | 151 | 253 | 97 | 6.00E−26 |
| 1052 | CGPG4303.pep | Rhodanese | 13 | 114 | 64.9 | 2.70E−16 |
| 1053 | CGPG4313.pep | G6PD_N | 94 | 273 | 322.4 | 8.50E−94 |
| 1053 | CGPG4313.pep | G6PD_C | 276 | 573 | 522.2 | 6.00E−154 |
| 1054 | CGPG4314.pep | AWPM-19 | 15 | 156 | 335.5 | 9.50E−98 |
| 1055 | CGPG4329.pep | AA_kinase | 86 | 324 | 201.9 | 1.60E−57 |
| 1056 | CGPG4330.pep | PALP | 53 | 341 | 418.6 | 9.40E−123 |
| 1057 | CGPG4338.pep | Proteasome | 21 | 217 | 157.3 | 4.00E−44 |
| 1058 | CGPG4341.pep | Mito_carr | 51 | 134 | 78 | 3.10E−20 |
| 1058 | CGPG4341.pep | Mito_carr | 158 | 246 | 81.5 | 2.80E−21 |
| 1058 | CGPG4341.pep | Mito_carr | 252 | 343 | 82.8 | 1.10E−21 |
| 1061 | CGPG4386.pep | GHMP_kinases_N | 113 | 171 | 55.4 | 1.90E−13 |

TABLE 21-continued

| PEP Seq ID No. | Construct ID | Pfam domain name | Begin | Stop | score | E-value |
|---|---|---|---|---|---|---|
| 1061 | CGPG4386.pep | GHMP_kinases_C | 245 | 338 | 29.5 | 1.20E−05 |
| 1062 | CGPG4394.pep | p450 | 39 | 503 | 389.1 | 7.00E−114 |
| 1063 | CGPG4396.pep | p450 | 39 | 504 | 355.6 | 8.20E−104 |
| 1064 | CGPG4400.pep | p450 | 32 | 474 | 146.7 | 6.70E−41 |
| 1065 | CGPG4401.pep | p450 | 47 | 511 | 383.1 | 4.60E−112 |
| 1066 | CGPG441.pep | Chalcone | 14 | 225 | 498.4 | 8.60E−147 |
| 1067 | CGPG4413.pep | p450 | 32 | 547 | 286.5 | 5.20E−83 |
| 1068 | CGPG4427.pep | p450 | 57 | 530 | 225.1 | 1.60E−64 |
| 1069 | CGPG4446.pep | p450 | 43 | 504 | 275.6 | 1.00E−79 |
| 1070 | CGPG4448.pep | p450 | 32 | 486 | 332.3 | 8.70E−97 |
| 1071 | CGPG4474.pep | Band_7 | 33 | 212 | 136.8 | 5.90E−38 |
| 1072 | CGPG4482.pep | peroxidase | 47 | 291 | 314.4 | 2.10E−91 |
| 1073 | CGPG4511.pep | VHS | 36 | 166 | 58.2 | 2.80E−14 |
| 1073 | CGPG4511.pep | GAT | 227 | 315 | 18.1 | 2.80E−05 |
| 1074 | CGPG4517.pep | Aldo_ket_red | 5 | 292 | 460.6 | 2.10E−135 |
| 1075 | CGPG4551.pep | XS | 30 | 148 | 250.2 | 4.60E−72 |
| 1075 | CGPG4551.pep | XH | 418 | 557 | 251.6 | 1.70E−72 |
| 1077 | CGPG4567.pep | SRF-TF | 3 | 53 | 85.4 | 1.80E−22 |
| 1078 | CGPG4586.pep | RRM_1 | 8 | 73 | 41.5 | 2.90E−09 |
| 1079 | CGPG4600.pep | zf-CCCH | 13 | 39 | 35.4 | 2.00E−07 |
| 1079 | CGPG4600.pep | zf-CCCH | 149 | 174 | 24.1 | 0.00053 |
| 1080 | CGPG4631.pep | C1_3 | 87 | 115 | 40.8 | 4.80E−09 |
| 1080 | CGPG4631.pep | C1_2 | 88 | 115 | 41.2 | 3.80E−09 |
| 1080 | CGPG4631.pep | C1_3 | 208 | 237 | 39.4 | 1.30E−08 |
| 1080 | CGPG4631.pep | C1_2 | 209 | 237 | 45.5 | 1.80E−10 |
| 1080 | CGPG4631.pep | C1_3 | 264 | 292 | 48.3 | 2.70E−11 |
| 1080 | CGPG4631.pep | C1_2 | 319 | 349 | 41.5 | 2.90E−09 |
| 1080 | CGPG4631.pep | C1_3 | 404 | 433 | 55.4 | 1.90E−13 |
| 1080 | CGPG4631.pep | C1_2 | 566 | 595 | 40.8 | 4.70E−09 |
| 1081 | CGPG4642.pep | Pyridoxal_deC | 63 | 412 | 126.5 | 7.90E−35 |
| 1082 | CGPG4645.pep | Cu-oxidase_3 | 31 | 148 | 198.9 | 1.30E−56 |
| 1082 | CGPG4645.pep | Cu-oxidase | 157 | 325 | 222.3 | 1.10E−63 |
| 1082 | CGPG4645.pep | Cu-oxidase_2 | 414 | 551 | 155.1 | 2.00E−43 |
| 1083 | CGPG4646.pep | efhand_like | 27 | 105 | 109.6 | 9.60E−30 |
| 1083 | CGPG4646.pep | PI-PLC-X | 108 | 251 | 143.6 | 5.60E−40 |
| 1083 | CGPG4646.pep | PI-PLC-Y | 332 | 450 | 93.9 | 5.20E−25 |
| 1083 | CGPG4646.pep | C2 | 471 | 563 | 82.3 | 1.50E−21 |
| 1084 | CGPG4649.pep | SMP | 14 | 72 | 102 | 1.90E−27 |
| 1084 | CGPG4649.pep | SMP | 130 | 191 | 127.6 | 3.60E−35 |
| 1084 | CGPG4649.pep | SMP | 195 | 256 | 62.7 | 1.30E−15 |
| 1085 | CGPG4653.pep | DUF1637 | 47 | 280 | 366.2 | 5.30E−107 |
| 1087 | CGPG4668.pep | SYF2 | 140 | 306 | 301.7 | 1.50E−87 |
| 1088 | CGPG469.pep | tRNA-synt_1c | 213 | 518 | 428.8 | 7.70E−126 |
| 1088 | CGPG469.pep | tRNA-synt_1c_C | 520 | 697 | 229.4 | 8.00E−66 |
| 1089 | CGPG4708.pep | Sulfate_transp | 172 | 482 | 504.9 | 9.60E−149 |
| 1089 | CGPG4708.pep | STAS | 505 | 623 | 142.8 | 9.80E−40 |
| 1090 | CGPG4712.pep | Mem_trans | 9 | 565 | 715.3 | 4.30E−212 |
| 1091 | CGPG4714.pep | DUF231 | 248 | 423 | 336.8 | 3.80E−98 |
| 1092 | CGPG4719.pep | Response_reg | 37 | 153 | 91.6 | 2.50E−24 |
| 1092 | CGPG4719.pep | CCT | 417 | 461 | 85 | 2.40E−22 |
| 1093 | CGPG473.pep | Peptidase_M16 | 88 | 234 | 184 | 3.90E−52 |
| 1093 | CGPG473.pep | Peptidase_M16_C | 239 | 423 | 161.3 | 2.70E−45 |
| 1094 | CGPG4734.pep | Auxin_inducible | 19 | 119 | 55.4 | 1.90E−13 |
| 1095 | CGPG4736.pep | Pribosyltran | 225 | 358 | 139.9 | 7.20E−39 |
| 1096 | CGPG474.pep | Pro_isomerase | 6 | 172 | 426 | 5.20E−125 |
| 1102 | CGPG4850.pep | PMEI | 25 | 174 | 138.8 | 1.60E−38 |
| 1103 | CGPG4868.pep | PsbW | 1 | 133 | 333 | 5.40E−97 |
| 1104 | CGPG4871.pep | Tryp_alpha_amyl | 52 | 133 | 98.3 | 2.30E−26 |
| 1105 | CGPG488.pep | Histone | 19 | 92 | 110.5 | 5.00E−30 |
| 1105 | CGPG488.pep | CBFD_NFYB_HMF | 25 | 89 | 20.6 | 0.002 |
| 1106 | CGPG4908.pep | WD40 | 16 | 54 | 22.1 | 0.002 |
| 1106 | CGPG4908.pep | WD40 | 63 | 101 | 22.2 | 0.002 |
| 1108 | CGPG4921.pep | WD40 | 202 | 241 | 26.8 | 7.90E−05 |
| 1108 | CGPG4921.pep | WD40 | 253 | 291 | 41.3 | 3.40E−09 |
| 1108 | CGPG4921.pep | WD40 | 295 | 333 | 33.5 | 7.40E−07 |
| 1108 | CGPG4921.pep | WD40 | 337 | 375 | 47.3 | 5.20E−11 |
| 1108 | CGPG4921.pep | WD40 | 472 | 510 | 25.7 | 0.00017 |
| 1109 | CGPG4954.pep | LRRNT_2 | 33 | 72 | 38.6 | 2.20E−08 |
| 1109 | CGPG4954.pep | LRR_1 | 76 | 98 | 9 | 6.5 |
| 1109 | CGPG4954.pep | LRR_1 | 100 | 122 | 12.7 | 1.4 |
| 1109 | CGPG4954.pep | LRR_1 | 124 | 145 | 8 | 10 |
| 1110 | CGPG4956.pep | Asp | 141 | 482 | −61.6 | 5.90E−10 |
| 1111 | CGPG4959.pep | adh_short | 15 | 183 | 94.8 | 2.80E−25 |
| 1111 | CGPG4959.pep | KR | 16 | 200 | −64.6 | 0.0014 |
| 1112 | CGPG4965.pep | zf-A20 | 15 | 39 | 32.9 | 1.20E−06 |
| 1112 | CGPG4965.pep | zf-AN1 | 114 | 154 | 64.5 | 3.50E−16 |
| 1113 | CGPG4970.pep | GASA | 1 | 108 | 225.3 | 1.40E−64 |
| 1114 | CGPG4980.pep | U-box | 73 | 147 | 95.4 | 1.80E−25 |

TABLE 21-continued

| PEP Seq ID No. | Construct ID | Pfam domain name | Begin | Stop | score | E-value |
|---|---|---|---|---|---|---|
| 1114 | CGPG4980.pep | Arm | 246 | 287 | 20.1 | 0.0085 |
| 1114 | CGPG4980.pep | Arm | 288 | 328 | 22.4 | 0.0017 |
| 1115 | CGPG4982.pep | F-box | 2 | 49 | 42.8 | 1.20E−09 |
| 1115 | CGPG4982.pep | FBA_1 | 209 | 387 | 313.8 | 3.20E−91 |
| 1116 | CGPG4985.pep | CPSase_sm_chain | 56 | 203 | 298.5 | 1.30E−86 |
| 1116 | CGPG4985.pep | GATase | 245 | 422 | 238.5 | 1.50E−68 |
| 1117 | CGPG4990.pep | LRRNT_2 | 73 | 112 | 28.9 | 1.90E−05 |
| 1117 | CGPG4990.pep | LRR_1 | 139 | 161 | 13.9 | 0.59 |
| 1117 | CGPG4990.pep | LRR_1 | 163 | 183 | 13.6 | 0.73 |
| 1117 | CGPG4990.pep | LRR_1 | 187 | 206 | 13.9 | 0.62 |
| 1117 | CGPG4990.pep | LRR_1 | 210 | 232 | 8.2 | 9.1 |
| 1117 | CGPG4990.pep | LRR_1 | 306 | 328 | 9.8 | 4.6 |
| 1118 | CGPG4991.pep | PALP | 164 | 473 | 254.7 | 2.00E−73 |
| 1119 | CGPG5007.pep | adh_short | 21 | 192 | 65.9 | 1.30E−16 |
| 1119 | CGPG5007.pep | Epimerase | 23 | 271 | −42.4 | 0.00053 |
| 1120 | CGPG5015.pep | adh_short | 13 | 126 | −22.3 | 0.00036 |
| 1121 | CGPG5026.pep | adh_short | 46 | 221 | 22.7 | 4.00E−07 |
| 1122 | CGPG5029.pep | adh_short | 80 | 252 | 70.7 | 4.90E−18 |
| 1123 | CGPG5046.pep | LRRNT_2 | 30 | 70 | 51.2 | 3.60E−12 |
| 1123 | CGPG5046.pep | LRR_1 | 99 | 121 | 9.2 | 6 |
| 1123 | CGPG5046.pep | LRR_1 | 123 | 145 | 10.5 | 3.4 |
| 1123 | CGPG5046.pep | LRR_1 | 147 | 169 | 15.8 | 0.16 |
| 1123 | CGPG5046.pep | Pkinase_Tyr | 306 | 573 | 109.4 | 1.10E−29 |
| 1123 | CGPG5046.pep | Pkinase | 306 | 573 | 145.6 | 1.40E−40 |
| 1124 | CGPG508.pep | Na_sulph_symp | 93 | 563 | 619 | 4.30E−183 |
| 1125 | CGPG5103.pep | C2 | 9 | 95 | 64.8 | 3.00E−16 |
| 1126 | CGPG511.pep | Rho_GDI | 22 | 222 | 43.8 | 6.70E−12 |
| 1127 | CGPG5121.pep | efhand_like | 30 | 113 | 41.4 | 3.20E−09 |
| 1127 | CGPG5121.pep | PI-PLC-X | 116 | 258 | 140.7 | 4.20E−39 |
| 1127 | CGPG5121.pep | PI-PLC-Y | 331 | 449 | 88.6 | 2.00E−23 |
| 1127 | CGPG5121.pep | C2 | 470 | 562 | 81.3 | 3.00E−21 |
| 1128 | CGPG5126.pep | peroxidase | 54 | 303 | 312 | 1.10E−90 |
| 1129 | CGPG5136.pep | p450 | 35 | 500 | 88.4 | 2.30E−23 |
| 1130 | CGPG5146.pep | p450 | 45 | 501 | 209 | 1.10E−59 |
| 1131 | CGPG5149.pep | p450 | 31 | 478 | 306.7 | 4.40E−89 |
| 1132 | CGPG5181.pep | Pkinase | 278 | 540 | 112.7 | 1.10E−30 |
| 1133 | CGPG52.pep | Sugar_tr | 32 | 472 | −75.6 | 5.00E−06 |
| 1134 | CGPG5206.pep | UDPG_MGDP_dh_N | 2 | 200 | 331.6 | 1.40E−96 |
| 1134 | CGPG5206.pep | UDPG_MGDP_dh | 209 | 306 | 189.1 | 1.10E−53 |
| 1134 | CGPG5206.pep | UDPG_MGDP_dh_C | 328 | 452 | 183.7 | 4.70E−52 |
| 1136 | CGPG5232.pep | Pkinase | 71 | 328 | 295.9 | 8.10E−86 |
| 1137 | CGPG5239.pep | Copine | 136 | 284 | 331.7 | 1.30E−96 |
| 1138 | CGPG5246.pep | ABC_tran | 94 | 285 | 132.8 | 9.70E−37 |
| 1138 | CGPG5246.pep | ABC_tran | 406 | 571 | 146.2 | 9.10E−41 |
| 1139 | CGPG525.pep | CDP-OH_P_transf | 138 | 277 | 132.1 | 1.60E−36 |
| 1140 | CGPG5268.pep | CDC50 | 65 | 368 | 681.3 | 7.50E−202 |
| 1141 | CGPG5272.pep | AA_permease | 153 | 621 | 569.2 | 4.10E−168 |
| 1142 | CGPG5333.pep | MFS_1 | 55 | 468 | 76 | 1.30E−19 |
| 1142 | CGPG5333.pep | Sugar_tr | 89 | 515 | 21.1 | 8.20E−10 |
| 1143 | CGPG5338.pep | RRM_1 | 8 | 77 | 90.6 | 5.10E−24 |
| 1143 | CGPG5338.pep | RRM_1 | 108 | 178 | 82.6 | 1.30E−21 |
| 1144 | CGPG5341.pep | F-box | 33 | 79 | 31.7 | 2.60E−06 |
| 1145 | CGPG5369.pep | AA_kinase | 83 | 366 | 213.4 | 5.30E−61 |
| 1145 | CGPG5369.pep | ACT | 400 | 469 | 20.9 | 0.0047 |
| 1145 | CGPG5369.pep | ACT | 477 | 539 | 9.7 | 0.71 |
| 1146 | CGPG5372.pep | SBF | 142 | 322 | 125.7 | 1.30E−34 |
| 1147 | CGPG5380.pep | Tyr-DNA_phospho | 137 | 581 | 1043.5 | 0 |
| 1148 | CGPG5386.pep | MOSC_N | 4 | 132 | 245 | 1.70E−70 |
| 1148 | CGPG5386.pep | MOSC | 138 | 296 | 66.5 | 8.80E−17 |
| 1149 | CGPG5396.pep | PALP | 9 | 297 | 469.3 | 5.00E−138 |
| 1150 | CGPG5397.pep | PDT | 128 | 307 | 347.9 | 1.70E−101 |
| 1151 | CGPG5421.pep | Pre-SET | 119 | 267 | 14.7 | 2.20E−05 |
| 1151 | CGPG5421.pep | SET | 269 | 414 | 151.3 | 2.60E−42 |
| 1152 | CGPG5433.pep | MtN3_slv | 10 | 98 | 144.3 | 3.30E−40 |
| 1152 | CGPG5433.pep | MtN3_slv | 132 | 218 | 145.4 | 1.50E−40 |
| 1153 | CGPG5439.pep | LANC_like | 69 | 410 | 459.8 | 3.60E−135 |
| 1154 | CGPG5453.pep | Mito_carr | 14 | 116 | 102 | 1.80E−27 |
| 1154 | CGPG5453.pep | Mito_carr | 125 | 215 | 98.8 | 1.60E−26 |
| 1154 | CGPG5453.pep | Mito_carr | 233 | 334 | 104 | 4.60E−28 |
| 1155 | CGPG5456.pep | Mito_carr | 78 | 175 | 128.9 | 1.50E−35 |
| 1155 | CGPG5456.pep | Mito_carr | 183 | 279 | 100.4 | 5.50E−27 |
| 1155 | CGPG5456.pep | Mito_carr | 283 | 373 | 91.5 | 2.70E−24 |
| 1156 | CGPG5483.pep | PP2C | 66 | 369 | 92.8 | 1.10E−24 |
| 1157 | CGPG5492.pep | FAE1_CUT1_RppA | 61 | 358 | 683.7 | 1.40E−202 |
| 1157 | CGPG5492.pep | Chal_sti_synt_C | 312 | 458 | −1.1 | 0.0023 |
| 1157 | CGPG5492.pep | ACP_syn_III_C | 372 | 456 | 4.3 | 5.30E−06 |
| 1158 | CGPG5508.pep | RCC1 | 310 | 359 | 23.9 | 0.00059 |
| 1158 | CGPG5508.pep | RCC1 | 413 | 462 | 39 | 1.70E−08 |

TABLE 21-continued

| PEP Seq ID No. | Construct ID | Pfam domain name | Begin | Stop | score | E-value |
|---|---|---|---|---|---|---|
| 1158 | CGPG5508.pep | RCC1 | 478 | 526 | 32.5 | 1.50E−06 |
| 1158 | CGPG5508.pep | RCC1 | 582 | 630 | 28.9 | 1.80E−05 |
| 1158 | CGPG5508.pep | FYVE | 633 | 701 | 44.7 | 3.30E−10 |
| 1158 | CGPG5508.pep | DZC | 967 | 1002 | 74 | 4.80E−19 |
| 1159 | CGPG5520.pep | TFIID-31 kDa | 19 | 152 | 319.5 | 6.10E−93 |
| 1160 | CGPG5525.pep | PRMT5 | 187 | 679 | 1145.5 | 0 |
| 1161 | CGPG5526.pep | Pkinase | 8 | 295 | 335.7 | 8.20E−98 |
| 1162 | CGPG5530.pep | Response_reg | 504 | 644 | 85.4 | 1.80E−22 |
| 1163 | CGPG5534.pep | Y_phosphatase2 | 3 | 169 | 331.1 | 2.00E−96 |
| 1164 | CGPG5537.pep | TBP | 62 | 147 | 136.9 | 5.90E−38 |
| 1164 | CGPG5537.pep | TBP | 152 | 238 | 157.1 | 4.70E−44 |
| 1165 | CGPG5545.pep | CBS | 35 | 175 | 26.9 | 7.50E−05 |
| 1165 | CGPG5545.pep | CBS | 193 | 318 | 80.7 | 4.60E−21 |
| 1166 | CGPG555.pep | PALP | 104 | 396 | 325.8 | 7.90E−95 |
| 1166 | CGPG555.pep | Thr_dehydrat_C | 409 | 498 | 105.4 | 1.70E−28 |
| 1166 | CGPG555.pep | Thr_dehydrat_C | 504 | 591 | 126.4 | 8.20E−35 |
| 1167 | CGPG5558.pep | Cyclin_N | 212 | 337 | 208.5 | 1.60E−59 |
| 1167 | CGPG5558.pep | Cyclin_C | 339 | 458 | 141 | 3.30E−39 |
| 1168 | CGPG5559.pep | Suc_Fer-like | 69 | 311 | 370.5 | 2.70E−108 |
| 1169 | CGPG5562.pep | Suc_Fer-like | 59 | 308 | 60.7 | 4.90E−15 |
| 1170 | CGPG5592.pep | Rho_GDI | 35 | 239 | 71.2 | 3.40E−18 |
| 1171 | CGPG5625.pep | LRR_1 | 433 | 455 | 20.5 | 0.0061 |
| 1171 | CGPG5625.pep | LRR_1 | 457 | 476 | 11.7 | 2.1 |
| 1171 | CGPG5625.pep | Pkinase | 586 | 854 | 138.6 | 1.80E−38 |
| 1171 | CGPG5625.pep | Pkinase_Tyr | 587 | 854 | 123.3 | 7.00E−34 |
| 1172 | CGPG5631.pep | WAK | 171 | 270 | 186.4 | 7.00E−53 |
| 1172 | CGPG5631.pep | Pkinase_Tyr | 390 | 660 | 146.8 | 5.90E−41 |
| 1172 | CGPG5631.pep | Pkinase | 390 | 658 | 159.5 | 9.00E−45 |
| 1173 | CGPG5632.pep | Aldedh | 29 | 491 | 831.6 | 4.30E−247 |
| 1174 | CGPG5636.pep | Aldedh | 15 | 476 | 794.5 | 6.10E−236 |
| 1175 | CGPG5637.pep | Aldedh | 32 | 493 | 925.9 | 1.70E−275 |
| 1176 | CGPG564.pep | Aminotran_3 | 80 | 413 | 293.8 | 3.30E−85 |
| 1177 | CGPG5641.pep | Aldedh | 14 | 472 | 720.7 | 1.10E−213 |
| 1178 | CGPG5650.pep | Aminotran_3 | 32 | 374 | 476.5 | 3.50E−140 |
| 1179 | CGPG5653.pep | Aminotran_1_2 | 32 | 383 | 268.2 | 1.70E−77 |
| 1180 | CGPG5657.pep | Aldedh | 15 | 474 | 701.6 | 5.70E−208 |
| 1181 | CGPG5671.pep | Gp_dh_N | 3 | 151 | 356.5 | 4.40E−104 |
| 1181 | CGPG5671.pep | Gp_dh_C | 156 | 313 | 350.1 | 3.90E−102 |
| 1182 | CGPG5672.pep | Glutaminase | 24 | 309 | 615.7 | 4.20E−182 |
| 1183 | CGPG5677.pep | PGAM | 4 | 165 | 177.7 | 3.10E−50 |
| 1184 | CGPG5678.pep | Aminotran_1_2 | 35 | 385 | 204 | 3.60E−58 |
| 1185 | CGPG5679.pep | TIM | 7 | 248 | 398.9 | 8.00E−117 |
| 1186 | CGPG5682.pep | Aminotran_3 | 31 | 384 | 432.3 | 7.00E−127 |
| 1187 | CGPG5691.pep | PK | 5 | 350 | 699.4 | 2.60E−207 |
| 1187 | CGPG5691.pep | PK_C | 362 | 478 | 198.7 | 1.40E−56 |
| 1188 | CGPG5699.pep | Gp_dh_N | 3 | 155 | 274 | 3.00E−79 |
| 1188 | CGPG5699.pep | Gp_dh_C | 160 | 316 | 231.1 | 2.60E−66 |
| 1189 | CGPG5705.pep | NDK | 3 | 137 | 354.1 | 2.40E−103 |
| 1190 | CGPG5722.pep | Pyrophosphatase | 17 | 175 | 197.9 | 2.50E−56 |
| 1191 | CGPG5734.pep | Cyclin_N | 232 | 357 | 208.7 | 1.40E−59 |
| 1191 | CGPG5734.pep | Cyclin_C | 359 | 478 | 150 | 6.70E−42 |
| 1192 | CGPG5736.pep | PP2C | 22 | 280 | 398.6 | 9.20E−117 |
| 1193 | CGPG5744.pep | CDC50 | 63 | 365 | 697.3 | 1.20E−206 |
| 1194 | CGPG5747.pep | Pkinase | 23 | 318 | 294 | 2.90E−85 |
| 1195 | CGPG5748.pep | NAD_Gly3P_dh_N | 84 | 259 | 271 | 2.50E−78 |
| 1195 | CGPG5748.pep | NAD_Gly3P_dh_C | 282 | 432 | 282.8 | 6.90E−82 |
| 1198 | CGPG577.pep | Thioredoxin | 7 | 111 | 138.6 | 1.70E−38 |
| 1199 | CGPG5780.pep | AA_permease | 68 | 517 | −83.3 | 0.0017 |
| 1200 | CGPG5793.pep | AA_permease | 285 | 815 | 226.5 | 5.90E−65 |
| 1201 | CGPG5795.pep | Sugar_tr | 123 | 565 | 30.1 | 3.70E−10 |
| 1202 | CGPG5796.pep | Sugar_tr | 43 | 466 | 340.9 | 2.30E−99 |
| 1202 | CGPG5796.pep | MFS_1 | 47 | 417 | 74.4 | 3.70E−19 |
| 1203 | CGPG5800.pep | AA_permease | 86 | 546 | 489 | 5.90E−144 |
| 1204 | CGPG5812.pep | Pkinase | 22 | 273 | 334.2 | 2.30E−97 |
| 1204 | CGPG5812.pep | Pkinase_Tyr | 22 | 271 | 85.2 | 2.10E−22 |
| 1205 | CGPG5815.pep | Pkinase | 9 | 272 | 136.6 | 6.90E−38 |
| 1206 | CGPG5838.pep | Pkinase | 1 | 264 | 137.8 | 3.10E−38 |
| 1207 | CGPG5844.pep | Pkinase | 78 | 351 | 159.7 | 7.80E−45 |
| 1207 | CGPG5844.pep | Pkinase_Tyr | 78 | 351 | 122.7 | 1.10E−33 |
| 1208 | CGPG5846.pep | Pkinase_Tyr | 92 | 376 | 128.5 | 2.00E−35 |
| 1208 | CGPG5846.pep | Pkinase | 99 | 376 | 136.1 | 9.90E−38 |
| 1209 | CGPG5851.pep | Pkinase_Tyr | 121 | 401 | 138.2 | 2.30E−38 |
| 1209 | CGPG5851.pep | Pkinase | 121 | 401 | 139.5 | 9.70E−39 |
| 1210 | CGPG5857.pep | Pkinase | 19 | 273 | 159.1 | 1.20E−44 |
| 1211 | CGPG5862.pep | Pkinase | 181 | 447 | 99.8 | 8.50E−27 |
| 1211 | CGPG5862.pep | Pkinase_Tyr | 181 | 447 | 95.5 | 1.70E−25 |
| 1212 | CGPG5863.pep | Pkinase | 52 | 330 | 86.5 | 8.60E−23 |
| 1213 | CGPG5867.pep | Pkinase_Tyr | 142 | 423 | 94.1 | 4.50E−25 |

TABLE 21-continued

| PEP Seq ID No. | Construct ID | Pfam domain name | Begin | Stop | score | E-value |
|---|---|---|---|---|---|---|
| 1213 | CGPG5867.pep | Pkinase | 142 | 423 | 104 | 4.70E−28 |
| 1214 | CGPG5872.pep | Pkinase_Tyr | 18 | 288 | 125.8 | 1.20E−34 |
| 1214 | CGPG5872.pep | Pkinase | 18 | 288 | 153 | 7.90E−43 |
| 1215 | CGPG5913.pep | ADH_N | 28 | 109 | 95.4 | 1.80E−25 |
| 1215 | CGPG5913.pep | ADH_zinc_N | 140 | 284 | 151 | 3.30E−42 |
| 1217 | CGPG5961.pep | Biotin_lipoyl | 94 | 167 | 79.7 | 9.50E−21 |
| 1217 | CGPG5961.pep | 2-oxoacid_dh | 232 | 462 | 478 | 1.20E−140 |
| 1219 | CGPG5968.pep | Pribosyltran | 36 | 172 | 151.2 | 2.90E−42 |
| 1220 | CGPG5984.pep | Pkinase | 115 | 443 | 246.8 | 4.70E−71 |
| 1221 | CGPG5991.pep | LRR_1 | 266 | 293 | 9.3 | 5.7 |
| 1222 | CGPG6006.pep | RRM_1 | 19 | 89 | 81.3 | 3.10E−21 |
| 1223 | CGPG6015.pep | La | 14 | 85 | 101.3 | 3.00E−27 |
| 1223 | CGPG6015.pep | RRM_1 | 118 | 188 | 37.1 | 6.40E−08 |
| 1223 | CGPG6015.pep | RRM_3 | 302 | 404 | 142.2 | 1.40E−39 |
| 1224 | CGPG603.pep | G6PD_N | 35 | 222 | 342 | 1.00E−99 |
| 1224 | CGPG603.pep | G6PD_C | 224 | 508 | 655.5 | 4.50E−194 |
| 1225 | CGPG6046.pep | Str_synth | 179 | 266 | 137.2 | 4.80E−38 |
| 1226 | CGPG6063.pep | Nramp | 88 | 451 | 733.6 | 1.40E−217 |
| 1228 | CGPG6092.pep | SRPRB | 53 | 235 | 117.6 | 3.70E−32 |
| 1229 | CGPG6104.pep | Steroid_dh | 111 | 262 | 337.7 | 2.00E−98 |
| 1230 | CGPG6106.pep | LEA_5 | 1 | 92 | 209.3 | 9.10E−60 |
| 1231 | CGPG6111.pep | PP-binding | 48 | 115 | 75.2 | 2.10E−19 |
| 1232 | CGPG6113.pep | UQ_con | 7 | 143 | 205.4 | 1.40E−58 |
| 1234 | CGPG6132.pep | SMP | 13 | 71 | 121.1 | 3.30E−33 |
| 1234 | CGPG6132.pep | SMP | 135 | 196 | 113.9 | 4.90E−31 |
| 1234 | CGPG6132.pep | SMP | 200 | 262 | 105 | 2.30E−28 |
| 1236 | CGPG6147.pep | Redoxin | 74 | 234 | 181.5 | 2.20E−51 |
| 1236 | CGPG6147.pep | AhpC-TSA | 75 | 214 | 65.2 | 2.30E−16 |
| 1237 | CGPG6152.pep | Arf | 5 | 177 | 434.6 | 1.40E−127 |
| 1237 | CGPG6152.pep | SRPRB | 15 | 177 | −23.5 | 7.20E−06 |
| 1237 | CGPG6152.pep | Miro | 19 | 129 | 20.4 | 0.00012 |
| 1237 | CGPG6152.pep | Ras | 19 | 179 | −47.2 | 8.20E−06 |
| 1238 | CGPG6154.pep | Ion_trans_2 | 122 | 204 | 70 | 7.90E−18 |
| 1238 | CGPG6154.pep | Ion_trans_2 | 253 | 328 | 48.9 | 1.80E−11 |
| 1239 | CGPG6170.pep | UQ_con | 19 | 158 | 187.1 | 4.50E−53 |
| 1240 | CGPG6171.pep | Thioredoxin | 120 | 227 | 55.8 | 1.50E−13 |
| 1241 | CGPG6177.pep | AIG1 | 39 | 236 | 212.9 | 7.60E−61 |
| 1241 | CGPG6177.pep | MMR_HSR1 | 39 | 154 | 31.5 | 1.40E−06 |
| 1242 | CGPG6181.pep | Peptidase_C12 | 2 | 214 | 311.3 | 1.80E−90 |
| 1243 | CGPG6188.pep | Di19 | 10 | 217 | 479 | 6.00E−141 |
| 1244 | CGPG6202.pep | TB2_DP1_HVA22 | 9 | 106 | 191.2 | 2.60E−54 |
| 1245 | CGPG6217.pep | MFS_1 | 40 | 460 | 86.7 | 7.20E−23 |
| 1245 | CGPG6217.pep | Sugar_tr | 90 | 507 | −7.3 | 1.10E−08 |
| 1246 | CGPG623.pep | SATase_N | 45 | 149 | 210 | 5.60E−60 |
| 1246 | CGPG623.pep | Hexapep | 203 | 220 | 19.7 | 0.011 |
| 1246 | CGPG623.pep | Hexapep | 229 | 246 | 15.6 | 0.18 |
| 1246 | CGPG623.pep | Hexapep | 247 | 264 | 8 | 16 |
| 1247 | CGPG6239.pep | Sugar_tr | 27 | 458 | 289.4 | 7.10E−84 |
| 1247 | CGPG6239.pep | MFS_1 | 32 | 413 | 90.4 | 5.50E−24 |
| 1248 | CGPG6244.pep | Pkinase | 39 | 303 | 81.8 | 2.10E−21 |
| 1249 | CGPG6254.pep | Pkinase | 12 | 264 | 310.9 | 2.40E−90 |
| 1249 | CGPG6254.pep | Pkinase_Tyr | 12 | 261 | 75.1 | 2.20E−19 |
| 1249 | CGPG6254.pep | NAF | 292 | 352 | 103 | 9.50E−28 |
| 1251 | CGPG627.pep | His_biosynth | 48 | 289 | 33.3 | 4.00E−12 |
| 1252 | CGPG6271.pep | Pkinase | 191 | 527 | 227.5 | 3.00E−65 |
| 1253 | CGPG6278.pep | Pkinase_Tyr | 86 | 365 | 146.9 | 5.60E−41 |
| 1253 | CGPG6278.pep | Pkinase | 86 | 368 | 158.7 | 1.60E−44 |
| 1254 | CGPG6288.pep | Pkinase | 207 | 463 | 183.7 | 4.70E−52 |
| 1254 | CGPG6288.pep | Pkinase_Tyr | 207 | 463 | 207.1 | 4.10E−59 |
| 1255 | CGPG6309.pep | PRA1 | 29 | 181 | 233.1 | 6.50E−67 |
| 1256 | CGPG633.pep | DCP1 | 12 | 134 | 258.3 | 1.70E−74 |
| 1257 | CGPG635.pep | RmlD_sub_bind | 7 | 338 | −145.7 | 0.00034 |
| 1257 | CGPG635.pep | adh_short | 7 | 177 | −35.3 | 0.0026 |
| 1257 | CGPG635.pep | Epimerase | 9 | 273 | 226.4 | 6.40E−65 |
| 1257 | CGPG635.pep | Polysacc_synt_2 | 9 | 319 | −162.6 | 0.0011 |
| 1257 | CGPG635.pep | 3Beta_HSD | 10 | 299 | −79 | 3.60E−05 |
| 1257 | CGPG635.pep | NAD_binding_4 | 11 | 240 | −73 | 0.00047 |
| 1258 | CGPG6350.pep | LRRNT_2 | 32 | 78 | 22.6 | 0.0015 |
| 1258 | CGPG6350.pep | LRR_1 | 105 | 127 | 20.8 | 0.0051 |
| 1258 | CGPG6350.pep | LRR_1 | 129 | 151 | 13.6 | 0.74 |
| 1258 | CGPG6350.pep | LRR_1 | 153 | 175 | 13.4 | 0.84 |
| 1258 | CGPG6350.pep | LRR_1 | 177 | 196 | 10.9 | 2.9 |
| 1260 | CGPG6365.pep | Aminotran_1_2 | 32 | 384 | 403.5 | 3.20E−118 |
| 1261 | CGPG6374.pep | Gln-synt_C | 120 | 380 | 370.8 | 2.30E−108 |
| 1262 | CGPG6377.pep | PGK | 2 | 383 | 466.4 | 3.70E−137 |
| 1263 | CGPG638.pep | PA | 51 | 163 | 106 | 1.10E−28 |
| 1264 | CGPG6397.pep | NAD_binding_2 | 1 | 157 | −57 | 0.00027 |
| 1264 | CGPG6397.pep | NAD_Gly3P_dh_N | 2 | 121 | −33.4 | 0.0009 |

TABLE 21-continued

| PEP Seq ID No. | Construct ID | Pfam domain name | Begin | Stop | score | E-value |
|---|---|---|---|---|---|---|
| 1264 | CGPG6397.pep | F420_oxidored | 3 | 246 | 249.4 | 7.60E−72 |
| 1265 | CGPG6398.pep | Enolase_N | 5 | 135 | 212.4 | 1.10E−60 |
| 1265 | CGPG6398.pep | Enolase_C | 140 | 430 | 405 | 1.10E−118 |
| 1266 | CGPG6408.pep | ADH_N | 25 | 155 | 153.5 | 6.00E−43 |
| 1266 | CGPG6408.pep | ADH_zinc_N | 185 | 350 | 101.5 | 2.50E−27 |
| 1267 | CGPG6415.pep | NTP_transferase | 4 | 271 | 71.9 | 2.10E−18 |
| 1268 | CGPG6421.pep | ADH_N | 25 | 148 | 131.4 | 2.60E−36 |
| 1268 | CGPG6421.pep | ADH_zinc_N | 179 | 318 | 163.9 | 4.30E−46 |
| 1269 | CGPG6442.pep | iPGM_N | 2 | 363 | 870.1 | 1.10E−258 |
| 1269 | CGPG6442.pep | Metalloenzyme | 373 | 488 | 191.4 | 2.20E−54 |
| 1270 | CGPG6443.pep | PGK | 1 | 391 | 727.8 | 7.60E−216 |
| 1271 | CGPG6446.pep | PK | 106 | 453 | 901.2 | 4.70E−268 |
| 1271 | CGPG6446.pep | PK_C | 467 | 587 | 259.4 | 7.60E−75 |
| 1272 | CGPG6453.pep | Aminotran_1_2 | 41 | 402 | 404.3 | 1.80E−118 |
| 1273 | CGPG6466.pep | ADH_N | 27 | 153 | 129.2 | 1.20E−35 |
| 1273 | CGPG6466.pep | ADH_zinc_N | 184 | 322 | 135.3 | 1.80E−37 |
| 1274 | CGPG6467.pep | Aminotran_3 | 19 | 366 | 361.7 | 1.20E−105 |
| 1275 | CGPG6470.pep | PfkB | 1 | 302 | 230 | 5.40E−66 |
| 1276 | CGPG6475.pep | NTP_transferase | 10 | 282 | 35.5 | 1.90E−09 |
| 1277 | CGPG6477.pep | NDK | 4 | 138 | 268.7 | 1.20E−77 |
| 1278 | CGPG6478.pep | PfkB | 1 | 308 | 70.6 | 5.30E−18 |
| 1279 | CGPG6493.pep | AA_permease | 94 | 561 | 594.7 | 9.00E−176 |
| 1280 | CGPG6506.pep | Asparaginase | 140 | 457 | 525.4 | 6.50E−155 |
| 1281 | CGPG6518.pep | NAD_binding_2 | 2 | 173 | 303 | 5.60E−88 |
| 1281 | CGPG6518.pep | 6PGD | 177 | 467 | 700.7 | 1.10E−207 |
| 1282 | CGPG6546.pep | PK | 3 | 348 | 560.5 | 1.80E−165 |
| 1282 | CGPG6546.pep | PK_C | 360 | 477 | 86.8 | 6.80E−23 |
| 1283 | CGPG6556.pep | Aminotran_1_2 | 124 | 475 | 223.7 | 4.30E−64 |
| 1284 | CGPG6562.pep | Aminotran_3 | 116 | 451 | 628.8 | 4.90E−186 |
| 1285 | CGPG6566.pep | NTP_transferase | 95 | 350 | 301.4 | 1.80E−87 |
| 1285 | CGPG6566.pep | Hexapep | 398 | 415 | 6.4 | 25 |
| 1285 | CGPG6566.pep | Hexapep | 432 | 449 | 16.6 | 0.097 |
| 1285 | CGPG6566.pep | Hexapep | 460 | 477 | 5.5 | 31 |
| 1286 | CGPG6571.pep | Aldedh | 102 | 560 | 720.7 | 1.10E−213 |
| 1287 | CGPG6576.pep | Aldedh | 99 | 565 | 569.2 | 4.30E−168 |
| 1288 | CGPG659.pep | G_glu_transpept | 48 | 567 | 839.1 | 2.30E−249 |
| 1289 | CGPG6594.pep | DAO | 94 | 524 | −28.6 | 0.00082 |
| 1289 | CGPG6594.pep | GIDA | 94 | 429 | −226.6 | 0.0045 |
| 1289 | CGPG6594.pep | Pyr_redox_2 | 94 | 419 | 229.8 | 6.20E−66 |
| 1289 | CGPG6594.pep | Pyr_redox | 278 | 374 | 119.5 | 9.90E−33 |
| 1289 | CGPG6594.pep | Pyr_redox_dim | 450 | 559 | 194.7 | 2.20E−55 |
| 1290 | CGPG6603.pep | Pyr_redox_2 | 94 | 397 | 239.1 | 9.60E−69 |
| 1290 | CGPG6603.pep | Pyr_redox | 257 | 350 | 101.2 | 3.10E−27 |
| 1290 | CGPG6603.pep | Pyr_redox_dim | 427 | 538 | 189.7 | 7.10E−54 |
| 1291 | CGPG6608.pep | DAO | 93 | 497 | −33.9 | 0.0018 |
| 1291 | CGPG6608.pep | Pyr_redox_2 | 93 | 394 | 145.4 | 1.60E−40 |
| 1291 | CGPG6608.pep | Pyr_redox | 256 | 348 | 92.2 | 1.70E−24 |
| 1291 | CGPG6608.pep | Pyr_redox_dim | 423 | 532 | 89.3 | 1.20E−23 |
| 1292 | CGPG6634.pep | DUF177 | 100 | 252 | 152.3 | 1.30E−42 |
| 1294 | CGPG6667.pep | Invertase_neut | 89 | 577 | 1313.4 | 0 |
| 1295 | CGPG6678.pep | Biotin_lipoyl | 92 | 165 | 75.9 | 1.30E−19 |
| 1295 | CGPG6678.pep | E3_binding | 225 | 263 | 51.7 | 2.60E−12 |
| 1295 | CGPG6678.pep | 2-oxoacid_dh | 281 | 512 | 374.6 | 1.60E−109 |
| 1296 | CGPG6695.pep | GIDA | 97 | 428 | −211.9 | 0.00053 |
| 1296 | CGPG6695.pep | Pyr_redox_2 | 97 | 408 | 266.1 | 7.40E−77 |
| 1296 | CGPG6695.pep | Pyr_redox | 266 | 361 | 90.1 | 7.20E−24 |
| 1296 | CGPG6695.pep | Pyr_redox_dim | 436 | 545 | 184.3 | 3.20E−52 |
| 1297 | CGPG6699.pep | Ribul_P_3_epim | 94 | 295 | 491.3 | 1.20E−144 |
| 1298 | CGPG670.pep | Fer2 | 60 | 135 | 120.2 | 6.20E−33 |
| 1299 | CGPG6705.pep | PK | 89 | 433 | 788.8 | 3.30E−234 |
| 1299 | CGPG6705.pep | PK_C | 445 | 559 | 164.3 | 3.30E−46 |
| 1299 | CGPG6705.pep | PEP-utilizers | 584 | 663 | 122.9 | 9.40E−34 |
| 1300 | CGPG6735.pep | FBPase | 93 | 413 | 525 | 8.60E−155 |
| 1301 | CGPG6744.pep | Glycolytic | 92 | 429 | 576.6 | 2.40E−170 |
| 1302 | CGPG6753.pep | Pyr_redox | 236 | 328 | 10.7 | 0.00051 |
| 1302 | CGPG6753.pep | Pyr_redox_2 | 236 | 538 | 72.9 | 1.10E−18 |
| 1303 | CGPG6757.pep | Aminotran_1_2 | 127 | 473 | 234 | 3.30E−67 |
| 1305 | CGPG6806.pep | mTERF | 110 | 457 | 550.4 | 2.00E−162 |
| 1306 | CGPG6811.pep | GH3 | 10 | 567 | 1341 | 0 |
| 1308 | CGPG6815.pep | V-ATPase_G | 5 | 109 | 183.9 | 4.00E−52 |
| 1310 | CGPG6830.pep | Tbf5 | 13 | 76 | 113.7 | 5.40E−31 |
| 1313 | CGPG6864.pep | DUF620 | 190 | 438 | 698.7 | 4.50E−207 |
| 1314 | CGPG6877.pep | Hep_59 | 101 | 194 | 198.3 | 1.90E−56 |
| 1315 | CGPG6878.pep | Peptidase_M24 | 107 | 343 | 229.5 | 7.80E−66 |
| 1316 | CGPG6880.pep | PAP_fibrillin | 72 | 232 | 178.2 | 2.20E−50 |
| 1318 | CGPG6887.pep | AIG2 | 12 | 111 | 89.1 | 1.40E−23 |
| 1319 | CGPG6895.pep | zf-CCHC | 166 | 183 | 26 | 0.00014 |
| 1319 | CGPG6895.pep | zf-CCHC | 208 | 225 | 24.9 | 0.00026 |

TABLE 21-continued

| PEP Seq ID No. | Construct ID | Pfam domain name | Begin | Stop | score | E-value |
|---|---|---|---|---|---|---|
| 1319 | CGPG6895.pep | zf-CCHC | 325 | 342 | 38.1 | 3.30E-08 |
| 1319 | CGPG6895.pep | zf-CCHC | 356 | 373 | 32 | 2.20E-06 |
| 1322 | CGPG6912.pep | zf-DHHC | 149 | 213 | 119.1 | 1.30E-32 |
| 1324 | CGPG6942.pep | RNA_pol_Rpb5_N | 18 | 108 | 174.3 | 3.20E-49 |
| 1324 | CGPG6942.pep | RNA_pol_Rpb5_C | 149 | 222 | 68.2 | 2.80E-17 |
| 1327 | CGPG6969.pep | 2OG-FeII_Oxy | 223 | 323 | 152.3 | 1.30E-42 |
| 1329 | CGPG6991.pep | Glyco_tran_28_C | 11 | 170 | 171.7 | 1.90E-48 |
| 1332 | CGPG7037.pep | Sad1_UNC | 313 | 416 | −3.4 | 0.0011 |
| 1333 | CGPG7051.pep | PAP_fibrillin | 84 | 236 | 218.7 | 1.40E-62 |
| 1336 | CGPG7086.pep | SFT2 | 44 | 163 | 182.6 | 9.70E-52 |
| 1339 | CGPG7136.pep | NOI | 1 | 72 | 159.7 | 8.10E-45 |
| 1340 | CGPG7147.pep | RAMP4 | 1 | 64 | 152.5 | 1.20E-42 |
| 1343 | CGPG7222.pep | Branch | 49 | 274 | 399.8 | 4.00E-117 |
| 1345 | CGPG7233.pep | eIF2A | 214 | 407 | 415.3 | 8.90E-122 |
| 1346 | CGPG7238.pep | UPF0185 | 5 | 80 | 214.1 | 3.30E-61 |
| 1347 | CGPG7253.pep | ArfGap | 15 | 117 | 58.4 | 2.40E-14 |
| 1348 | CGPG7255.pep | Arf | 5 | 177 | 365.3 | 1.00E-106 |
| 1348 | CGPG7255.pep | SRPRB | 15 | 200 | −3.7 | 2.60E-07 |
| 1348 | CGPG7255.pep | Miro | 19 | 129 | 40.3 | 7.10E-09 |
| 1348 | CGPG7255.pep | Ras | 19 | 179 | −43.7 | 4.50E-06 |
| 1349 | CGPG7286.pep | ORC2 | 20 | 345 | 558.7 | 6.00E-165 |
| 1350 | CGPG7292.pep | Methyltransf_11 | 38 | 135 | 44.1 | 5.00E-10 |
| 1350 | CGPG7292.pep | Methyltransf_12 | 38 | 133 | 38.4 | 2.60E-08 |
| 1351 | CGPG7301.pep | ELFV_dehydrog_N | 57 | 187 | 294.9 | 1.50E-85 |
| 1351 | CGPG7301.pep | ELFV_dehydrog | 202 | 445 | 484.3 | 1.50E-142 |
| 1352 | CGPG7305.pep | DAO | 126 | 401 | −31.6 | 0.0013 |
| 1352 | CGPG7305.pep | Pyr_redox_2 | 126 | 386 | 66.3 | 1.00E-16 |
| 1352 | CGPG7305.pep | Pyr_redox | 255 | 345 | 55.7 | 1.60E-13 |
| 1353 | CGPG7307.pep | Gp_dh_N | 11 | 163 | 300.6 | 3.00E-87 |
| 1353 | CGPG7307.pep | Gp_dh_C | 168 | 324 | 258.5 | 1.50E-74 |
| 1354 | CGPG7318.pep | MIP | 1 | 142 | −31.2 | 9.10E-08 |
| 1355 | CGPG7319.pep | SNF5 | 172 | 400 | 471.8 | 9.00E-139 |
| 1356 | CGPG7345.pep | Lipase_3 | 97 | 237 | 131.1 | 3.30E-36 |
| 1357 | CGPG7368.pep | MT-A70 | 516 | 676 | 316.4 | 5.20E-92 |
| 1358 | CGPG7385.pep | FHA | 32 | 107 | 51 | 4.10E-12 |
| 1359 | CGPG7391.pep | G-patch | 6 | 50 | 71.2 | 3.40E-18 |
| 1360 | CGPG7405.pep | TATA_RF | 1 | 216 | 160.8 | 3.70E-45 |
| 1361 | CGPG7415.pep | IU_nuc_hydro | 1 | 312 | 255.3 | 1.30E-73 |
| 1362 | CGPG7416.pep | GLTP | 52 | 233 | 208 | 2.30E-59 |
| 1363 | CGPG7420.pep | PRK | 95 | 302 | 426.6 | 3.60E-125 |
| 1366 | CGPG7445.pep | PRC | 92 | 169 | 37.2 | 5.70E-08 |
| 1366 | CGPG7445.pep | PRC | 171 | 252 | 48.6 | 2.20E-11 |
| 1367 | CGPG7465.pep | Aldedh | 103 | 567 | 834.4 | 6.30E-248 |
| 1368 | CGPG7473.pep | F-box | 273 | 320 | 35.1 | 2.60E-07 |
| 1368 | CGPG7473.pep | WD40 | 412 | 449 | 41.5 | 2.90E-09 |
| 1368 | CGPG7473.pep | WD40 | 453 | 493 | 49.7 | 1.00E-11 |
| 1368 | CGPG7473.pep | WD40 | 520 | 556 | 30.6 | 5.70E-06 |
| 1368 | CGPG7473.pep | WD40 | 560 | 598 | 41.7 | 2.70E-09 |
| 1369 | CGPG7489.pep | UBX | 295 | 376 | 70.8 | 4.50E-18 |
| 1370 | CGPG7492.pep | Pescadillo_N | 8 | 291 | 519 | 5.30E-153 |
| 1370 | CGPG7492.pep | BRCT | 337 | 414 | 50.7 | 5.00E-12 |
| 1371 | CGPG7499.pep | G-alpha | 423 | 839 | 50.2 | 3.20E-22 |
| 1374 | CGPG7508.pep | Smg4_UPF3 | 1 | 170 | 236.2 | 7.10E-68 |
| 1375 | CGPG7509.pep | SSB | 76 | 187 | 95.3 | 1.90E-25 |
| 1376 | CGPG7511.pep | GFA | 31 | 125 | 74.2 | 4.20E-19 |
| 1377 | CGPG7515.pep | Brix | 45 | 297 | 232.5 | 9.60E-67 |
| 1378 | CGPG7521.pep | G-alpha | 23 | 386 | 560.5 | 1.80E-165 |
| 1380 | CGPG7547.pep | PAD_porph | 14 | 368 | 695.7 | 3.40E-206 |
| 1381 | CGPG7561.pep | Snf7 | 17 | 187 | 219.6 | 7.40E-63 |
| 1382 | CGPG7562.pep | Sybindin | 6 | 136 | 253.6 | 4.30E-73 |
| 1382 | CGPG7562.pep | Sedlin_N | 11 | 135 | −21.6 | 0.00015 |
| 1383 | CGPG7563.pep | DUF887 | 40 | 279 | 394.2 | 2.10E-115 |
| 1384 | CGPG7567.pep | Peptidase_M18 | 14 | 461 | 680 | 1.90E-201 |
| 1389 | CGPG7597.pep | zf-AN1 | 76 | 116 | 78.4 | 2.40E-20 |
| 1390 | CGPG7606.pep | Pentapeptide | 127 | 166 | 29.2 | 1.50E-05 |
| 1390 | CGPG7606.pep | Pentapeptide | 172 | 211 | 42.7 | 1.30E-09 |
| 1392 | CGPG7637.pep | DAD | 2 | 112 | 168.4 | 1.90E-47 |
| 1393 | CGPG7649.pep | YgbB | 71 | 227 | 244.8 | 2.00E-70 |
| 1394 | CGPG7658.pep | Cyclase | 56 | 256 | 109.9 | 7.70E-30 |
| 1395 | CGPG7664.pep | Aldedh | 9 | 463 | 801 | 7.20E-238 |
| 1396 | CGPG7666.pep | Aminotran_1_2 | 26 | 392 | 491 | 1.50E-144 |
| 1397 | CGPG7668.pep | DUF594 | 660 | 719 | 97.6 | 3.90E-26 |
| 1399 | CGPG7746.pep | UPF0153 | 49 | 139 | 59.7 | 9.90E-15 |
| 1400 | CGPG7747.pep | Copine | 113 | 261 | 308.5 | 1.30E-89 |
| 1401 | CGPG7752.pep | zf-MYND | 176 | 214 | 48.9 | 1.80E-11 |
| 1401 | CGPG7752.pep | PDCD2_C | 241 | 403 | 38.2 | 1.00E-10 |
| 1403 | CGPG7770.pep | YTH | 263 | 353 | 218.6 | 1.40E-62 |
| 1406 | CGPG7778.pep | Ubie_methyltran | 51 | 304 | 393.3 | 3.70E-115 |

TABLE 21-continued

| PEP Seq ID No. | Construct ID | Pfam domain name | Begin | Stop | score | E-value |
|---|---|---|---|---|---|---|
| 1406 | CGPG7778.pep | Methyltransf_11 | 105 | 222 | 75 | 2.50E−19 |
| 1406 | CGPG7778.pep | Methyltransf_12 | 105 | 220 | 43.1 | 1.00E−09 |
| 1407 | CGPG7786.pep | KH_1 | 141 | 193 | 27.6 | 4.60E−05 |
| 1408 | CGPG7788.pep | YIF1 | 34 | 263 | 341.8 | 1.20E−99 |
| 1410 | CGPG78.pep | Hpt | 46 | 132 | 55.5 | 1.80E−13 |
| 1411 | CGPG783.pep | RRM_1 | 288 | 354 | 40 | 8.40E−09 |
| 1411 | CGPG783.pep | RRM_2 | 682 | 778 | 232.4 | 1.00E−66 |
| 1412 | CGPG7832.pep | STT3 | 26 | 670 | 626.4 | 2.50E−185 |
| 1413 | CGPG7841.pep | ECH | 17 | 186 | 192.8 | 8.40E−55 |
| 1413 | CGPG7841.pep | 3HCDH_N | 311 | 490 | 295.4 | 1.10E−85 |
| 1413 | CGPG7841.pep | 3HCDH | 492 | 585 | 116.2 | 9.50E−32 |
| 1414 | CGPG7845.pep | LRRNT_2 | 23 | 64 | 49.2 | 1.50E−11 |
| 1414 | CGPG7845.pep | LRR_1 | 97 | 119 | 10.5 | 3.5 |
| 1414 | CGPG7845.pep | LRR_1 | 121 | 143 | 14.5 | 0.39 |
| 1414 | CGPG7845.pep | LRR_1 | 145 | 167 | 12.1 | 1.7 |
| 1414 | CGPG7845.pep | LRR_1 | 169 | 192 | 13.1 | 1.1 |
| 1414 | CGPG7845.pep | LRR_1 | 194 | 216 | 14 | 0.55 |
| 1415 | CGPG7847.pep | Peptidase_C48 | 30 | 225 | −1.9 | 0.00023 |
| 1417 | CGPG7853.pep | LRR_1 | 142 | 164 | 17.4 | 0.052 |
| 1417 | CGPG7853.pep | LRR_1 | 166 | 188 | 9.9 | 4.4 |
| 1417 | CGPG7853.pep | LRR_1 | 190 | 212 | 10 | 4.3 |
| 1417 | CGPG7853.pep | LRR_1 | 214 | 235 | 13.8 | 0.65 |
| 1417 | CGPG7853.pep | LRR_1 | 258 | 280 | 10.5 | 3.5 |
| 1417 | CGPG7853.pep | LRR_1 | 282 | 304 | 14 | 0.56 |
| 1417 | CGPG7853.pep | LRR_1 | 306 | 325 | 11.7 | 2.1 |
| 1418 | CGPG7857.pep | Response_reg | 79 | 195 | 89.7 | 9.40E−24 |
| 1418 | CGPG7857.pep | CCT | 689 | 736 | 62.1 | 1.80E−15 |
| 1420 | CGPG7869.pep | Acyltransferase | 117 | 264 | 81.9 | 2.00E−21 |
| 1421 | CGPG7891.pep | FMO-like | 11 | 427 | −207 | 1.20E−16 |
| 1421 | CGPG7891.pep | DAO | 13 | 268 | −9.4 | 4.70E−05 |
| 1422 | CGPG7892.pep | FMO-like | 9 | 416 | −157.4 | 2.80E−19 |
| 1423 | CGPG7906.pep | Skp1_POZ | 4 | 65 | 96.7 | 7.50E−26 |
| 1423 | CGPG7906.pep | Skp1 | 76 | 153 | 154.3 | 3.40E−43 |
| 1424 | CGPG7924.pep | AAA | 249 | 462 | 54.2 | 4.60E−13 |
| 1428 | CGPG7964.pep | IQ | 108 | 128 | 25.7 | 0.00017 |
| 1428 | CGPG7964.pep | IQ | 130 | 150 | 12.2 | 1.9 |
| 1429 | CGPG7968.pep | FMO-like | 13 | 427 | −229.9 | 2.10E−15 |
| 1429 | CGPG7968.pep | DAO | 15 | 291 | −34.2 | 0.0019 |
| 1429 | CGPG7968.pep | Pyr_redox_2 | 15 | 321 | −18 | 0.00054 |
| 1431 | CGPG7972.pep | FAD_binding_3 | 5 | 372 | −97.4 | 5.20E−06 |
| 1432 | CGPG7982.pep | Tetraspannin | 4 | 241 | 241.9 | 1.40E−69 |
| 1433 | CGPG7985.pep | BT1 | 57 | 469 | 419.2 | 6.00E−123 |
| 1434 | CGPG7993.pep | F-box | 27 | 73 | 15.1 | 0.26 |
| 1434 | CGPG7993.pep | LRR_2 | 278 | 304 | 16.8 | 0.084 |
| 1435 | CGPG8.pep | p450 | 39 | 503 | 399 | 7.30E−117 |
| 1436 | CGPG80.pep | Pkinase | 68 | 328 | 277.6 | 2.60E−80 |
| 1437 | CGPG8001.pep | FMO-like | 13 | 433 | −243.5 | 1.10E−14 |
| 1437 | CGPG8001.pep | Pyr_redox | 215 | 295 | 5.3 | 0.0016 |
| 1438 | CGPG8009.pep | BT1 | 41 | 511 | 517.8 | 1.30E−152 |
| 1440 | CGPG8049.pep | BT1 | 1 | 436 | 331.8 | 1.20E−96 |
| 1441 | CGPG806.pep | Synaptobrevin | 127 | 215 | 146.7 | 6.20E−41 |
| 1442 | CGPG8060.pep | DUF829 | 161 | 425 | 426 | 5.30E−125 |
| 1446 | CGPG81.pep | Pkinase | 70 | 330 | 287.7 | 2.30E−83 |
| 1452 | CGPG8125.pep | zf-C3HC4 | 46 | 86 | 31.1 | 4.00E−06 |
| 1453 | CGPG8134.pep | DEK_C | 3 | 57 | 60.4 | 6.10E−15 |
| 1453 | CGPG8134.pep | SWIB | 197 | 272 | 140.9 | 3.60E−39 |
| 1453 | CGPG8134.pep | SWIB | 305 | 382 | 112.9 | 9.40E−31 |
| 1455 | CGPG8156.pep | PCI | 258 | 362 | 69.4 | 1.20E−17 |
| 1456 | CGPG8159.pep | ACT | 77 | 141 | 51.9 | 2.10E−12 |
| 1456 | CGPG8159.pep | ACT | 308 | 374 | 51.5 | 3.00E−12 |
| 1458 | CGPG8179.pep | WD40 | 138 | 177 | 23.7 | 0.00069 |
| 1458 | CGPG8179.pep | WD40 | 264 | 305 | 42.5 | 1.50E−09 |
| 1459 | CGPG8193.pep | Ank | 22 | 54 | 5.5 | 5.2 |
| 1459 | CGPG8193.pep | Ank | 55 | 87 | 36.4 | 1.00E−07 |
| 1460 | CGPG8197.pep | F-box | 5 | 53 | 22 | 0.0022 |
| 1461 | CGPG8198.pep | F-box | 74 | 119 | 15 | 0.28 |
| 1461 | CGPG8198.pep | Kelch_2 | 174 | 221 | 19.7 | 0.011 |
| 1461 | CGPG8198.pep | Kelch_1 | 223 | 278 | 15.6 | 0.041 |
| 1461 | CGPG8198.pep | Kelch_2 | 329 | 369 | 14.2 | 0.51 |
| 1463 | CGPG8211.pep | F-box | 182 | 229 | 48.8 | 2.00E−11 |
| 1463 | CGPG8211.pep | WD40 | 292 | 328 | 30.3 | 6.90E−06 |
| 1463 | CGPG8211.pep | WD40 | 332 | 368 | 37.7 | 4.30E−08 |
| 1463 | CGPG8211.pep | WD40 | 372 | 408 | 43.4 | 8.30E−10 |
| 1463 | CGPG8211.pep | WD40 | 411 | 449 | 40.9 | 4.60E−09 |
| 1463 | CGPG8211.pep | WD40 | 453 | 538 | 32.2 | 1.90E−06 |
| 1463 | CGPG8211.pep | WD40 | 542 | 578 | 38.9 | 1.80E−08 |
| 1464 | CGPG823.pep | Ribosomal_S6e | 1 | 129 | 258.3 | 1.70E−74 |
| 1466 | CGPG8238.pep | PGI | 49 | 537 | 857.4 | 7.40E−255 |

TABLE 21-continued

| PEP Seq ID No. | Construct ID | Pfam domain name | Begin | Stop | score | E-value |
|---|---|---|---|---|---|---|
| 1467 | CGPG8260.pep | Iso_dh | 4 | 331 | 460.7 | 1.90E−135 |
| 1468 | CGPG8267.pep | Pyridoxal_deC | 34 | 383 | 352.2 | 8.70E−103 |
| 1469 | CGPG8268.pep | NIR_SIR_ferr | 62 | 131 | 43.9 | 5.60E−10 |
| 1469 | CGPG8268.pep | NIR_SIR | 164 | 345 | 193.4 | 5.50E−55 |
| 1469 | CGPG8268.pep | NIR_SIR_ferr | 360 | 432 | 76.9 | 6.80E−20 |
| 1470 | CGPG8274.pep | PK | 5 | 347 | 589.9 | 2.50E−174 |
| 1470 | CGPG8274.pep | PK_C | 363 | 476 | 81.9 | 2.10E−21 |
| 1471 | CGPG8277.pep | Rib_5-P_isom_A | 55 | 229 | 345 | 1.30E−100 |
| 1472 | CGPG8279.pep | F-box | 22 | 69 | 43 | 1.10E−09 |
| 1472 | CGPG8279.pep | Kelch_1 | 124 | 168 | 35.2 | 2.40E−07 |
| 1472 | CGPG8279.pep | Kelch_1 | 170 | 213 | 29.4 | 1.40E−05 |
| 1472 | CGPG8279.pep | Kelch_2 | 170 | 213 | 24.3 | 0.00045 |
| 1475 | CGPG8408.pep | DUF641 | 60 | 192 | 237.3 | 3.40E−68 |
| 1476 | CGPG842.pep | Redoxin | 5 | 162 | 182.6 | 9.80E−52 |
| 1476 | CGPG842.pep | AhpC-TSA | 6 | 142 | 38.6 | 2.20E−08 |
| 1477 | CGPG8421.pep | NOSIC | 121 | 173 | 90.1 | 6.90E−24 |
| 1477 | CGPG8421.pep | Nop | 213 | 361 | 257.3 | 3.20E−74 |
| 1478 | CGPG8435.pep | NHL | 55 | 82 | 5.9 | 3.4 |
| 1478 | CGPG8435.pep | NHL | 115 | 142 | 37.2 | 5.80E−08 |
| 1479 | CGPG8440.pep | U-box | 242 | 316 | 70.2 | 6.80E−18 |
| 1479 | CGPG8440.pep | Arm | 372 | 413 | 47.5 | 4.70E−11 |
| 1479 | CGPG8440.pep | Arm | 455 | 495 | 32.1 | 2.00E−06 |
| 1479 | CGPG8440.pep | Arm | 496 | 537 | 22.3 | 0.0018 |
| 1479 | CGPG8440.pep | Arm | 538 | 578 | 25.5 | 0.0002 |
| 1480 | CGPG8453.pep | ACT | 36 | 99 | 33.5 | 7.90E−07 |
| 1480 | CGPG8453.pep | ACT | 129 | 201 | 54.1 | 4.90E−13 |
| 1480 | CGPG8453.pep | ACT | 265 | 332 | 28.6 | 2.40E−05 |
| 1480 | CGPG8453.pep | ACT | 343 | 406 | 43.5 | 7.50E−10 |
| 1481 | CGPG8470.pep | DUF89 | 18 | 357 | −103.6 | 0.0022 |
| 1482 | CGPG8479.pep | F-box | 31 | 78 | 22.6 | 0.0015 |
| 1482 | CGPG8479.pep | Kelch_1 | 124 | 170 | 35.4 | 2.00E−07 |
| 1482 | CGPG8479.pep | Kelch_1 | 172 | 216 | 44.6 | 3.40E−10 |
| 1482 | CGPG8479.pep | Kelch_2 | 172 | 216 | 21.7 | 0.0027 |
| 1483 | CGPG8489.pep | F-box | 3 | 50 | 44.4 | 3.90E−10 |
| 1483 | CGPG8489.pep | FBA_1 | 219 | 384 | 291.3 | 2.00E−84 |
| 1484 | CGPG8498.pep | Fcf1 | 87 | 185 | 245.9 | 9.10E−71 |
| 1485 | CGPG85.pep | Aa_trans | 19 | 454 | 556.5 | 2.80E−164 |
| 1486 | CGPG8501.pep | PPR | 149 | 183 | 11.6 | 0.32 |
| 1486 | CGPG8501.pep | PPR | 189 | 223 | 29 | 1.70E−05 |
| 1486 | CGPG8501.pep | PPR | 224 | 258 | 25.6 | 0.00019 |
| 1486 | CGPG8501.pep | PPR | 259 | 292 | 6.5 | 1.3 |
| 1486 | CGPG8501.pep | PPR | 330 | 364 | 4.2 | 2.5 |
| 1486 | CGPG8501.pep | PPR | 401 | 435 | 12.3 | 0.27 |
| 1487 | CGPG8507.pep | DUF588 | 31 | 185 | 202.1 | 1.30E−57 |
| 1488 | CGPG8509.pep | Pro_isomerase | 80 | 233 | 18.3 | 3.90E−10 |
| 1490 | CGPG8517.pep | B_lectin | 84 | 197 | 191 | 2.90E−54 |
| 1490 | CGPG8517.pep | S_locus_glycop | 211 | 339 | 250 | 5.20E−72 |
| 1490 | CGPG8517.pep | PAN_2 | 356 | 422 | 105.1 | 2.10E−28 |
| 1492 | CGPG852.pep | Ribosomal_S5 | 94 | 160 | 140.9 | 3.60E−39 |
| 1492 | CGPG852.pep | Ribosomal_S5_C | 177 | 250 | 134.4 | 3.30E−37 |
| 1498 | CGPG8567.pep | TB2_DP1_HVA22 | 3 | 98 | 59.4 | 1.20E−14 |
| 1499 | CGPG8580.pep | Caleosin | 22 | 195 | 434.3 | 1.70E−127 |
| 1501 | CGPG8590.pep | DUF579 | 42 | 289 | 571.9 | 6.60E−169 |
| 1503 | CGPG8594.pep | DUF584 | 1 | 139 | 248.7 | 1.30E−71 |
| 1504 | CGPG8606.pep | Exo_endo_phos | 56 | 327 | 125 | 2.30E−34 |
| 1505 | CGPG8628.pep | DUF584 | 32 | 203 | 125.8 | 1.30E−34 |
| 1507 | CGPG8654.pep | PPR | 73 | 107 | 13.2 | 0.21 |
| 1507 | CGPG8654.pep | PPR | 141 | 175 | 38.6 | 2.30E−08 |
| 1508 | CGPG8668.pep | TATA_RF | 1 | 200 | 306.9 | 3.90E−89 |
| 1511 | CGPG8702.pep | RPE65 | 50 | 622 | 19.9 | 1.70E−17 |
| 1514 | CGPG8748.pep | AAA | 201 | 357 | 13.1 | 1.30E−06 |
| 1516 | CGPG8770.pep | DUF543 | 1 | 73 | 107.6 | 3.90E−29 |
| 1517 | CGPG8777.pep | DUF569 | 1 | 144 | 377.9 | 1.70E−110 |
| 1517 | CGPG8777.pep | DUF569 | 227 | 368 | 391.4 | 1.40E−114 |
| 1519 | CGPG8786.pep | DUF260 | 13 | 113 | 247.6 | 2.70E−71 |
| 1520 | CGPG8792.pep | Abhydrolase_3 | 75 | 290 | 228.4 | 1.60E−65 |
| 1521 | CGPG8801.pep | PPR | 110 | 144 | 18.7 | 0.022 |
| 1521 | CGPG8801.pep | PPR | 145 | 179 | 9.1 | 0.64 |
| 1521 | CGPG8801.pep | PPR | 181 | 215 | 42.6 | 1.40E−09 |
| 1521 | CGPG8801.pep | PPR | 216 | 250 | 19.5 | 0.012 |
| 1521 | CGPG8801.pep | PPR | 251 | 285 | 23.6 | 0.00076 |
| 1521 | CGPG8801.pep | PPR | 286 | 320 | 37.2 | 6.10E−08 |
| 1521 | CGPG8801.pep | PPR | 321 | 355 | 12 | 0.3 |
| 1522 | CGPG8809.pep | Ribosomal_L12 | 141 | 208 | 61.2 | 3.50E−15 |
| 1523 | CGPG8840.pep | CLP_protease | 115 | 289 | 45.1 | 1.30E−11 |
| 1524 | CGPG8850.pep | PPR | 189 | 223 | 17.3 | 0.057 |
| 1524 | CGPG8850.pep | PPR | 224 | 258 | 48.5 | 2.40E−11 |
| 1524 | CGPG8850.pep | PPR | 297 | 331 | 34.6 | 3.50E−07 |

TABLE 21-continued

| PEP Seq ID No. | Construct ID | Pfam domain name | Begin | Stop | score | E-value |
|---|---|---|---|---|---|---|
| 1524 | CGPG8850.pep | PPR | 332 | 366 | 46.2 | 1.20E−10 |
| 1524 | CGPG8850.pep | PPR | 367 | 401 | 40.7 | 5.40E−09 |
| 1524 | CGPG8850.pep | PPR | 402 | 436 | 50 | 8.00E−12 |
| 1524 | CGPG8850.pep | PPR | 437 | 470 | 36.5 | 9.50E−08 |
| 1524 | CGPG8850.pep | PPR | 471 | 505 | 39.8 | 9.60E−09 |
| 1524 | CGPG8850.pep | PPR | 506 | 540 | 23.2 | 0.00094 |
| 1524 | CGPG8850.pep | PPR | 542 | 576 | 46.6 | 8.80E−11 |
| 1525 | CGPG8870.pep | Fructosamin_kin | 54 | 339 | 208 | 2.30E−59 |
| 1525 | CGPG8870.pep | APH | 69 | 308 | 80.1 | 7.30E−21 |
| 1526 | CGPG8871.pep | DUF59 | 36 | 115 | 57.6 | 4.20E−14 |
| 1527 | CGPG8872.pep | RRM_1 | 138 | 205 | 78 | 3.00E−20 |
| 1527 | CGPG8872.pep | RRM_1 | 214 | 288 | 32.4 | 1.70E−06 |
| 1527 | CGPG8872.pep | RRM_1 | 308 | 378 | 60 | 8.10E−15 |
| 1528 | CGPG8876.pep | SFT2 | 43 | 162 | 194.7 | 2.40E−55 |
| 1529 | CGPG8902.pep | RNA_pol_I_A49 | 31 | 415 | 702.7 | 2.70E−208 |
| 1530 | CGPG8904.pep | G-alpha | 103 | 447 | 513.2 | 3.10E−151 |
| 1531 | CGPG8907.pep | DnaJ | 4 | 67 | 128.7 | 1.70E−35 |
| 1531 | CGPG8907.pep | zf-C2H2 | 338 | 362 | 28 | 3.40E−05 |
| 1532 | CGPG8914.pep | Whi5 | 181 | 205 | 50.1 | 7.80E−12 |
| 1533 | CGPG8931.pep | eIF3_subunit | 1 | 231 | 272.1 | 1.20E−78 |
| 1534 | CGPG8933.pep | MACPF | 126 | 322 | 60.6 | 5.20E−15 |
| 1535 | CGPG8935.pep | Pkinase | 33 | 324 | 308.5 | 1.30E−89 |
| 1536 | CGPG8938.pep | Pkinase | 71 | 348 | 187.5 | 3.40E−53 |
| 1536 | CGPG8938.pep | Pkinase_Tyr | 71 | 348 | 128.4 | 2.10E−35 |
| 1537 | CGPG8944.pep | PH | 31 | 134 | 48.5 | 2.40E−11 |
| 1538 | CGPG895.pep | DUF231 | 251 | 427 | 223.7 | 4.30E−64 |
| 1540 | CGPG8961.pep | Dus | 59 | 392 | 236.5 | 5.90E−68 |
| 1541 | CGPG8963.pep | Pkinase | 319 | 612 | 332 | 1.10E−96 |
| 1542 | CGPG898.pep | DUF231 | 276 | 448 | 289.8 | 5.30E−84 |
| 1543 | CGPG8993.pep | AAA | 44 | 226 | 54.9 | 2.80E−13 |
| 1543 | CGPG8993.pep | Rep_fac_C | 237 | 326 | 113.5 | 6.50E−31 |
| 1544 | CGPG8994.pep | Brix | 86 | 262 | 264.3 | 2.50E−76 |
| 1545 | CGPG8995.pep | Porin_3 | 54 | 326 | 280.1 | 4.30E−81 |
| 1546 | CGPG90.pep | MFS_1 | 68 | 427 | 55 | 2.50E−13 |
| 1547 | CGPG900.pep | DUF231 | 241 | 420 | 229.6 | 6.90E−66 |
| 1548 | CGPG9002.pep | CTP_transf_1 | 51 | 382 | 443.1 | 3.90E−130 |
| 1549 | CGPG9009.pep | Alg6_Alg8 | 22 | 514 | 439.6 | 4.30E−129 |
| 1550 | CGPG9011.pep | OTCace_N | 70 | 212 | 188.6 | 1.60E−53 |
| 1550 | CGPG9011.pep | OTCace | 216 | 369 | 198.1 | 2.20E−56 |
| 1551 | CGPG9012.pep | FolB | 16 | 129 | 125 | 2.10E−34 |
| 1552 | CGPG9017.pep | DMRL_synthase | 70 | 213 | 195.5 | 1.30E−55 |
| 1553 | CGPG9025.pep | Glyco_transf_29 | 105 | 355 | −11 | 1.90E−06 |
| 1554 | CGPG9026.pep | Adap_comp_sub | 160 | 428 | 469.4 | 4.70E−138 |
| 1555 | CGPG9032.pep | RNase_PH | 33 | 165 | 135.6 | 1.40E−37 |
| 1555 | CGPG9032.pep | RNase_PH_C | 194 | 262 | 44.9 | 2.70E−10 |
| 1556 | CGPG9040.pep | Sec1 | 35 | 592 | 217.7 | 2.70E−62 |
| 1557 | CGPG9044.pep | Syntaxin | 57 | 163 | 93.9 | 5.10E−25 |
| 1557 | CGPG9044.pep | SNARE | 256 | 318 | 79.5 | 1.10E−20 |
| 1558 | CGPG9048.pep | RNase_PH | 15 | 135 | 53.3 | 8.30E−13 |
| 1559 | CGPG9049.pep | Glycos_transf_1 | 244 | 442 | 16 | 3.70E−05 |
| 1560 | CGPG9058.pep | RNA_pol_N | 1 | 60 | 125.6 | 1.40E−34 |
| 1561 | CGPG906.pep | PPR | 210 | 244 | 28.2 | 3.10E−05 |
| 1561 | CGPG906.pep | PPR | 245 | 279 | 13.7 | 0.19 |
| 1562 | CGPG9070.pep | ATP-synt_C | 20 | 85 | 42.4 | 1.60E−09 |
| 1562 | CGPG9070.pep | ATP-synt_C | 104 | 169 | 21.7 | 0.00014 |
| 1564 | CGPG9084.pep | CH | 15 | 116 | 47.4 | 5.20E−11 |
| 1564 | CGPG9084.pep | EB1 | 209 | 255 | 79.7 | 9.20E−21 |
| 1566 | CGPG9098.pep | DUF6 | 32 | 165 | 22.6 | 0.0015 |
| 1566 | CGPG9098.pep | TPT | 199 | 337 | −10.3 | 0.0023 |
| 1566 | CGPG9098.pep | DUF6 | 208 | 337 | 66.1 | 1.20E−16 |
| 1567 | CGPG9099.pep | Rick_17kDa_Anti | 66 | 110 | 24.9 | 0.00029 |
| 1568 | CGPG9110.pep | RALF | 53 | 118 | 122.9 | 9.30E−34 |
| 1569 | CGPG9119.pep | PTR2 | 115 | 504 | 350.4 | 3.10E−102 |
| 1570 | CGPG9125.pep | ThiF | 98 | 233 | 171.7 | 1.90E−48 |
| 1571 | CGPG913.pep | PPR | 86 | 120 | 32.9 | 1.20E−06 |
| 1571 | CGPG913.pep | PPR | 188 | 222 | 51.1 | 4.00E−12 |
| 1571 | CGPG913.pep | PPR | 223 | 257 | 7.4 | 1 |
| 1571 | CGPG913.pep | PPR | 289 | 323 | 26 | 0.00014 |
| 1571 | CGPG913.pep | PPR | 325 | 358 | 12 | 0.29 |
| 1571 | CGPG913.pep | PPR | 361 | 395 | 12.8 | 0.24 |
| 1574 | CGPG9164.pep | DHBP_synthase | 5 | 202 | 475.9 | 5.10E−140 |
| 1574 | CGPG9164.pep | GTP_cyclohydro2 | 207 | 377 | 431.4 | 1.30E−126 |
| 1575 | CGPG9172.pep | Sec61_beta | 32 | 77 | 83 | 9.60E−22 |
| 1577 | CGPG9185.pep | DUF423 | 10 | 115 | 84.7 | 2.90E−22 |
| 1578 | CGPG9187.pep | Pkinase | 12 | 263 | 298.2 | 1.60E−86 |
| 1579 | CGPG9190.pep | DREPP | 2 | 203 | 280.3 | 3.80E−81 |
| 1580 | CGPG9193.pep | GATase | 11 | 196 | 175.1 | 1.90E−49 |
| 1580 | CGPG9193.pep | GMP_synt_C | 432 | 524 | 172.7 | 9.30E−49 |

TABLE 21-continued

| PEP Seq ID No. | Construct ID | Pfam domain name | Begin | Stop | score | E-value |
|---|---|---|---|---|---|---|
| 1581 | CGPG9195.pep | DUF1279 | 91 | 193 | 127 | 5.60E−35 |
| 1582 | CGPG9203.pep | Na_H_Exchanger | 13 | 391 | 242.3 | 1.00E−69 |
| 1582 | CGPG9203.pep | TrkA_C | 418 | 486 | 58.4 | 2.50E−14 |
| 1583 | CGPG9209.pep | GATase | 9 | 197 | 199.6 | 7.80E−57 |
| 1583 | CGPG9209.pep | GMP_synt_C | 423 | 515 | 201.4 | 2.20E−57 |
| 1585 | CGPG9210.pep | Na_H_Exchanger | 10 | 376 | 229 | 1.10E−65 |
| 1585 | CGPG9210.pep | TrkA_N | 402 | 517 | 131 | 3.50E−36 |
| 1586 | CGPG9211.pep | NTP_transferase | 7 | 296 | 508.1 | 1.00E−149 |
| 1586 | CGPG9211.pep | MannoseP_isomer | 307 | 473 | 454 | 2.00E−133 |
| 1586 | CGPG9211.pep | Cupin_2 | 388 | 458 | 48.1 | 3.10E−11 |
| 1587 | CGPG9212.pep | ATP-synt_ab_N | 22 | 87 | 53.4 | 7.60E−13 |
| 1587 | CGPG9212.pep | ATP-synt_ab | 143 | 353 | 429.3 | 5.40E−126 |
| 1588 | CGPG9216.pep | DHBP_synthase | 10 | 206 | 377.8 | 1.70E−110 |
| 1588 | CGPG9216.pep | GTP_cyclohydro2 | 211 | 379 | 395.3 | 9.20E−116 |
| 1589 | CGPG9226.pep | Carboxyl_trans | 40 | 541 | 967.5 | 5.20E−288 |
| 1590 | CGPG9252.pep | CDC48_N | 28 | 114 | 132.1 | 1.60E−36 |
| 1590 | CGPG9252.pep | AAA | 245 | 429 | 330.3 | 3.40E−96 |
| 1590 | CGPG9252.pep | AAA_5 | 245 | 377 | 9.8 | 0.00052 |
| 1590 | CGPG9252.pep | AAA | 518 | 705 | 344.1 | 2.40E−100 |
| 1592 | CGPG9289.pep | LSM | 10 | 75 | 64.8 | 3.00E−16 |
| 1593 | CGPG9298.pep | p450 | 41 | 516 | 138.8 | 1.60E−38 |
| 1594 | CGPG9299.pep | ThiF | 82 | 227 | 145.2 | 1.80E−40 |
| 1597 | CGPG9316.pep | ATP-grasp_2 | 34 | 242 | 405.7 | 7.10E−119 |
| 1597 | CGPG9316.pep | Ligase_CoA | 285 | 421 | 229 | 1.10E−65 |
| 1598 | CGPG9317.pep | DUF163 | 43 | 196 | 205.3 | 1.50E−58 |
| 1599 | CGPG9318.pep | Aldo_ket_red | 20 | 285 | 408 | 1.40E−119 |
| 1600 | CGPG9324.pep | Pkinase | 158 | 706 | 150.9 | 3.40E−42 |
| 1601 | CGPG9357.pep | Raffinose_syn | 7 | 757 | 1669.7 | 0 |
| 1602 | CGPG965.pep | Hexapep | 70 | 87 | 10.5 | 6.4 |
| 1602 | CGPG965.pep | Hexapep | 119 | 136 | 16.4 | 0.11 |
| 1602 | CGPG965.pep | Hexapep | 142 | 159 | 5.9 | 28 |
| 1602 | CGPG965.pep | Hexapep | 160 | 177 | 2.6 | 71 |
| 1603 | CGPG970.pep | NPH3 | 206 | 441 | 272 | 1.20E−78 |
| 1604 | CGPG982.pep | p450 | 29 | 495 | 389.8 | 4.30E−114 |
| 1605 | CGPG994.pep | adh_short | 50 | 218 | 46.7 | 8.30E−11 |
| 1606 | CGPG996.pep | DUF866 | 1 | 167 | 456.5 | 3.60E−134 |

TABLE 22

| Pfam domain name | Accession # | gathering cutoff | domain description |
|---|---|---|---|
| 2OG-FeII_Oxy | PF03171.11 | 11.5 | 2OG-Fe(II)oxygenase superfamily |
| 3Beta_HSD | PF01073.10 | −135.9 | 3-beta hydroxysteroid dehydrogenase/isomerase family |
| 3HCDH | PF00725.13 | −8.9 | 3-hydroxyacyl-CoA dehydrogenase, C-terminal domain |
| 3HCDH_N | PF02737.9 | −82.1 | 3-hydroxyacyl-CoA dehydrogenase, NAD binding domain |
| 6PGD | PF00393.10 | −232.3 | 6-phosphogluconate dehydrogenase, C-terminal domain |
| AAA | PF00004.20 | 12.3 | ATPase family associated with various cellular activities (AAA) |
| AAA_5 | PF07728.5 | 4 | ATPase family associated with various cellular activities (AAA) |
| AARP2CN | PF08142.3 | 25 | AARP2CN (NUC121) domain |
| AA_kinase | PF00696.19 | −40 | Amino acid kinase family |
| AA_permease | PF00324.12 | −120.8 | Amino acid permease |
| ABC_tran | PF00005.18 | 9.5 | ABC transporter |
| ACBP | PF00887.10 | −14 | Acyl CoA binding protein |
| ACP_syn_III_C | PF08541.1 | −21.6 | 3-Oxoacyl-[acyl-carrier-protein (ACP)] synthase III C terminal |
| ACT | PF01842.16 | 0.7 | ACT domain |
| ADH_N | PF08240.3 | −14.5 | Alcohol dehydrogenase GroES-like domain |
| ADH_zinc_N | PF00107.17 | 23.8 | Zinc-binding dehydrogenase |
| AIG1 | PF04548.7 | −40 | AIG1 family |
| AIG2 | PF06094.3 | 12.7 | AIG2-like family |
| AP2 | PF00847.11 | 21.9 | AP2 domain |
| APH | PF01636.14 | 32.5 | Phosphotransferase enzyme family |
| ATP-grasp_2 | PF08442.1 | −118.8 | ATP-grasp domain |
| ATP-synt_C | PF00137.12 | 5 | ATP synthase subunit C |
| ATP-synt_G | PF04718.6 | −7.9 | Mitochondrial ATP synthase g subunit |
| ATP-synt_ab | PF00006.16 | −37.5 | ATP synthase alpha/beta family, nucleotide-binding domain |
| ATP-synt_ab_N | PF02874.14 | 17 | ATP synthase alpha/beta family, beta-barrel domain |
| ATP_bind_1 | PF03029.8 | −19 | Conserved hypothetical ATP binding protein |
| AWPM-19 | PF05512.2 | 25 | AWPM-19-like family |
| Aa_trans | PF01490.9 | −128.4 | Transmembrane amino acid transporter protein |
| Abhydrolase_3 | PF07859.8 | 25.8 | alpha/beta hydrolase fold |
| Acetyltransf_1 | PF00583.15 | 18.6 | Acetyltransferase (GNAT) family |
| Acyltransferase | PF01553.12 | 2.2 | Acyltransferase |
| Adap_comp_sub | PF00928.12 | −5.4 | Adaptor complexes medium subunit family |
| AhpC-TSA | PF00578.12 | 4.8 | AhpC/TSA family |

TABLE 22-continued

| Pfam domain name | Accession # | gathering cutoff | domain description |
|---|---|---|---|
| Alba | PF01918.12 | 20 | Alba |
| Aldedh | PF00171.13 | −208.2 | Aldehyde dehydrogenase family |
| Aldo_ket_red | PF00248.12 | −97 | Aldo/keto reductase family |
| Alg6_Alg8 | PF03155.6 | −235.5 | ALG6, ALG8 glycosyltransferase family |
| Alpha-amyl_C2 | PF07821.3 | 25 | Alpha-amylase C-terminal beta-sheet domain |
| Alpha-amylase | PF00128.15 | −92.6 | Alpha amylase, catalytic domain |
| Aminotran_1_2 | PF00155.12 | −57.5 | Aminotransferase class I and II |
| Aminotran_3 | PF00202.12 | −206.1 | Aminotransferase class-III |
| Aminotran_5 | PF00266.10 | −164.4 | Aminotransferase class-V |
| Ank | PF00023.21 | 0 | Ankyrin repeat |
| Arf | PF00025.12 | 40 | ADP-ribosylation factor family |
| ArfGap | PF01412.9 | −17 | Putative GTPase activating protein for Arf |
| Arm | PF00514.14 | 17 | Armadillo/beta-catenin-like repeat |
| Asp | PF00026.14 | −153.8 | Eukaryotic aspartyl protease |
| Asparaginase | PF00710.11 | 25 | Asparaginase |
| Auxin_inducible | PF02519.5 | −15 | Auxin responsive protein |
| B3 | PF02362.12 | 26.5 | B3 DNA binding domain |
| BRCT | PF00533.17 | 27.8 | BRCA1 C Terminus (BRCT) domain |
| BT1 | PF03092.7 | −148.6 | BT1 family |
| B_lectin | PF01453.15 | 28.2 | D-mannose binding lectin |
| Band_7 | PF01145.16 | 10.3 | SPFH domain/Band 7 family |
| Beta_elim_lyase | PF01212.12 | −110.3 | Bela-eliminating lyase |
| Biotin_lipoyl | PF00364.13 | −2.3 | Biotin-requiring enzyme |
| Bombesin | PF02044.8 | 11.4 | Bombesin-like peptide |
| Branch | PF02485.12 | −83.5 | Core-2/I-Branching enzyme |
| Brix | PF04427.9 | 11.4 | Brix domain |
| Bromodomain | PF00439.16 | 8.9 | Bromodomain |
| C1_1 | PF00130.13 | 11.4 | Phorbol esters/diacylglycerol binding domain (C1 domain) |
| C1_2 | PF03107.7 | 26.4 | C1 domain |
| C1_3 | PF07649.3 | 25 | C1-like domain |
| C2 | PF00168.21 | 3.7 | C2 domain |
| CAF1 | PF04857.11 | −100.5 | CAF1 family ribonuclease |
| CBFD_NFYB_HMF | PF00808.14 | 18.4 | Histone-like transcription factor (CBF/NF-Y) and archaeal histone |
| CBS | PF00571.19 | 17.5 | CBS domain pair |
| CCT | PF06203.5 | 25 | CCT motif |
| CDC48_N | PF02359.9 | −2 | Cell division protein 48 (CDC48), N-terminal domain |
| CDC50 | PF03381.6 | 25 | LEM3 (ligand-effect modulator 3) family/CDC50 family |
| CDP-OH_P_transf | PF01066.12 | 0 | CDP-alcohol phosphatidyltransferase |
| CH | PF00307.22 | 22.5 | Calponin homology (CH) domain |
| CLP_protease | PF00574.14 | −77.2 | Clp protease |
| CPSase_sm_chain | PF00988.13 | 25 | Carbamoyl-phosphate synthase small chain, CPSase domain |
| CRAL_TRIO | PF00650.11 | −26 | CRAL/TRIO domain |
| CRAL_TRIO_N | PF03765.6 | 16 | CRAL/TRIO, N-terminus |
| CTP_transf_1 | PF01148.11 | −35.9 | Cylidylyltransferase family |
| Caleosin | PF05042.4 | 25 | Caleosin related protein |
| Garb_anhydrase | PF00194.12 | −105 | Eukaryotic-type carbonic anhydrase |
| Carboxyl_trans | PF01039.13 | −262.3 | Carboxyl transferase domain |
| Cellulose_synt | PF03552.5 | −257.9 | Cellulose synthase |
| Cenp-O | PF09496.1 | 25 | Cenp-O kinetochore centromere component |
| Chal_sti_synt_C | PF02797.6 | −6.1 | Chalcone and stilbene synthases, C-terminal domain |
| Chalcone | PF02431.6 | 25 | Chalcone-flavanone isomerase |
| ClpS | PF02617.8 | −15 | ATP-dependent Clp protease adaptor protein ClpS |
| Copine | PF07002.7 | −36.5 | Copine |
| Cu-oxidase | PF00394.13 | −18.9 | Multicopper oxidase |
| Cu-oxidase_2 | PF07731.5 | −5.8 | Multicopper oxidase |
| Cu-oxidase_3 | PF07732.6 | 10 | Multicopper oxidase |
| Cullin | PF00888.13 | −33.3 | Cullin family |
| Cupin_1 | PF00190.13 | −13 | Cupin |
| Cupin_2 | PF07883.2 | 19.4 | Cupin domain |
| Cyclase | PF04199.4 | −31.7 | Putative cyclase |
| Cyclin_C | PF02984.10 | −13 | Cyclin, C-terminal domain |
| Cyclin_N | PF00134.14 | −14.7 | Cyclin, N-terminal domain |
| DAD | PF02109.7 | 25 | DAD family |
| DAO | PF01266.15 | −34.9 | FAD dependent oxidureductase |
| DCP1 | PF06058.4 | −16.8 | Dcp1-like decapping family |
| DEAD | PF00270.20 | 7.2 | DEAD/DEAH box helicase |
| DEK_C | PF08766.2 | 25 | DEK C terminal domain |
| DHBP_synthase | PF00926.10 | −95.1 | 3,4-dihydroxy-2-butanone 4-phosphate synthase |
| DMRL_synthase | PF00885.10 | −43 | 6,7-dimethyl-8-ribityllumazine synthase |
| DREPP | PF05558.3 | 25 | DREPP plasma membrane polypeptide |
| DSPc | PF00782.11 | −21.8 | Dual specificity phosphatase, catalytic domain |
| DUF1279 | PF06916.4 | 25 | Protein of unknown function (DUF1279) |
| DUF1350 | PF07082.2 | −145.7 | Protein of unknown function (DUF1350) |
| DUF1475 | PF07343.2 | 25 | Protein of unknown function (DUF1475) |
| DUF1517 | PF07466.2 | 25 | Protein of unknown function (DUF1517) |
| DUF163 | PF02590.8 | −48.6 | Uncharacterized ACR, COG1576 |
| DUF1637 | PF07847.3 | 25 | Protein of unknown function (DUF1637) |

TABLE 22-continued

| Pfam domain name | Accession # | gathering cutoff | domain description |
|---|---|---|---|
| DUF167 | PF02594.7 | −3.4 | Uncharacterised ACR, YggU family COG1872 |
| DUF177 | PF02620.8 | 25 | Uncharacterized ACR, COG1399 |
| DUF220 | PF02713.5 | 25 | Domain of unknown function DUF220 |
| DUF231 | PF03005.6 | −58 | Arabidopsis proteins of unknown function |
| DUF260 | PF03195.5 | 0.8 | Protein of unknown function DUF260 |
| DUF423 | PF04241.6 | −17.6 | Protein of unknown function (DUF423) |
| DUF543 | PF04418.3 | 25 | Domain of unknown function (DUF543) |
| DUF569 | PF04601.4 | −47.6 | Protein of unknown function (DUF569) |
| DUF579 | PF04669.4 | 25 | Protein of unknown function (DUF579) |
| DUF584 | PF04520.4 | 25 | Protein of unknown function, DUF584 |
| DUF588 | PF04535.3 | 25 | Domain of unknown function (DUF588) |
| DUF59 | PF01883.10 | −7.9 | Domain of unknown function DUF59 |
| DUF594 | PF04578.4 | 25 | Protein of unknown function DUF594 |
| DUF599 | PF04654.3 | 25 | Protein of unknown function DUF599 |
| DUF6 | PF00892.11 | 21.7 | Integral membrane protein DUF6 |
| DUF607 | PF04678.4 | 25 | Protein of unknown function, DUF607 |
| DUF616 | PF04765.4 | 25 | Protein of unknown function (DUF616) |
| DUF620 | PF04788.3 | 25 | Protein of unknown function (DUF620) |
| DUF641 | PF04859.3 | 25 | Plant protein of unknown function (DUF641) |
| DUF663 | PF04950.3 | 25 | Protein of unknown function (DUF663) |
| DUF822 | PF05687.4 | 25 | Plant protein of unknown function (DUF822) |
| DUF829 | PF05705.5 | 25 | Eukaryotic protein of unknown function (DUF829) |
| DUF862 | PF05903.5 | −21.4 | PPPDE putative peptidase domain |
| DUF866 | PF05907.4 | 30.1 | Eukaryolic protein of unknown function (DUF866) |
| DUF887 | PF05967.2 | −72.3 | Eukaryotic protein of unknown function (DUF887) |
| DUF89 | PF01937.10 | −113.8 | Protein of unknown function DUF89 |
| DUF933 | PF06071.4 | 20 | Protein of unknown function (DUF933) |
| DZC | PF08381.2 | 15.3 | Disease resistance/zinc finger/chromosome condensation-like region |
| Di19 | PF05605.3 | 25 | Drought induced 19 protein (Di19) |
| Dimerisation | PF08100.2 | 25 | Dimerisation domain |
| DnaJ | PF00226.22 | −8 | DnaJ domain |
| Dus | PF01207.8 | −82.1 | Dihydrouridine synthase (Dus) |
| E3_binding | PF02817.8 | 10 | e3 binding domain |
| EB1 | PF03271.8 | 25 | EB1-like C-terminal motif |
| ECH | PF00378.11 | −57.6 | Enoyl-CoA hydratase/isomerase family |
| ELFV_dehydrog | PF00208.12 | −26.4 | Glutamate/Leucine/Phenylalanine/Valine dehydrogenase |
| ELFV_dehydrog_N | PF02812.9 | 31.8 | Glu/Leu/Phe/Val dehydrogenase, dimerisation domain |
| EMP24_GP25L | PF01105.15 | 10.4 | emp24/gp25L/p24 family/GOLD |
| ENOD93 | PF03386.5 | 25 | Early nodulin 93 ENOD93 protein |
| ENT | PF03735.5 | 25 | ENT domain |
| Enolase_C | PF00113.13 | −71.2 | Enolase, C-terminal TIM barrel domain |
| Enolase_N | PF03952.7 | 11.3 | Enolase, N-terminal domain |
| Epimerase | PF01370.12 | −46.3 | NAD dependent epimerase/dehydratase family |
| Exo_endo_phos | PF03372.14 | 11 | Endonuclease/Exonuclease/phosphatase family |
| F-box | PF00646.24 | 14.4 | F-box domain |
| F420_oxidored | PF03807.8 | −34.5 | NADP oxidoreductase coenzyme F420-dependent |
| FAD_binding_2 | PF00890.15 | −124.8 | FAD binding domain |
| FAD_binding_3 | PF01494.10 | −136.6 | FAD binding domain |
| FAE1_CUT1_RppA | PF08392.3 | −192.7 | FAE1/Type III polykelide synthase-like protein |
| FA_hydroxylase | PF04116.4 | −15.3 | Fatty acid hydroxylase superfamily |
| FBA_1 | PF07734.4 | −39.4 | F-box associated |
| FBPase | PF00316.11 | −170.3 | Fructose-1-6-bisphosphatase |
| FHA | PF00498.17 | 25 | FHA domain |
| FMO-like | PF00743.10 | −381.6 | Flavin-binding monooxygenase-like |
| FYVE | PF01363.12 | 28.5 | FYVE zinc finger |
| Fcf1 | PF04900.3 | −7.6 | Fcf1 |
| Fer2 | PF00111.18 | 7 | 2Fe—2S iron-sulfur cluster binding domain |
| FolB | PF02152.9 | 25 | Dihydroneopterin aldolase |
| Fructosamin_kin | PF03881.5 | −125.6 | Fructosamine kinase |
| G-alpha | PF00503.11 | −230 | G-protein alpha subunit |
| G-patch | PF01585.14 | 18.4 | G-patch domain |
| G6PD_C | PF02781.7 | −175 | Glucose-6-phosphate dehydrogenase, C-terminal domain |
| G6PD_N | PF00479.13 | −99 | Glucose-6-phosphate dehydrogenase, NAD binding domain |
| GASA | PF02704.5 | 25 | Gibberellin regulated protein |
| GAT | PF03127.5 | −7 | GAT domain |
| GATase | PF00117.19 | −38.1 | Glutamine amidotransferase class-I |
| GFA | PF04828.5 | 12.4 | Glutathione-dependent formaldehyde-activating enzyme |
| GH3 | PF03321.4 | −336 | GH3 auxin-responsive promoter |
| GHMP_kinases_C | PF08544.4 | 20.8 | GHMP kinases C terminal |
| GHMP_kinases_N | PF00288.17 | 17.1 | GHMP kinases N terminal domain |
| GIDA | PF01134.13 | −226.7 | Glucose inhibited division protein A |
| GLTP | PF08718.2 | −71.1 | Glycolipid transfer protein (GLTP) |
| GMP_synt_C | PF00958.13 | 25 | GMP synthase C terminal domain |
| GST_C | PF00043.16 | 22.3 | Glutathione S-transferase, C-terminal domain |
| GST_N | PF02798.11 | 14.6 | Glutathione S-transferase, N-terminal domain |
| GTP_cyclohydro2 | PF00925.11 | −49 | GTP cyclohydrolase II |
| G_glu_transpept | PF01019.12 | −236.1 | Gamma-glutamyltranspeptidase |

TABLE 22-continued

| Pfam domain name | Accession # | gathering cutoff | domain description |
|---|---|---|---|
| Gln-synt_C | PF00120.15 | −124 | Glutamine synthelase, catalytic domain |
| GlutR_N | PF05201.6 | −37.8 | Glutamyl-tRNAGlu reductase, N-terminal domain |
| GlutR_dimer | PF00745.11 | 25 | Glutamyl-tRNAGlu reductase, dimerisation domain |
| Glutaminase | PF04960.6 | −143.6 | Glutaminase |
| Glutaredoxin | PF00462.15 | 17.2 | Glutaredoxin |
| Glyco_tran_28_C | PF04101.7 | −10.4 | Glycosyltransferase family 28 C-terminal domain |
| Glyco_transf_29 | PF00777.9 | −74 | Glycosyltransferase family 29 (sialyltransferase) |
| Glyco_trans_8 | PF01501.11 | −43.2 | Glycosyl transferase family 8 |
| Glycolytic | PF00274.10 | −174.5 | Fructose-bisphosphate aldolase class-I |
| Glycos_transf_1 | PF00534.11 | −7.3 | Glycosyl transferases group 1 |
| Glyoxalase | PF00903.16 | 12.1 | Glyoxalase/Bleomycin resistance protein/Dioxygenase superfamily |
| Gp_dh_C | PF02800.11 | −64.1 | Glyceraldehyde 3-phosphate dehydrogenase, C-terminal domain |
| Gp_dh_N | PF00044.15 | −74.2 | Glyceraldehyde 3-phosphate dehydrogenase, NAD binding domain |
| Hi0933_like | PF03486.5 | −255.8 | Hi0933-like protein |
| H_PPase | PF03030.7 | −377 | Inorganic H+ pyrophosphatase |
| Helicase_C | PF00271.22 | 2.4 | Helicase conserved C-terminal domain |
| Hep_59 | PF07052.2 | 25 | Hepatocellular carcinoma-associated antigen 59 |
| Hexapep | PF00132.15 | 0.3 | Bacterial transferase hexapeptide (three repeats) |
| Hin1 | PF07320.4 | 25 | Harpin-induced protein 1 (Hin1) |
| His_biosynth | PF00977.12 | −102.4 | Histidine biosynthesis protein |
| Histone | PF00125.15 | 17.4 | Core histone H2A/H2B/H3/H4 |
| Hpt | PF01627.14 | 25 | Hpt domain |
| Hydrolase | PF00702.17 | 13.6 | haloacid dehalogenase-like hydrolase |
| IF4E | PF01652.9 | −35 | Eukaryotic initiation factor 4E |
| IQ | PF00612.18 | 11.9 | IQ calmodulin-binding motif |
| IU_nuc_hydro | PF01156.10 | −154 | Inosine-uridine preferring nucleoside hydrolase |
| Inositol_P | PF00459.16 | −55.6 | Inositol monophosphatase family |
| Invertase_neut | PF04853.3 | −233.6 | Plant neutral invertase |
| Ion_trans_2 | PF07885.7 | 24.9 | Ion channel |
| Iso_dh | PF00180.11 | −97 | Isocitrate/isopropylmalate dehydrogenase |
| KH_1 | PF00013.20 | 12.5 | KH domain |
| KH_2 | PF07650.8 | 5 | KH domain |
| KR | PF08659.1 | −74.3 | KR domain |
| Kelch_1 | PF01344.16 | 11.7 | Kelch motif |
| Kelch_2 | PF07646.6 | 14 | Kelch motif |
| LAG1 | PF03798.7 | −57.5 | Longevity-assurance protein (LAG1) |
| LANC_like | PF05147.4 | −76.9 | Lanthionine synthetase C-like protein |
| LEA_5 | PF00477.8 | 25 | Small hydrophilic plant seed protein |
| LRRNT_2 | PF08263.3 | 18.6 | Leucine rich repeat N-terminal domain |
| LRR_1 | PF00560.24 | 7.7 | Leucine Rich Repeat |
| LRR_2 | PF07723.4 | 6 | Leucine Rich Repeat |
| LSM | PF01423.13 | 13.7 | LSM domain |
| La | PF05383.8 | 25 | La domain |
| Lectin_legB | PF00139.10 | −110.1 | Legume lectin domain |
| Ligase_CoA | PF00549.10 | −43.3 | CoA-ligase |
| Lipase_3 | PF01764.16 | −8 | Lipase (class 3) |
| MACPF | PF01823.10 | −24.6 | MAC/Perforin domain |
| MATH | PF00917.17 | 0.5 | MATH domain |
| MFS_1 | PF07690.7 | 23.5 | Major Facilitator Superfamily |
| MIP | PF00230.11 | −62 | Major intrinsic protein |
| MMR_HSR1 | PF01926.14 | 31.2 | GTPase of unknown function |
| MOSC | PF03473.8 | 25 | MOSC domain |
| MOSC_N | PF03476.7 | 25 | MOSC N-terminal beta barrel domain |
| MT-A70 | PF05063.5 | −40.8 | MT-A70 |
| Malic_M | PF03949.6 | −143.9 | Malic enzyme, NAD binding domain |
| MannoseP_isomer | PF01050.9 | −70 | Mannose-6-phosphate isomerase |
| Mem_trans | PF03547.9 | −73.4 | Membrane transport protein |
| Metalloenzyme | PF01676.9 | −14.4 | Metalloenzyme superfamily |
| Metallophos | PF00149.10 | 22 | Calcineurin-like phosphoesterase |
| Methyltransf_11 | PF08241.3 | 21 | Methyltransferase domain |
| Methyltransf_12 | PF08242.3 | 23 | Methyltransferase domain |
| Methyltransf_2 | PF00891.9 | −103.8 | O-methyltransferase |
| Miro | PF08477.4 | 10.8 | Miro-like protein |
| Mito_carr | PF00153.10 | 0 | Mitochondrial carrier protein |
| Mov34 | PF01398.12 | 0.9 | Mov34/MPN/PAD-1 family |
| MIN3_slv | PF03083.7 | 9.7 | MIN3/saliva family |
| NAC | PF01849.9 | 0 | NAC domain |
| NAD_Gly3P_dh_C | PF07479.5 | −50.8 | NAD-dependent glycerol-3-phosphate dehydrogenase C-terminus |
| NAD_Gly3P_dh_N | PF01210.14 | −44 | NAD-dependent glycerol-3-phosphate dehydrogenase N-terminus |
| NAD_binding_2 | PF03446.6 | −63.5 | NAD binding domain of 6-phosphogluconate dehydrogenase |
| NAD_binding_4 | PF07993.3 | −87.7 | Male sterility protein |
| NAF | PF03822.5 | 4.5 | NAF domain |
| NAP | PF00956.9 | −122 | Nucleosome assembly protein (NAP) |
| NDK | PF00334.10 | −59.9 | Nucleoside diphosphate kinase |
| NHL | PF01436.12 | 3.8 | NHL repeat |
| NIR_SIR | PF01077.13 | −19.6 | Nitrite and sulphite reductase 4Fe—4S domain |
| NIR_SIR_ferr | PF03460.8 | 2.4 | Nitrite/Sulfite reductase ferredoxin-like half domain |

TABLE 22-continued

| Pfam domain name | Accession # | gathering cutoff | domain description |
|---|---|---|---|
| NOI | PF05627.2 | 0.3 | Nitrate-induced NOI protein |
| NOSIC | PF08060.4 | 25 | NOSIC (NUC001) domain |
| NPH3 | PF03000.5 | 25 | NPH3 family |
| NTF2 | PF02136.11 | 6 | Nuclear transport factor 2 (NTF2) domain |
| NTP_transferase | PF00483.14 | −39.9 | Nucleotidyl transferase |
| Na_Ca_ex | PF01699.15 | 25 | Sodium/calcium exchanger protein |
| Na_H_Exchanger | PF00999.12 | −67.9 | Sodium/hydrogen exchanger family |
| Na_sulph_symp | PF00939.10 | −259 | Sodium:sulfate symporter transmembrane region |
| Nfu_N | PF08712.2 | 20 | Scaffold protein Nfu/NifU N terminal |
| NifU | PF01106.8 | −5.6 | NifU-like domain |
| NifU_N | PF01592.7 | −27.4 | NifU-like N terminal domain |
| Nodulin-like | PF06813.4 | −57.8 | Nodulin-like |
| Nop | PF01798.9 | 25 | Putative snoRNA binding domain |
| Nramp | PF01566.9 | −171.4 | Natural resistance-associated macrophage protein |
| OPT | PF03169.6 | −238.6 | OPT oligopeptide transporter protein |
| ORC2 | PF04084.5 | −181.2 | Origin recognition complex subunit 2 |
| OTCace | PF00185.15 | −42 | Aspartate/ornithine carbamoyltransferase, Asp/Orn binding domain |
| OTCace_N | PF02729.12 | −55 | Aspartate/ornithine carbamoyltransferase, carbamoyl-P binding domain |
| PA | PF02225.13 | 13 | PA domain |
| PAD_porph | PF04371.6 | −180.8 | Porphyromonas-type peptidyl-arginine deiminase |
| PALP | PF00291.16 | −70 | Pyridoxal-phosphate dependent enzyme |
| PAN_1 | PF00024.17 | 1.4 | PAN domain |
| PAN_2 | PF08276.2 | −4.9 | PAN-like domain |
| PAP_fibrillin | PF04755.3 | 25 | PAP_fibrillin |
| PB1 | PF00564.15 | 12.3 | PB1 domain |
| PCI | PF01399.18 | 25 | PCI domain |
| PDCO2_C | PF04194.4 | −40.9 | Programmed cell death protein 2, C-terminal putative domain |
| PDT | PF00800.9 | 25 | Prephenate dehydratase |
| PEP-utilizers | PF00391.14 | 0.6 | PEP-utilising enzyme, mobile domain |
| PEP-utilizers_C | PF02896.9 | −173 | PEP-utilising enzyme. TIM barrel domain |
| PGAM | PF00300.13 | −3 | Phosphoglycerate mutase family |
| PGI | PF00342.10 | −168.9 | Phosphoglucose isomerase |
| PGK | PF00162.10 | −39.3 | Phosphoglycerate kinase |
| PH | PF00169.20 | 25.1 | PH domain |
| PHD | PF00628.20 | 26.2 | PHD-finger |
| PI-PLC-X | PF00388.10 | 18.8 | Phosphatidylinositol-specific phospholipase C, X domain |
| PI-PLC-Y | PF00387.10 | −11 | Phosphatidylinositol-specific phospholipase C, Y domain |
| PK | PF00224.12 | −244 | Pyruvate kinase, barrel domain |
| PK_C | PF02887.7 | −44 | Pyruvate kinase, alpha/beta domain |
| PLAC8 | PF04749.8 | −1.1 | PLAC8 family |
| PMEI | PF04043.6 | 25 | Plant invertase/pectin methylesterase inhibitor |
| PP-binding | PF00550.16 | 25.3 | Phosphopantetheine attachment site |
| PP2C | PF00481.12 | −36.3 | Protein phosphatase 2C |
| PPDK_N | PF01326.10 | −150.2 | Pyruvate phosphate dikinase, PEP/pyruvate binding domain |
| PPR | PF01535.11 | 0 | PPR repeat |
| PRA1 | PF03208.10 | 25 | PRA1 family protein |
| PRC | PF05239.7 | 25 | PRC-barrel domain |
| PRK | PF00485.9 | −28.5 | Phosphoributokinase/Uridine kinase family |
| PRMT5 | PF05185.7 | 25 | PRMT5 arginine-N-methyltransferase |
| PTA_PTB | PF01515.10 | −165.5 | Phosphate acetyl/butaryl transferase |
| PTPA | PF03095.6 | −106 | Phosphotyrosyl phosphate activator (PTPA) protein |
| PTR2 | PF00854.12 | −50 | POT family |
| PTS_2-RNA | PF01885.7 | −48 | RNA 2'-phosphotransferase, Tpt1/KptA family |
| Pentapeptide | PF00805.13 | 0 | Pentapeptide repeats (8 copies) |
| Peptidase_C12 | PF01088.12 | 10 | Ubiquitin carboxyl-terminal hydrolase, family 1 |
| Peptidase_C14 | PF00656.13 | −22.5 | Caspase domain |
| Peptidase_C48 | PF02902.10 | −13.1 | Ulp1 protease family, C-terminal catalytic domain |
| Peptidase_M16 | PF00675.11 | −38 | Insulinase (Peptidase family M16) |
| Peptidase_M16_C | PF05193.12 | 7.9 | Peptidase M16 inactive domain |
| Peptidase_M18 | PF02127.6 | −250.8 | Aminopeptidase I zinc metalloprotease (M18) |
| Peptidase_M24 | PF00557.15 | −70.7 | metallopeptidase family M24 |
| Peptidase_S8 | PF00082.13 | −51 | Subtilase family |
| Per1 | PF04080.4 | 25 | Per1-like |
| Pescadillo_N | PF06732.2 | −167.1 | Pescadillo N-terminus |
| PfkB | PF00294.15 | −67.8 | pfkB family carbohydrate kinase |
| PhzC-PhzF | PF02567.7 | −66 | Phenazine biosynthesis-like protein |
| Pkinase | PF00069.16 | 70.3 | Protein kinase domain |
| Pkinase_C | PF00433.15 | 14.1 | Protein kinase C terminal domain |
| Pkinase_Tyr | PF07714.8 | 65 | Protein tyrosine kinase |
| Polysacc_synt_2 | PF02719.6 | −176 | Polysaccharide biosynthesis protein |
| Porin_3 | PF01459.13 | −53 | Eukaryotic porin |
| Pre-SET | PF05033.7 | 3.9 | Pre-SET motif |
| Pribosyltran | PF00156.18 | 2 | Phosphoribosyl transferase domain |
| Pro_isomerase | PF00160.12 | −37 | Cyclophilin type peptidyl-protyl cis-trans isomerase/CLD |
| Proteasome | PF00227.17 | −36.7 | Proteasome A-type and B-type |
| PsbW | PF07123.3 | 6.7 | Photosystem II reaction centre W protein (PsbW) |

TABLE 22-continued

| Pfam domain name | Accession # | gathering cutoff | domain description |
|---|---|---|---|
| Pyr_redox | PF00070.18 | 5 | Pyridine nucleotide-disulphide oxidoreductase |
| Pyr_redox_2 | PF07992.5 | −20 | Pyridine nucleotide-disulphide oxidoreductase |
| Pyr_redox_dim | PF02852.13 | −13 | Pyridine nucleotide-disulphide oxidoreductase, dimerisation domain |
| Pyridoxal_deC | PF00282.10 | −158.6 | Pyridoxal-dependent decarboxylase conserved domain |
| Pyrophosphatase | PF00719.10 | −41 | Inorganic pyrophosphatase |
| RALF | PF05498.2 | 25 | Rapid ALkalinization Factor (RALF) |
| RAMP4 | PF06624.3 | 25 | Ribosome associated membrane protein RAMP4 |
| RCC1 | PF00415.9 | 21.2 | Regulator of chromosome condensation (RCC1) |
| RNA_pot_I_A49 | PF06870.3 | 25 | A49-like RNA polymerase I associated factor |
| RNA_pot_N | PF01194.8 | 25 | RNA polymerases N/8 kDa subunit |
| RNA_pol_Rpb5_C | PF01191.10 | 25 | RNA polymerase Rpb5, C-terminal domain |
| RNA_pol_Rpb5_N | PF03871.5 | −8.9 | RNA polymerase Rpb5, N-terminal domain |
| RNase_PH | PF01138.12 | 4 | 3' exoribonuclease family, domain 1 |
| RNase_PH_C | PF03725.6 | 20 | 3' exoribonuclease family, domain 2 |
| RPE65 | PF03055.6 | −156.5 | Retinal pigment epithelial membrane protein |
| RRM_1 | PF00076.13 | 17.7 | RNA recognition motif, (a.k.a. RRM, RBD, or RNP domain) |
| RRM_2 | PF04059.3 | 25 | RNA recognition motif 2 |
| RRM_3 | PF08777.2 | 0.5 | RNA binding motif |
| RRS1 | PF04939.3 | −60.5 | Ribosome biogenesis regulatory protein (RRS1) |
| Raffinose_syn | PF05691.3 | −395.7 | Raffinose synthase or seed imbition protein Sip1 |
| Ras | PF00071.13 | −69.9 | Ras family |
| Redoxin | PF08534.1 | −1 | Redoxin |
| Rep_fac_C | PF08542.2 | −0.4 | Replication factor C |
| Response_reg | PF00072.15 | 4 | Response regulator receiver domain |
| Rho_GDI | PF02115.8 | −55 | RHO protein GDP dissociation inhibitor |
| Rhodanese | PF00581.11 | 25 | Rhodanese-like domain |
| Rib_5-P_isom_A | PF06026.5 | −84.5 | Ribose 5-phosphate isomerase A (phosphoriboisomerase A) |
| Ribosomal_L12 | PF00542.10 | 25 | Ribosomal protein L7/L12 C-terminal domain |
| Ribosomal_L7Ae | PF01248.17 | 6 | Ribosomal protein L7Ae/L30e/S12e/Gadd45 family |
| Ribosomal_S5 | PF00333.11 | 25 | Ribosomal protein S5, N-terminal domain |
| Ribosomal_S5_C | PF03719.6 | 0 | Ribosomal protein S5, C-terminal domain |
| Ribosomal_S6e | PF01092.10 | 25 | Ribosomal protein S6e |
| Ribul_P_3_epim | PF00834.10 | −97.3 | Ribulose-phosphate 3 epimerase family |
| Rick_17_kDa_Anti | PF05433.6 | 23.2 | Rickettsia 17 kDa surface antigen |
| RmID_sub_bind | PF04321.8 | −171.8 | RmID substrate binding domain |
| SAM_1 | PF00536.21 | 11.3 | SAM domain (Sterile alpha motif) |
| SAM_2 | PF07647.8 | 0 | SAM domain (Sterile alpha motif) |
| SATase_N | PF06426.5 | 25 | Serine acetyltransferase, N-terminal |
| SBF | PF017513.7 | −27.8 | Sodium Bile acid symporter family |
| SET | PF00856.19 | 23.5 | SET domain |
| SFT2 | PF07770.3 | −14.4 | SFT2-like protein |
| SH3_1 | PF00018.19 | −8 | SH3 domain |
| SH3_2 | PF07653.8 | 0 | Variant SH3 domain |
| SIP1 | PF04938.3 | 25 | Survival motor neuron (SMN) interacting protein 1 (SIP1) |
| SMP | PF04927.3 | 25 | Seed maturation protein |
| SNARE | PF05739.10 | 23.8 | SNARE domain |
| SNF5 | PF04855.3 | 25 | SNF5/SMARCB1/INI1 |
| SOS_PSY | PF00494.10 | −78 | Squalene/phytoene synthase |
| SRF-TF | PF00319.9 | 11 | SRF-type transcription factor (DNA-binding and dimerisation domain) |
| SRPRB | PF09439.1 | −45.6 | Signal recognition particle receptor beta subunit |
| SSB | PF00436.16 | 0.4 | Single-strand binding protein family |
| STAS | PF01740.12 | 0 | STAS domain |
| STT3 | PF02516.5 | −175 | Oligosaccharyl transferase STT3 subunit |
| SWIB | PF02201.9 | −5.7 | SWIB/MDM2 domain |
| SYF2 | PF08231.3 | 25 | SYF2 splicing factor |
| S_locus_glycop | PF00954.11 | −12.7 | S-locus glycoprotein family |
| Sad1_UNC | PF07738.4 | −20.4 | Sad1/UNC-like C-terminal |
| Sec1 | PF00995.14 | −272 | Sec1 family |
| Sec61_beta | PF03911.7 | 25 | Sec61beta family |
| Sedlin_N | PF04628.4 | −22.1 | Sedlin, N-terminal conserved region |
| SelR | PF01641.9 | −66.5 | SelR domain |
| Shikimate_DH | PF01488.11 | −4.4 | Shikimate/quinate 5-dehydrogenase |
| Sina | PF03145.7 | −48.4 | Seven in absentia protein family |
| Skp1 | PF01466.10 | −2 | Skp1family, dimerisation domain |
| Skp1_POZ | PF03931.6 | 14.9 | Skp1 family, tetramerisation domain |
| Smg4_UPF3 | PF03467.6 | −27.5 | Smg-4/UPF3 family |
| Snf7 | PF03357.12 | −22.9 | Snf7 |
| Spc97_Spc98 | PF04130.4 | −136.8 | Spc97/Spc98 family |
| Steroid_dh | PF02544.7 | −44.7 | 3-oxo-5-alpha-steroid 4-dehydrogenase |
| Str_synth | PF03088.7 | 4.7 | Strictosidine synthase |
| Subtilisin_N | PF05922.7 | 26.1 | Sublilisin N-terminal Region |
| Suc_Fer-like | PF06999.3 | −42.4 | Sucrase/ferredoxin-like |
| Sugar_tr | PF00083.15 | −85 | Sugar (and other) transporter |
| Sulfate_transp | PF00916.11 | −131.5 | Sulfate transporter family |
| Sybindin | PF04099.3 | −44.4 | Sybindin-like family |
| Synaptobrevin | PF00957.12 | 25 | Synaptobrevin |
| Syntaxin | PF00804.16 | 11.4 | Syntaxin |

TABLE 22-continued

| Pfam domain name | Accession # | gathering cutoff | domain description |
|---|---|---|---|
| TATA_RF | PF08612.2 | 25 | TATA-binding related factor (TRF) |
| TB2_DP1_HVA22 | PF03134.10 | −6.9 | TB2/DP1, HVA22 family |
| TBC | PF00566.9 | −58 | TBC domain |
| TBP | PF00352.12 | −8 | Transcription factor TFIID (or TATA-binding protein, TBP) |
| TFIID-18 kDa | PF02269.7 | −7.3 | Transcription initiation factor IID, 18 kD subunit |
| TFIID-31 kDa | PF02291.6 | 25 | Transcription initiation factor IID, 31 kD subunit |
| TFIID_30 kDa | PF03540.4 | 25 | Transcription initiation factor TFIID 23-30 kDa subunit |
| TIM | PF00121.9 | −97 | Triosephosphate isomerase |
| TLC | PF03219.5 | 25 | TLC ATP/ADP transporter |
| TPP_enzyme_C | PF02775.12 | 19.7 | Thiamine pyrophosphate enzyme, C-terminal TPP binding domain |
| TPP_enzyme_M | PF00205.13 | −8.1 | Thiamine pyrophosphate enzyme, central domain |
| TPP_enzyme_N | PF02776.9 | −70 | Thiamine pyrophosphate enzyme, N-terminal TPP binding domain |
| TPT | PF03151.7 | −15.3 | Triose-phosphate Transporter family |
| Tbf5 | PF06331.3 | 25 | Transcription factor TFIIH complex subunit Tfb5 |
| Tetraspannin | PF00335.11 | −15.4 | Tetraspanin family |
| ThiF | PF00899.12 | −38.4 | ThiF family |
| Thioredoxin | PF00085.11 | −25.7 | Thioredoxin |
| Thr_dehydrat_C | PF00585.9 | −7.9 | C-terminal regulatory domain of Threonine dehydratase |
| Transket_pyr | PF02779.15 | −49 | Transketolase, pyrimidine binding domain |
| Transketolase_C | PF02780.11 | −15.5 | Transketolase, C-terminal domain |
| TrkA_C | PF02080.12 | 25 | TrkA-C domain |
| TrkA_N | PF02254.9 | 4.7 | TrkA-N domain |
| Tryp_alpha_amyl | PF00234.13 | −0.2 | Protease inhibitor/seed storage/LTP family |
| Tyr-DNA_phospho | PF06087.3 | −152.8 | Tyrosyl-DNA phosphodiesterase |
| U-box | PF04564.6 | −7.6 | U-box domain |
| U3_snoRNA_C | PF09384.1 | 25 | U3 small nucleolar RNA C terminal |
| UBA | PF00627.22 | 20.7 | UBA/TS-N domain |
| UBX | PF00789.11 | 10 | UBX domain |
| UDPG_MGDP_dh | PF00984.10 | −6.9 | UDP-glucose/GDP-mannose dehydrogenase family, central domain |
| UDPG_MGDP_dh_C | PF03720.6 | 0.8 | UDP-glucose/GDP-mannose dehydrogenase family, UDP binding domain |
| UDPG_MGDP_dh_N | PF03721.5 | −74.8 | UDP-glucose/GDP-mannose dehydrogenase family, NAD binding domain |
| UIM | PF02809.11 | 16.6 | Ubiquitin interaction motif |
| UPF0061 | PF02696.5 | −200 | Uncharacterized ACR, YdiU/UPF0061 family |
| UPF0139 | PF03669.4 | 25 | Uncharacterised protein family (UPF0139) |
| UPF0153 | PF03692.6 | 11.7 | Uncharacterised protein family (UPF0153) |
| UPF0185 | PF03671.5 | 11.6 | Uncharacterised protein family (UPF0185) |
| UQ_con | PF00179.17 | −30 | Ubiquitin-conjugating enzyme |
| Ubie_methyltran | PF01209.9 | −117 | ubiE/COQ5 methyltransferase family |
| Usp | PF00582.17 | 21.6 | Universal stress protein family |
| V-ATPase_G | PF03179.6 | −19.8 | Vacuolar (H+)-ATPase G subunit |
| VHS | PF00790.10 | −13.2 | VHS domain |
| VQ | PF05678.5 | 25 | VQ motif |
| WAK | PF08488.2 | 25 | Wall-associated kinase |
| WD40 | PF00400.23 | 21.5 | WD domain, G-beta repeat |
| Whi5 | PF08528.2 | 25 | Whi5 like |
| X8 | PF07983.4 | −28.8 | X8 domain |
| XH | PF03469.5 | 25 | XH domain |
| XS | PF03468.5 | 25 | XS domain |
| YDG_SRA | PF02182.8 | 25 | YDG/SRA domain |
| YIF1 | PF03878.6 | −81.2 | YIF1 |
| YTH | PF04146.6 | 25 | YT521-B-like family |
| Y_phosphatase2 | PF03162.4 | −47.6 | Tyrosine phosphatase family |
| YgbB | PF02542.7 | 25 | YgbB family |
| Zip | PF02535.13 | −25.6 | ZIP Zinc transporter |
| adh_short | PF00106.16 | −40.2 | short chain dehydrogenase |
| dsrm | PF00035.16 | 24.6 | Double-stranded RNA binding motif |
| eIF2A | PF08662.2 | 0 | Eukaryotic translation initiation factor eIF2A |
| eIF3_subunit | PF08597.1 | 11.9 | Translation initiation factor eIF3 subunit |
| efhand | PF00036.23 | 21.7 | EF hand |
| efhand_like | PF09279.2 | 8.8 | Phosphoinositide-specific phospholipase C, efhand-like |
| iPGM_N | PF06415.4 | −263.4 | BPG-independent PGAM N-terminus (iPGM_N) |
| mTERF | PF02536.5 | −60 | mTERF |
| malic | PF00390.10 | 25 | Malic enzyme, N-terminal domain |
| p450 | PF00067.13 | −105 | Cytochrome P450 |
| peroxidase | PF00141.14 | −10 | Peroxidase |
| polyprenyl_synt | PF00348.8 | −43 | Polyprenyl synthetase |
| tRNA-synt_1c | PF00749.12 | −130.2 | tRNA synthetases class I (E and Q), catalytic domain |
| tRNA-synt_1c_C | PF03950.9 | 25 | tRNA synthetases class I (E and Q), anti-codon binding domain |
| zf-A20 | PF01754.7 | 25 | A20-like zinc finger |
| zf-AN1 | PF01428.7 | 0 | AN1-like Zinc finger |
| zf-C2H2 | PF00096.17 | 17.7 | Zinc finger, C2H2 type |
| zf-C3HC4 | PF00097.16 | 16 | Zinc finger, C3HC4 type (RING finger) |
| zf-CCCH | PF00642.15 | 0 | Zinc finger C-x8-C-x5-C-x3-H type (and similar) |
| zf-CCHC | PF00098.14 | 17.9 | Zinc knuckle |
| zf-DHHC | PF01529.11 | −11 | DHHC zinc finger domain |

TABLE 22-continued

| Pfam domain name | Accession # | gathering cutoff | domain description |
|---|---|---|---|
| zf-MYND | PF01753.9 | 11 | MYND finger |
| zf-Tim10_DDP | PF02953.6 | −5 | Tim10/DDP family zinc finger |

Example 10. Selection of Transgenic Plants with Enhanced Agronomic Trait(s)

This example illustrates identification of plant cells of the invention by screening derived plants and seeds for enhanced trait. Transgenic seed and plants in corn, soybean, cotton or canola with recombinant DNA identified in Table 2 are prepared by plant cells transformed with DNA that is stably integrated into the genome of the corn cell. Transgenic corn plant cells are transformed with recombinant DNA from each of the genes identified in Table 2. Progeny transgenic plants and seed of the transformed plant cells are screened for enhanced water use efficiency, enhanced cold tolerance, increased yield, enhanced nitrogen use efficiency, enhanced seed protein and enhanced seed oil as compared to control plants A. Selection for Enhanced Nitrogen Use Efficiency Transgenic corn seeds provided by the present invention are planted in fields with three levels of nitrogen (N) fertilizer being applied, e.g. low level (0 N), medium level (80 lb/ac) and high level (180 lb/ac). A variety of physiological traits are monitored. Plants with enhanced NUE provide higher yield as compared to control plants.

B. Selection for Increased Yield

Effective selection of enhanced yielding transgenic plants uses hybrid progeny of the transgenic plants for corn, cotton, and canola, or inbred progeny of transgenic plants for soybeanplants plant such as corn, cotton, canola, or inbred plant such as soy, canola and cottoncotton over multiple locations with plants grown under optimal production management practices, and maximum pest control. A target for improved yield is about a 5% to 10% increase or more in yield as compared to yield produced by plants grown from seed for a control plant. Selection methods can be applied in multiple and diverse geographic locations, for example up to 16 or more locations, over one or more planting seasons, for example at least two planting seasons, to statistically distinguish yield improvement from natural environmental effects.

C. Selection for Enhanced Water Use Efficiency (WUE)

The selection process imposes a water withholding period to induce stressdrought followed by watering. For example, for corn, a selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

D. Selection for Growth Under Cold Stress (1) Cold germination assay—Trays of transgenic and control seeds are placed in a growth chamber at 9.7° C. for 24 days (no light). Seeds having higher germination rates as compared to the control are identified.

(2) Cold field efficacy trial—A cold field efficacy trial is used to identify gene constructs that confer enhanced cold vigor at germination and early seedling growth under early spring planting field conditions in conventional-till and simulated no-till environments. Seeds are planted into the ground around two weeks before local farmers begin to plant corn so that a significant cold stress is exerted onto the crop, named as cold treatment. Seeds also are planted under local optimal planting conditions such that the crop has little or no exposure to cold condition, named as normal treatment. At each location, seeds are planted under both cold and normal conditions with 3 repetitions per treatment. Two temperature monitors are set up at each location to monitor both air and soil temperature daily.

Seed emergence is defined as the point when the growing shoot breaks the soil surface. The number of emerged seedlings in each plot is counted everyday from the day the earliest plot begins to emerge until no significant changes in emergence occur. In addition, for each planting date, the latest date when emergence is 0 in all plots is also recorded. Seedling vigor is also rated at V3-V4 stage before the average of corn plant height reaches 10 inches, with 1=excellent early growth, 5=Average growth and 9=poor growth. Days to 50% emergence, maximum percent emergence and seedling vigor are used to determine plants with enhanced cold tolerance.

E. Screens for Transgenic Plant Seeds with Increased Protein and/or Oil Levels

This example sets forth a high-throughput selection for identifying plant seeds with improvement in seed composition using the Infratec 1200 series Grain Analyzer, which is a near-infrared transmittance spectrometer used to determine the composition of a bulk seed sample (Table 26). Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides predicted values as well as information on how well the sample fits in the calibration.

Infratec Model 1221, 1225, or 1227 with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc. Software. Calculations are performed automatically by the software. Seed samples are received in packets or containers with barcode labels from the customer. The seed is poured into the cuvettes and analyzed as received.

TABLE 23

| | |
|---|---|
| Typical sample(s): | Whole grain corn and soybean seeds |
| Analytical time to run method: | Less than 0.75 min per sample |
| Total elapsed time per run: | 1.5 minute per sample |

TABLE 23-continued

| | |
|---|---|
| Typical and minimum sample size: | Corn typical: 50 cc; minimum 30 cc<br>Soybean typical: 50 cc; minimum 5 cc |
| Typical analytical range: | Determined in part by the specific calibration.<br>Corn - moisture 5-15%, oil 5-20%, protein 5-30%, starch 50-75%, and density 1.0-1.3%.<br>Soybean - moisture 5-15%, oil 15-25%, and protein 35-50%. |

Example 11. Cotton Transgenic Plants with Enhanced Agronomic Traits

Cotton transformation is performed as generally described in WO0036911 and in U.S. Pat. No. 5,846,797. Transgenic cotton plants containing each of the recombinant DNA having a sequence of SEQ ID NO: 1 through SEQ ID NO: 803 are obtained by transforming with recombinant DNA from each of the genes identified in Table 2. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, e.g. cotton variety ST474, cotton variety FM 958, and cotton variety Siokra L-23, are used to compare the relative performance of the transgenic cotton plants containing the recombinant DNA. The specified culture conditions are growing a first set of transgenic and control plants under "wet" conditions, e.g. irrigated in the range of 85 to 100 percent of evapotranspiration to provide leaf water potential of −14 to −18 bars, and growing a second set of transgenic and control plants under "dry" conditions, e.g. irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for: the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 12. Canola Plants with Enhanced Agrominic Traits

This example illustrates plant transformation in producing the transgenic canola plants of this invention and the production and identification of transgenic seed for transgenic canola having enhanced water use efficiency enhanced cold tolerance, increased yield, enhanced nitrogen use efficiency, enhanced seed protein and enhanced seed oil.

Tissues from in vitro grown canola seedlings are prepared and inoculated with a suspension of overnight grown *Agrobacterium* containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterizations are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 2. Transgenic progeny plants and seed of the transformed plant cells are screened for enhanced water use efficiency, enhanced cold tolerance, increased yield, enhanced nitrogen use efficiency, enhanced seed protein and enhanced seed oil.

Example 13. Selection of Transgenic Plants with Enhanced Agronomic Trait(s)

This example illustrates the preparation and identification by selection of transgenic seeds and plants derived from transgenic plant cells of this invention where the plants and seed are identified by screening for a transgenic plant having an enhanced agronomic trait imparted by expression or suppression of a protein selected from the group including the homologous proteins identified in Example 7. Transgenic plant cells of corn, soybean, cotton, canola, alfalfa, wheat and rice are transformed with recombinant DNA for expressing or suppressing each of the homologs identified in Example 7. Plants are regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. Plants are identified exhibiting enhanced traits imparted by expression or suppression of the homologous proteins.

Example 14. Monocot and Dicot Plant Transformation for the Suppression of Endogeneous Protein This example illustrates monocot and dicot plant transformation to produce nuclei of this invention in cells of a transgenic plant by transformation where the recombinant DNA suppresses the expression of an endogenous protein identified in Table 24.

Corn, soybean, cotton, or canola tissue are transformed as described in Examples 2-5 using recombinant DNA in the nucleus with DNA that is transcribed into RNA that forms double-stranded RNA targeted to an endogenous gene with DNA encoding the protein. The genes for which the double-stranded RNAs are targeted are the native gene in corn, soybean, cotton or canola that are homologs of the genes encoding the protein that has the function of the protein of *Arabidopsis thaliana* as identified in Table 24.

Populations of transgenic plants prepared in Examples 3, 4, 5, 6, or 13 with DNA for suppressing a gene identified in Table 2 as providing an enhanced trait by gene suppression are screened to identify an event from those plants with a nucleus of the invention by selecting the trait identified in this specification.

TABLE 24

| PEP SEQ ID | Pfam module | Construct ID | Traits | |
|---|---|---|---|---|
| 115 | AP2 | 10177 | LN | |
| 116 | zf-C2H2 | 12155 | CS | SS |

TABLE 24-continued

| PEP SEQ ID | Pfam module | Construct ID | Traits | |
|---|---|---|---|---|
| 118 | F-box::Tub | 11873 | LN | PEG |
| 154 | Pex2_Pex12::zf-C3HC4 | 11113 | CS | |
| 188 | Myb_DNA-binding::Myb_DNA-binding | 12325 | LN | |
| 200 | bZIP_1 | 71228 | CK | |

SEQUENCE LISTING (94734 sequences)

SEQ ID NO: 1 - DNA, 1526 bp, Arabidopsis thaliana
tttaattaaatggaagatatcatcatcggcgtggtggctctcgccgcggttctccttttcttcctctaccaaaaaccgaaaaccaaacggtacaagctacctccagggccatcaccacttccggtgatcggaaacctccttcagcttcagaagcttaacccacaacgcttcttcgctggatgggccaaaaaatacggtccaatcttgtcatacaggataggaagcagaacaatggtggtgatatcttcagctgagctagctaaagagcttctcaagacgcaagatgtcaactttgcggaccggcctccacatcgtggccatgagttcatatcctacggcaggcgtgacatggcattaaaccactacacaccgtattaccgagagataaggaagatggggatgaaccacttgttctcaccaacacgtgtggccacctttaagcatgtacgagaggaagaggctaggaggatgatggataagatcaacaaggccgcggataaatccgaagtagtcgatataagtgagcttatgctgaccttcacgaactcggttgtgtgtagacaagcgttcgggaagaagtacaatgaagatggagaagagatgaagaggttcatcaagattctttatgggactcaaagcgttttggggaagatctttttctctgattttttcccatattgtggctttcttgatgatttatcaggcctcacagcttatatgaaagagtgtttcgaaagacaagacacttatattcaagaggttgtcaatgagacgcttgatcctaagagagtcaagcccgaaaccgagagcatgattgatctcttgatggggatctacaaagaacaacctttcgcttctgagtttactgtagataatgtcaaagccgtcatcttggatattgtagtggcgggaacagatactgcagctgcggcggttgtgtgggggatgacgtatctaatgaagtacccacaagtgttgaagaaagctcaagcagaagtgagagagtatatgaaagagaaaggttcaacgttcgttactgaagacgatgtcaagaaccttccttacttcagagccttagttaaagaaaccctaaggatcgaaccagtgattcctctccttatccctcgtgcttgcattcaagataccaagatcgccggttacgacatccccgcaggaacaacggtcaacgtcaacgcgtgggccgtgtcacgtgacgagaaagaatggggaccgaaccctgatgagttcaggcccgagaggtttcttgagaaggaagttgacttcaaaggcacggactacgagtttataccgttcgggtcaggccggagaatgtgcccgggaatgcgtcttggggccgcgatgcttgaggttccttatgcgaaccttctcctcagcttcaactttaaacttcctaatgggatgaaaccagatgatatcaatatggatgtcatgactggtcttgctatgcacaagtcgcagcatctcaagcttgttccagagaaagtgaacaagtattagatttaaat

SEQ ID NO: 2 - DNA, 522 bp, Arabidopsis thaliana
attgtttcacaaacttcaaatattattcatttatttgtcagctttcaaactctttgtttcttgtttgttgattaacccttaattaagaaaatgacaacggcgatgatgatattcgcggttttggttacagtggtggaggtggaagcacagactgagtgcgtgagcaagatagttccctgcttcaggttcttgaacacgacaacaaagccgtcgacggattgttgcaactcgatcaaggaagcgatggagaaagattttagctgtctctgcaccatctacaacactcctggtttactcgctcagttcaacatcactacagatcaagctctcggtctcaaccttcgatgtggagtcaacactgatctatccgcttgttccggtactttaattctccaagatcttcgaccgttgcaattatgaatcatttaaatacccagaaattggagctctgcagagctttcgttcgtatcatcggtttcgacaacgttcgtcaagttcaatgcatcagtttcattgcgcaca

SEQ ID NO: 3 - DNA, 1380 bp, Arabidopsis thaliana
atgggaagtatcgtggagccatgggcagcaatcgccgagaacggaaacgcaaacgtgaccgcgaaaggctcgagcagggagctgcgacatgggagaacagcacacaacatgtcttcatcgtcgctaaggaagaaatcagacctgagattggttcagaaagttccatgcaaaactctcaagaacattctctctaatcttcaagaagtcattcttggtactaagcttactctcttatttctcgccatccctctcgccattcttgccaattcttacaactacggtcgtccgttgatatttggactgagcttgatagggctgacacctctagctgagcgagttagctttttgacagagcaactagctttctacactggtccaacagtgggcggtttgttgaacgcgacttgtggaaacgcgacagagctgataatcgcgatactagcgttggccaataacaaagtggcagtggtgaaatactctctattgggttcaattctctcaaaccttctcttggttcttggcacttccctcttctttggtggtatcgccaatatccgccgcgagcagcggttcgaccggaaacaagccgatgtgaacttcttcttgctgcttatgggcctgttgtgtcatttgctgccattattgttaaaatatgcagcaaccggcgaagtatcgacctctatgattaacaaaatgtcgctcactctgtcgcggacaagcagcatagttatgcttattgcttacattgcttatctcatcttccagctctggactcaccgccaattgtttgaggcacaacaggatgatgatgatgcatatgatgatgaggttagtgttgaagaaactccagtgataggattctggagcggatttgcttggctcgttgggatgacaatagtcatcgcattgctatcagagtatgttgtggacacgatcgaggatgcatcggactcatggggactatcagtgagtttcataagcatcatattgcttcccattgttgggaatgcggctgagcatgctggagccatcattttcgcattcaagaacaagctcgacatatctctaggggttgcgttgggctctgcaactcagatttctttgttcgtggtcccattgagtgttatcgttgcgtggatcctgggaataaaaatggatctcaactttaacatccttgaaactagctctctagctttggccattatcatcacagccttcactttacaggatggaacttctcattacatgaagggactggttctattgttatgctatgtcatcatcgcggcgtgtttcttcgtcgaccaaattccccaaccaaatgatttggacgtgggacttcaacccatgaacaatttgggagaagttttctcagcttaa

SEQ ID NO: 4 - DNA, 911 bp, Arabidopsis thaliana
atggcgacgactagtttagtgaccggactaaaagtggtattaccggttatgttctgtctgatgctagcgactcttgtctacaccatcatcaccgatggccttcctttacctgatcgtcaagatgtcttcacaccatggttcgttacgacaattttggatttctacattaatcttgtacctatagcggtttggattgtgtataaggagtctacatggtctggttcaatactttggaccattttgctcatcatttttggcagcctcacgacatgtgtgtatctgtttctgcaacttctcaagctgacaaatcaagaagcttcagaagatcctatgtactatttgttacttcgagattcaatcaaggatggagttggtctgagagacaagaattcacttgttgtcactgcaagatttgtgtttggtgccttaggatgtgtgatgctaggagctttggtttacacttgcttcacttatggttctcctttccacatggagcttctatacccgtggatggtggttttattggttaacttctacattgatgttgctgtcttatcagtttgggttgtctataaagaatctagtttgatcattggaattctatgggttgctctattgataggtcttggcagcgttggcacgagcgcagtcattgtcgtgcagctattccgtctgtctcctctcgacccgctctacctcgttctagtgaacaacagcaatcgggctggagatatgtacgagcgcactcattctgcggctttgcgcataatgtgaagctttgtcatttcatttttaacattttaccacaaaagttcaaaacatatttttatctacattttaagtttgtatgtttcatagttttcttctgtatatactttctcttatgtgacgacaattacttatgtacttaa

SEQ ID NO: 5 - DNA, 375 bp, Arabidopsis thaliana
atgcaaatgctaagaaacttaagcacgaggacgaggagtcgtcgcggcggatatgagcgtgtaagcgatgattccaccttcagcctacttggagcaaagctaaggaggtcaacgagcgttccatactatgctccatcgataaggcttggtggagattttcctgtgattttggaaaagcttccacgccaaaaaccaactaaaacagtggtgacaagcaaattaagccatccaatcttcagtttatttgatggttatcgccgccataacaagaagaaagcgacggctaaaccggagttctctagataccatgaataccttaaagaaagtggaatgtgggatttgagatctaatagtccggtcatctactttaagtag

SEQ ID NO: 6 - DNA, 1303 bp, Arabidopsis thaliana
atggataattgtactggagaaaatcccatggcttctcagttgaacattctccgatgcccgttcttgaggaacatcaatgagcccactaacctctctttctcttcatccttgccttttcccatccctgtaagtaaccgtctgttggttcactccatattgacatttcttatagattctgatcttgtctcatcatatatataggcaagagctgggaaaggacctatatttgaagatggtcccaattttgatacggcgtttaggcttttccatggccaagatggagttgtccctctctctgacaccgctcgaactgaagcccagaagcctgtgcctgtattccatccacttgctgctaaggcggccactattagtctctcatcctttggatctggagggccttttggatttgatgcattttctgacatgtttaaaaatcaaaagaagaagtcagattcatccaaaaataaggtaaaggttttatgagtttcttgctcaacatttatcttttaaaactgatgtgcataggtaaagaaatgtgtctaaggaaatagttaagcttctaagattgcttaagtagtatgcaatgtgttggcttatgagatagaaaatcatgatatttcttttctcttagagcaccgcttaattgttgtttctctttcagggaggaaaccacgaagccatgggcgacgaatggcttaaaacaggaaactgcccaatagcaaaatcatatcgagctgtaagtggtgtggcaccacttgtggcaaagatcctgcaaccccctccaggcatgaaatttaaatgccctcaagcaatagtcacagctcgagcagcgatatcaaaaacacctttcgccaagaacctccgtccacaacctttaccagctaaagtactagtgatcgggatgctgggcatggcgttaaatgtgcctttaggggtctggagagagcacactgaaaagttttcggcatcttggtttatagctcttcacgcagcggttccattcataggaatactgagaaagtcagtgttgatgcctaaaacagctatggtattcaccatagcagcatcagttttgggacaggtgattgggtcaagagcagagaggcggagactcaagtctgtagctgagaagaagttgacattggaggtaccaaatccgtcttctgttgaagcagatcagatgcaatttgccggagtttcatcagatggaagatgcggtgataaagtggtgatgaagtggaatcccatgatgcttgatgttgcaagccctgtgtcttccggagcagctactgttgtctgctaa

SEQ ID NO: 7 - DNA, 273 bp, Arabidopsis thaliana
atggcgttgagaagggtttacagtgaaatcagagggaagaaggtgacggagcttccaggctatatcaaatcgactttttcaatggagaccgtgaagacctctgtgaagagaggactcgataactacaacgaaaaatacattcagaccagctccgttgatcctatccttcatatctgcttctacggcatggctttctcttaccttgtcgctctccctaatgagcgtcgccatcttgagcatcagcagcatgctaaggagcacggtggtcattga

SEQ ID NO: 8 - DNA, 351 bp, Arabidopsis thaliana
atgcaagattcaaagattccacctttctctgaagcaaaaagaatgaagattcctactccaaaacaacccttgactcaactaccaccacgtatcgggaaaaaagtttcaaatcggagcaaatcgaaccaggttcatgcgatttcacatcaacttgagatgtctccaaattcagattcatctccaggaaacgagtacagagcactgagacgcaagtatttgctgctagaggaagatagtttcgcgttggagagagagttaaaggaagcagaggatgaggttaaagcacttgaagatgagaaacttgagctcttggacaaactcgttgttatggaaggtttagttgatccttga

SEQ ID NO: 9 - DNA, 1122 bp, Arabidopsis thaliana
atggagtttggattagccacttcgagttttctgggtactcaactaatcccggccactctgtttagcaaacgagctcgagctttgtctctcaccgtcacagcgaccggtggcagcagaaacaataaggtttacacgaggcttgattcttgtctagtgattcctcctcctcctaaattcaagaaaccgcgtgctattgttaaattcttgggaggtgccttcgtcggagctgttcctgaactcacttacagttaccttaaggagctactggcaaaggaagggtatttgatagtatctgtgccgtacaatgttacatttgatcatgaacaagctgctaagcaagtttatgagaggtttaattcatgcttggacacgattgtctcatctggaattccaaattcaaacttgaagcctggagatttagctgaccttcctcttttctcagttggtcacagtaatggtgcactgctccaagttttgaccggaagttattttgctgagaagataccaaaggttaatgccattatttcattcaataacaaatcagcgacagaggcggttccatattttgagcagcttggtcctctcatccagcagatgctgccaatggtggaagcttctccagtatatgaaatggctcgaaatgcttcaggtgatgttttgaaactcttacttgacacagctgggacaacgattctaaacaacgatcaagaagctcttaagtcatttactaaattggtggatcaattgccatcagtatttggtgaggtaggacaaggagtgtcagaattcagaccgtcaccacttgagaatcgcaattgcttcaagtgctcctacagcgttccacacactctactggtacaattcaactccgatgcaatcgacgagactgatttgctcgaagaaactcttaggcctcggatagaatctattggtggtacacttgaaaaggttcggctgaacggaaaccatcttacaccttgcatacaggatccaaagtggcaaattgggactgtgtacacgccagcagacgctgtggctcaggcgctaaagaccattcctcttagcgaaactcgagttctttccaggacgatcgttgactggtttagacggtttgagaattga

SEQ ID NO: 10 - DNA, 912 bp, Arabidopsis thaliana
tataatataatctccaaatcactaattatgacctcacattttaggataatgttttttttttaaatgcttatggtcaagaaagaagataacgattcaagccacacgaaacagaagaagacaatggcctctctcttcacaccatcaccaaccaccactagtagtagtggagacaccatctatgtagcggcggtgccgcttaaagccgcggccggtccgccgcaacttattatgtcaatggcttactcacttaatatctcaaatttacaacatttcatggtcctcatcaaaccttcttctccaatccgtcaagaggtttctctatctatataactttcactaaaatgcataaatgagttaataatacttgttgacctaatccgttttgtggaatctttaggttcttgtgtttgattttcagccacgtaaccctgaaagcatagaagcagcaatctcacttttgtcaggaaatttgattccaggttctgattctcagacatcgaatgtaatctgtgattcagacaacttttctctgattttcaacgaacctttttgatcatgcaaatgtagtcaagattctgatcaaagaaaattatttgtttggttacaggtgtagttttgcaaagaaggttgaagaatgttccaagacaaagatgttggatggttggaccatctaaagggaatgatgctatggaaatggcaatggagtttaataagtcatgggagactgatttgagagttggatttcatgattgccgacattataccaatggtttagtgttatacaagctttaatttaatcaagaagactttggtttttatttgtttctaagtgtttttggtttttaatcttttggaatacagaacttgtccaacatcttaccggagaaatgcaaattgtggagcgacttccaa

SEQ ID NO: 11 - DNA, 997 bp, Arabidopsis thaliana
ttgttgattaacccttaattaacctccgtctgtgaaatcaagggttttctctgatctgggttttgatcagaaatcagatctaggtttaatttccgaaatcaaattatgaggaagagagaaagagagaacccttgttcgatttgtgggcattaccataagtacgaggaaggagaagtatgtggagtctgtggtcactgtatgcctgtttcttccgatacggtggcgccgcaacaagtccacgtcagtgcttttccgtcggagattctccctgagtttctttacctcggtagttacgacaacgcttctcgctctgagcttcttaagactcaaggaatctctcgtgttcttaatacggttcctatgtgccagaatctctacaggaattcattcacttatcatggtcttgataatgaaaaagttttacagtttgatgatgctattaagttcttagaccaatgtgagaaggacaaggcacgtgttcttgtgcattgcatgtctgggaaaagtagatcaccagcggttgttgtagcgtacttgatgaaacgaaaagggtggagactcgctgagagtcatcagtgggttaaacaacggagaccaagcactgacataagtccagagttttaccaacaactgcaggagtttgagcaggggatattcggatctgagatgatgtcggcgatgaatattaatgatgctccaacgtttgggtttggtttccctaagattgataatcaagcacaagctcctgtgttcaacaatgctcctacttcttctatattttcatctcctgcttcgagtatccctcctcaggagttcacttttggagcaactccaccaaagccaacaactggtggtgatattgcaatggatggctcttagaaccagataatcatatactcttgcaagaattttcatcaacaaatatactgttgtgagaatgtttctttttcttttttgtacatggagattggtgcattgcggcgcgccaaaaattgga

SEQ ID NO: 12 - DNA, 165 bp, Arabidopsis thaliana
atgttcccaggaatgttcatgcgaaagccagacaaagccgaggctctgaagcagctacgcactcatgtcgctctttttggcagctgggttgtcattatccgtgctgctccctacgtcctctcctatttctccgattccaaagatgagctcaagatcgatttctaa

SEQ ID NO: 13 - DNA, 741 bp, Arabidopsis thaliana
ttcaaactctttgtttcttgtttgttgattaacccttaattaatgcaactctctcaacaaacacataatataaatatatttacctacatcagattcttcatacacattgtaatcaatagaccatagagatttacatggcgacttctaccttctcttctcgtggggcacaaaccatgaacaccatgttcgtcaagtaagtttaccttaaatttagtgttgagcatatgcattatttgtttcgtgcatgtcaatctttacgcataaaccatgctaattttctctctattcatattgattcttagatcatacacttttggttgttatgatcgtttaattatgtatcatgttatatatcattaacacatgcaatttgcatatatataggccgatgcttaggaaatcaattcacaagaagagtgcctcgcatgatatagtgagggatacggtgaagactgagggctctagctccggagaggaggtgaagacgatgagaggcttctacggcgccggagaaacgtcgtcgccggcgagtagttgggtgccacatgaaggtacgggaatatactatccaaagggacaagagaaagtgatgcaagatgtgcctcctcctccagctggcagccacgcggacgagctcgttaattggttctcttgatccattagtctcgagtgactctcttctcatctcgatctcgtcgaaggcgcgccaaaaattggagctctgcagagctttcgttcgta

SEQ ID NO: 14 - DNA, 1137 bp, Arabidopsis thaliana
atggagatggagaatcaccgccccggcagtttcacctacatgggccgcaaattcagcgatttaagtctcaacgatgactcctctgctttcagcgattgtaacagcgacagatccggcgaattccccactgcttcctccgagagccgtcgtctcctcctctcttgcgcctctgagaattccgatgatctcatcaatcatctcgtgtcgcatcttgattcctcctattcgatcgatgagcagaagcaagctgctatggagatcaggctcttatccaagaacaaacctgagaatcggatcaaaatcgccaaggccggtgcgattaagccgttgatttctctgatctcttcttcggatcttcagcttcaggagtatggtgtcactgcaatcttgaatctatctctctgcgacgagaacaaagagtcgattgcttcttccggtgcgattaagccgcttgtcagggctttgaaaatgggaacaccgactgctaaagagaacgctgcttgtgctctgctccgtctatcgcagatcgaggagaacaaagtcgccatcgggagatccggagcgattcctctgttggtgaaccttctagaaacaggcggattcagagcgaagaaggacgcgtcgacggctctgtactcgttgtgctcagctaaagagaacaaaatcagagccgtgcaatcgggaattatgaagccgcttgttgaattgatggcggatttcggatcaaacatggtggataaatcggcgtttgtgatgagtctgttaatgtcggtgccggaatcgaaaccggcgattgtggaggaaggaggagttccggtgctggtggagatagtagaggtgggaacacagagacagaaagagatggctgtgtcgatattgctacagctttgtgaggagagtgttgtgtatagaacaatggtggctagagaaggagcgatacctccgctagtggctctgtcgcaggcaggaacaagtcgagctaagcaaaaggctgaggcgttgattgagcttctaaggcaaccaagatccattagtaatggtggtgctagatcatcgtcccaactctgatgtgagcttttcttatttatctttttttaccacactctttcttcgtcttttactgttaatgcgagggtg

SEQ ID NO: 15 - DNA, 755 bp, Arabidopsis thaliana
atgatgatgctaaggcaaacgtcgagaaaggcttacctagggttacaggcgtctcctctagggttaggtcgtcgattataccacgagaatgtaatcgaccactttgaaaaccctagaaacgttggctccttcaacaggaatgaccctaacgttggcacgggattggtaggagctcctgcctgcggagacctcatgagcctccagattaaggtcgatgattcaggtcagatcattgatactcgattcaagacctttggctgtggctccgctatcgcctcatcttccgttggtatgccttcgaatcagggttttcaattttgatcgattcgttaagaggctcatgatcagagtcaggtagatgtagacaggttataatttgtatatttgtttggttcagcttctgaatggatcaagggcaaaaccttagacgaagttatgaccatcaagaacgcgtaagtgccttttaaccatcaaaatcatgtctcttagatatatcgtcaggattgttatctctaactctgttctagtgcttggaatatcccaaatctagtgatatggttaacattttgatgaatgagtcattgttttgggattcttaaatttgcagggaaatcgctaagcatcttaggttgccaccggtaaagctacattgcagtatgcttgcagaggacgctatcaagtccgcggtcagagactacaaggagaagcaagcaaagactaatgctgctgctgcagaagaaaccgtcaaggcctga

SEQ ID NO: 16 - DNA, 648 bp, Arabidopsis thaliana
atgacgcatgttgaagatgataaggaattcaaggagaaacctttggttcaggttctgagcgacgacgacagtgaagtgaaggaagccaaagacggaggaggtgaagaagttaccggcggcgacggtgaaggagaggctaatgtagaagaggaagacgacgaagcagaaaatgaagacgatgatgatgatgatgatgatgatgatgacgacgacgaggacgaggacgatgaagaaggggtatgaatctctttagtttttatttatttattttgatttgagctgtaaatccttaagagaagattatagatctagggttttatgcatctctttagctacgaatttcgtagaacatgtgtgttttgttcattttacattcaaactgtgcaggaggaggatcttgggacagagtacctagtgaggccggttggtgaggttgaagatgaggatgatgcaagtgattttgaccctgaggagaatggcttggatgaagaagaaggtgatgaagagattgaagaagatgatgttgatgaggacatcagcttgagtgctggcaaatctgagcctctgtccaagaggaagagggttgctaaggaccacagtgagcaaggagatgtcactggtgataacattaggccttctaaacggtag

SEQ ID NO: 17 - DNA, 816 bp, Arabidopsis thaliana
atgggttacgcccagctagttattggtccagcaggcagtggaaagtcaacttattgctcgtctttgtatgaacattgtgaaactatcggtcgaacaatgcatgttgttaaccttgatcctgctgcggagatcttcaactatcctgtggctatggatatcagagaacttatttctttggaagatgtgatggaggatctaaagcttggtcctaatggtgcccttatgtattgcatggagtatcytgaggatagcttacatgattgggcggatgaagaattggagaactacagggatgacgattaccttatctttgattgtccaggccagatagagctgtttacacatgttcctgtgctcaagaactttgtggagcatttgaagcagaagaacttcaacgtctgtgttgtttatctgcttgattcacagttcatcacagatgtaaccaagtttatcagtggttgcatgtcatctctcgctgcaatgatccagcttgaattaccacatgtcaacatcctctcaaaaatggacctcttgcaggacaaaagcaacattgatgattacttgaatccggagcctcgcacattgctagcagagttaaacaaaaggatgggtcctcaatatgcaaaactaaacaaagccttgattgagatggtgggagagtatgggatggtgaatttcatacccattaacttgaggaaagaaaagagcattcaatatgttctgtcgcaaatcgacgtctgtattcagtttggagaagatgctgatgtgaacatcaaagatgatgacgattttagtgacgatggtcctgacctataa

SEQ ID NO: 18 - DNA, 1060 bp, Arabidopsis thaliana
aactctttgtttcttgtttgttgattaacccttaattaaggatggccgccggaggaggaggaggaggaggaggatcatcgtcgggacgtactccgacgtggaaagagagagagaacaataagaagagagaaagaagaagaagagccatcactgctaagatttactctggtcttagagctcaaggtaactataagcttcctaagcactgcgataacaacgaggttcttaaagctctctgtctcgaagctggttggatcgtcgaagacgatggcaccacttatcgcaaggggtttaagccaccagcatcagatatttcaggaactcctacaaacttcagcacaaattcatcaatccaaccaagtccacaatcatcagcttttccaagtcctgcaccttcgtaccacggaagtccagtctcatcatccttcccgagtccatctcgctatgacggaaacccttcttcataccttcttcttccgttcctacacaacatcgcttcttcgattcctgctaaccttccacctcttagaatatccaacagtgcgcctgtgactcctccgttgtcatctcctacttctcgtggttcgaagcggaaacttacttcagagcaattaccaaatggcgggtctttacacgttttgagacatccgcttttcgctatctctgctccatctagtcctactcgtcgtgctggtcaccaaacgccacctacaataccggaatgtgatgagtccgaggaggattcgatcgaggattcaggaaggtggatcaatttccaatctactgctcctacttcaccaacatttaaccttgttcagcaaacttctatggccattgatatgaaaaggtcagactggggaatgtccggaatgaatgggagaggggcagagtttgagtttgagaatggaacagttaagccgtgggaaggcgaaatgattcatgaagttggcgtagaagatctcgaactcactctcggtggcactaaagccagatgctgaatttaaatacccagaaatacccagcaaattggagctctgcagagctttcgttcgtatcatcg

SEQ ID NO: 19 - DNA, 903 bp, Arabidopsis thaliana
atggtaggaggagtagaagaattgagtattgaacagttagcttcgagtatctctacctacaaagaacaactcgaacaggttaggcagcttttgtcagaggatcctaggaactcggaatatgcagacatggaaaaggagcttaaagaggtgattgcattgacagaggaagttcttgcaactgcaaagcaaaatgagatttctctatcagatgccggagttagtgctgaagcaactcctggctcacccgatttagagggtgcttgggaaaagacgggtttaaggaatgacccaatccatgagggtaagttccctgttggaactaaagttcaagctgtctttagtgacgatggcgagtggtatgatgcgaccattgaggcacatactgcaaatggctattttgttgcttatgatgagtggggaaacaaggaagaggtggatccagataatgtgaggccaatcgagcaaaatgctattgtcgaagctgagagattagctcaagctaccaaaaatgctctcaaaagaaagattgagaaagctgcgagttctgattatcagacaaaaactctaccagcaaagctcaaaatcgatcctaatgatcccgaggatgtaaaaatagctaagcgtaagaagatacatgctttcaaatccaaggcaaggtttgagcaactcgaggttgtgcagaacaagaaacagaatgattggcaacagtttcagacgactaaagccaaaactaaaaaggtagggttcttcacagggaggaagaaagagagtatatttaaatcacctgaggatccatttggaaaagtgggtgtgactggaagtgggaaaggtttgacagatttccaaaagcgagagaagcatcttcatctcaagtctggtaatgctgagggcactgatgaatga

SEQ ID NO: 20 - DNA, 924 bp, Arabidopsis thaliana
atggaagacgaagaaggcatcgggttaattttagccagagccaccgagctcagactcaagatcagcgattgtatcgataactccagtaccaccgtcagcgacaacggcgatggaaacgaggatctttctcccggagaaggaagaaaaagcgagattattgggaatcaagacaaggattttgactcaatcagctctgaggatgtagatgaagcagaagctgaacggcttttgcgtattcgtgatgctcttgaagctcttgagtctcagcttgcttctttacagaatctaaggcaaagacaacaatatgagaagcaactggctctctctgagattgattacagtaggaaaatgttgcttgagaagcttaaggagtacaaagggaaagattttgaagtgttacgtgagactacgacttttgctggtgaaagagttgattatgagaatgatcttttacttcctccttatcctgtccatcctcctctctcccttggtttagataataataatggttacctatctcacttaccttcgaagaagaaatcggatgcgaatgggttcggctcaggacatgtgaggaacgaggcagaggcgaaaagtcccaacggaggatctggaggttcgagtcatggggttattcgcttcttaggctctgtcgcaaagatcgtgcttccaatcatcggtgttatctctctattgtctgcatcaggatatggtccagagatgaggaaaagaggcgcttccttgaacctttttggacttctcccgcaccgagctaccagagggaagagaacacctaaccaatgtccaccagggaaagttcttgtgattgaagatggagaagcacggtgccttgttaaggaaagagtcgaaataccatttgactctgttgtagcgaaacgcgatgtaacttacggatacggttga

SEQ ID NO: 21 - DNA, 741 bp, Arabidopsis thaliana
atggagtgggagaaatggtacttagatgcggttcttgtgccaagtgctttacttatgatgtttggttaccacatctatttgtggtataaggttcgaaccgatcctttctgcaccattgttggtacaaattcccgcgcccgtcgatcttgggtagcagccatcatgaaggacaacgagaagaagaacatcttagcggtacaaacactacgaaacacgataatgggagggacgttaatggcaaccacttgcatcctcctctgtgcaggtctcgctgccgttttaagcagtacttatagcatcaagaaacctttaaacgacgccgtatatggagctcatggtgacttcactgttgcactcaaatacgtaaccatcctcacaatcttcctcttcgccttcttctctcattctctctccattcgcttcatcaaccaagtcaacatccttattaacgctcctcaagaacctttttctgatgatttcggcgaaataggaagctttgtgactcccgagtatgtctctgaactactcgagaaagctttcttgctcaatacggtaggtaataggctgttctacatgggcttgcctttgatgctatggatctttgggcctgtgcttgtgttcttgagctctgctttgataatccctgttctttataacctcgacttcgtgtttttgttgagcaataaggagaagggtaaagtcgattgcaatggaggttgtgatgacaacttctcgccttaa

SEQ ID NO: 22 - DNA, 2879 bp, Arabidopsis thaliana
actctggtggttatgtgtggatctgcgacctcgatttcaattcgaagtcgtcggtttcttctctaaatcgaatctttccaggattcgtttgtttttttcttttgtttttttttcgatccgatggaggatcctgatatcaagaggtgtaaattgagctgcgtcgcgacggttgatgatgtcatcgagcaagtcatgacctatataactgacccgaaagatcgcgattcggcttctttggtgtgtcggagatggttcaagattgattccgagacgagagagcatgtgactatggcgctttgctacactgcgacgcctgatcgtcttagccgtcgattcccgaacttgaggtcgctcaagcttaaaggcaagcctagagcagctatgtttaatctgatccctgagaactggggaggttatgttactccttgggttactgagatttctaacaaccttaggcagctcaaatcggtgcacttccgacggatgattgtcagtgacttagatctagatcgtttagctaaagctagagcagatgatcttgagactttgaagctagacaagtgttctggttttactactgatggacttttgagcatcgttacacactgcaggtacacttacttctcagtatcttgtagctactttggctcgatgcttttgaggtttagcgactccttatcatttcctactttgactagaactctagatgcatttggctctttttaaaaaacttaataagtcgtcgttgtacaaagaaccatatcttgagtttgtgtttgtaaagatttgatcttctttagctcaattgggtaagttgtaactttggtggatactttttgtccttaatgaaattggtgaaccttacttcatttgatttcttagtacactttacactaagagtaatataagcagaaacatttatttcagaaagtttcagtatttaggcgttcatgtttgtcttatatccttaattgctttgcaactgttatgcttgctattaaagcagaaattgcaatgatcttcagttatttctcaattggggaagtataaactttgatccggattttatctacaaccaattttttccctctttggggaacattcactttgtttatgcataaatagcaaaaagattgatttctgacatcttcagtctgccagagtttatgtgtattatttggtttttgaatccttgattcggctgctgctgttcttcatattcagttttagcgggaaatccaaatatcttgagttgtttctcactttattcatgcaactgtctgttgtcttgtccaggaaaataaaaactttgttaatggaagagagttcttttagtgaaaaggatggtaagtggcttcatgagcttgctcagcacaacacatctcttgaggttttaaacttctacatgacggagtttgccaaaatcagtcccaaagacttggaaaccatagctagaaattgccgctctctggtatctgtgaaggtcggtgactttgagattttggaactagttgggttctttaaggctgcagctaatcttgaagaattttgtggtggctccttgaatgaggatattggaatgcctgagaagtacatgaatctggtttttccccgaaaactatgtcggcttggtctctcttacatgggacctaatgaaatgccaatactatttccattcgcggcccaaatccgaaagctggatttgctttatgcattgctagaaactgaagaccattgtacgcttatccaaaagtgtcctaatttggaagttctcgaggtaaacgtttaactttgctgtctttactacatacttgggaatgcgtccttagtactaaattgtgttcctattttttcacgaaatatttggggagataagggatatgaatgcaatattggttctctttagtctttacatctatataagactgacaacacttgttgtttttcttcagacaaggaatgtaatcggagataggggtctagaggtccttgcacagtactgtaagcagttgaagcggctgaggattgaacgcggtgcagatgaacaaggaatggaggacgaagaaggcttagtctcacaaagaggattaatcgctttggctcagggctgccaggagctagaatacatggcggtgtatgtctcagatataactaacgaatctcttgaaagcataggcacatatctgaaaaacctctgtgacttccgccttgtcttactcgaccgggaagaaaggattacagatctgccactggacaacggagtccgatctcttttgattggatgcaagaaactcagacgatttgcattctatctgagacaaggcggcttaaccgacttgggcttaagctacatcggacagtacagtccaaacgtgagatggatgctgctgggttacgtaggtgaatcagatgaaggtttaatggaattctcaagaggctgtccaaatctacagaagctagagatgagaggttgttgcttcagtgagcgagcaatcgctgcagcggttacaaaattgccttcactgagatacttgtgggtacaaggttacagagcatcgatgacgggacaagatctaatgcagatggctagaccgtactggaacatcgagctgattccatcaagaagagtcccggaagtgaatcaacaaggagagataagagagatggagcatccggctcatatattggcttactactctctggctggccagagaacagattgtccaacaactgttagagtcctgaaggagccaatatgatatgacccaaaaaacaggtttgtatataaagatttttagtctcgagttttggggtttccacaaactgtgtactatactactttggttctttttttgtttcatgttgtgtcgtcgatgttt

SEQ ID NO: 23 - DNA, 2411 bp, Arabidopsis thaliana
ttcttgtttgttgattaacccttaattaatccgggcgcgcctgatttatcacaagtttgtacaaaaaagcaggctcctgcaggaccatgagtaatcagaagaagaggaattttcagatagaggcgtttaagcatcgagtcgttgtggatcccaaatacgctgataaaacttggcagattcttgagcgtgcgatccatcagatttacaatcaagatgctagcggtctcagtttcgaagaactttacagaaatgcgtacaacatggtcctgcacaagtttggtgagaagctatatactgggtttattgctactatgacttctcatctcaaagaaaaatccaagcttatcgaggcagctcagggagggtcgtttctagaagagcttaataagaaatggaatgagcacaacaaagcgttagagatgattcgagacattctcatgtatatggataggacttatattgagagcaccaaaaagactcatgttcatccgatggggcttaacttgtggagggataatgttgtgcatttcactaagatacatacaaggcttctaaacactcttcttgatctagtgcagaaggaacggataggtgaagttattgatagggggttgatgaggaatgtcattaagatgtttatggatttgggtgaatctgtgtatcaggaggattttgagaagccgtttttggatgcgtcttctgagttttataaggttgagtctcaggagtttattgaatcttgtgattgtggggactatctgaagaaatcagagaaacgccttactgaagagatagagagggtagcgcactacttagatgccaagagcgaagagaagattactagtgtggttgagaaagagatgattgccaaccacatgcagagactggttcacatggagaactcaggtctggttaatatgcttctgaatgacaagtatgaggatttgggtagaatgtacaacttgtttcgcagggttactaatggtcttgttactgtcagagacgttatgacttcgcatcttagggagatgggaaaacaactggttactgatccggaaaagtcaaaggatccggtggaatttgtacaacgtctattggatgagcgggataaatatgacaaaatcatcaacaccgcatttggcaatgataaaacctttcagaatgccctgaattcttcattcgagtatttcatcaacttgaatgctcgttctcctgagtttatctccctgtttgttgatgacaagctacggaaaggacttaagggtatcaccgatgtggatgttgaggttatccttgataaagtgatgatgctgttccgttatttacaagagaaagatgtctttgagaagtactacaagcagcatttggctaaaaggcttctctcaggcaaaactgtgtcagatgacgcagaaaggagtttaatagtgaaactaaagacagaatgtggctatcagttcacttcaaaattggaaggcatgttcactgacatgaagacttcagaggacacaatgcgtgggttttatggcagtcaccccgagctttcagaaggacctacacttattgttcaggtacttacaactggttcttggccaacacagcctgcagtaccttgtaatctcccagctgaagtttcagttctctgtgagaagttccgttcttactaccttgggacacataccggtagaagattgtcctggcaaacaaacatgggcacagcagatatcaaagccatctttggaaagggtcagaaacatgaactgaacgtgtcgactttccagatgtgtgttctcatgttgttcaacaattctgatcgactcagctacaaagagatcgaacaggctacagaaatcccggcagcagatcttaaacgctgtttgcagtcgctagcttgtgtaaagggcaaaaacgtgataaagaaagaacccatgagcaaagacataggagaggaggatttgttcgttgtgaacgacaagttcactagcaagttttacaaagtgaagatcggaactgtggttgcccaaaaggaaacagaaccggagaagcaagagacgagacagagagtggaggaagacagaaaacctcagattgaagcagccatcgtaaggatcatgaagtccaggaaaatactagaccacaacaacataatcgccgaggtgacgaaacagttgcagccacggttcctagctaatcccacggagataaagaagagaatcgagtcgctcattgaacgagatttcttggaaagggatagtacagaccggaaactttaccgctatctagcctaaataagttgaataccacaacccaaaaaaaaaaggctttactctgtttctttctttgcctcgagacccagctttcttgtacaaagtggtgataaattggagctctgcagagctttcgttcgtatcatc

SEQ ID NO: 24 - DNA, 1604 bp, Arabidopsis thaliana
catagaagacgagacgcccccactacttagactttttctactacaaacctgagattttagtctgagagaaagagaagagaacactaagatgatgacttctcgttcgattgttcctcaacaatccacggatgatgttgttgtggtagatggcaaaaacgtagcgaaaggaagaaaccgtcaagttcttggtgatataggtaatgttgttcgaggaaattacccaaagaacaacgaaccggaaaagatcaatcatcgtcctcgtacacgatctcaaaatcccacgcttcttgtggaggataatctcaaaaaacctgtagtcaagagaaacgcagtaccaaagccgaagaaagtggctgggaatccaaaggtagtagacgtgattgagataagttcagacagtgatgaagaacttggtttagttgctgctcgagagaagaaggctactaagaagaaagcgaccacttacacatctgttcttactgctagaagcaaggctgcttgtggtttagagaagaaacagaaagaaaagattgttgatatcgattctgctgatgttgagaatgacctcgcagctgtggaatatgtggaagatatttacagtttttacaagtctgttgagagtgaatggaggccacgagattacatggcatctcagcctgatattaatgaaaagatgagactgatcctggtggagtggttgattgatgtgcatgtccgattcgagctaaacccggaaacattttacctcactgttaacattctggatcggttcttgtcggttaagccagtgcctcgaaaagaactgcagcttgttggtctcagtgctcttctcatgtcggccaagtatgaagaaatttggccaccacaggtggaggatctagttgatattgcagaccatgcatacagtcacaaacagattctggtgatggagaagacaatactgtctacacttgagtggtacttgacagttccgactcattatgtcttcctagctcgtttcatcaaagcttccattgcagacgaaaagatggagaatatggtgcactatttggctgagttaggcgtaatgcattacgatacgatgataatgttcagtccatcaatggtagctgcttctgcaatctacgcagcaagatcttctctccgccaagttcccatatggaccagcactctcaagcatcacactggctattctgagactcagctcatggactgtgcaaagctgttggcgtatcagcaatggaagcaacaagaagaagggagtgagagcagtactaagggagctttacgaaagaaatactccaaggacgaacgcttcgctgtggctttgatccctccggccaaagctttgttgaccggaactgaatctgcttaggagttaggaccctttaagaagacgaagaagctgaagaaccaagcctagtttcattttccttctgaaaatcaagtctagtttcattagataatggtattttgaacaagtctaatgagtcgctttgaaacctagtcctttagcatgattcattcccaaacactgcatatcttgtaagaagtcagtttcttccgagaagtttaatttccttagatataatattctgtggttt

SEQ ID NO: 25 - DNA, 2296 bp, Arabidopsis thaliana
acaagtttgtacaaaaaagcaggctcctgcaggaccatggcgaagaaggattctgtgttggaggcaggatggtctgtcatggaggctggtgttgcaaagctacaaaagattctggaagaagtgcctgatgagccaccatttgacccggttcaacgtatgcagctgtacacgactgtccacaatctgtgtacccagaaacctcctaatgattactcacagcagatctatgatcggtatggtggagtatatgttgattacaataaacaaactgtgttgccggctatacgtgagaagcatggtgaatatatgttgagagagcttgttaagagatgggccaaccagaaaattcttgttagatggttatcccacttcttcgaatatcttgaccgtttttatactcgtcgggggtctcatccaacactgagtgctgttggcttcatatccttccgcgacctggtttatcaagagttacagtccaaggccaaagacgctgtactagcacttattcataaagaacgcgagggcgaacagattgatagagcactattgaaaaacgtaatagatgtctattgtgggaatgggatgggagagctggttaaatacgaagaggattttgaaagcttcttgcttgaagattctgcatcttactactctcgcaacgcctcaaggtggaaccaggagaattcttgtcctgattacatgataaaggctgaggagtctctaagactggagaaggagagagtcaccaactaccttcattcaaccactgagccgaaactagttgcgaaagtacaaaatgaattgttggtagtggttgcaaaacaacttatagaaaatgagcactcaggatgccgtgcattgttaagagacgacaagatggatgatctcgccaggatgtacaggctttatcatccaataccgcaagggctggatcctgttgcagacttattcaagcaacatattactgtagagggaagtgcccttatcaaacaagctaccgaggcagctactgataaggctgcaagtactagtggactgaaggtgcaggaccaggtgcttatcagacaattaattgacctacacgataaattcatggtctacgtcgatgagtgttttcagaaacacagcctcttccataaggcattgaaggaggcatttgaagtcttctgtaacaagacagtggctggagtgtccagtgcagaaattcttgcaacgtattgcgataatatcctcaagacgggagggggaattgagaagcttgaaaatgaagatcttgaacttacgcttgagaaagtggttaagttgcttgtttatataagtgacaaggatcttttcgccgagtttttcaggaagaaacaagcccgtcggctcttgtttgatcgcaacggtaatgactaccacgaaagaagtttacttacaaagtttaaagaactactcggtgcgcagtttacttctaagatggagggcatgctgacggatatgacattggcaaaagaacaccaaaccaacttcgtggaatttttatcagttaacaagaccaaaaagctggggatggatttcactgtcactgtacttactactggtttttggccaagttacaaaacaaccgacctcaatctacccattgaaatggtcaactgtgttgaagcttttaaggcctattatggaacaaaaaccaattccaggagactttcatggatttattctttaggaacttgtcagttagctggaaaattcgataaaaaaacaattgagatagtagttaccacctaccaggctgctgtgcttttactcttcaacaacacagagagattaagctacactgagatcttggagcagctaaacctcggccatgaagatcttgccaggctgcttcattcactatcatgcttaaagtacaagattcttataaaggaaccaatgtcgagaaacatctccaacaccgatacctttgaattcaactccaagttcaccgataagatgaggagaattagggtgcctctgcctccgatggatgagaggaagaaaattgttgaagatgttgataaagatagacgctatgcaattgatgcagctcttgttcggatcatgaagagtagaaaagtgttggggcatcaacagttggtctctgaatgtgttgagcatctcagcaaaatgttcaagcctgatataaagatgataaagaaacggattgaggacttgatcagcagagattacttggagagggataccgacaatcccaacactttcaagtatttggcttagctcgagacccagctttcttgtacaaagtggt

SEQ ID NO: 26 - DNA, 2521 bp, Arabidopsis thaliana
gaattatgagtaatcctgcgtccaaacaataactttcgtcaacggctcaagaggggaagaagattgaattggaaattctgggaattggaattggagagggagagagagaattcgttcatcatggaggaagtgacgagatctgtgttagcagaagaaatactgaagcgtttagatctggagaatctctgttccgtcgcatgcgtttccaccactctccgctccgccgttgtttccggcgttcttccttctcttacctccctcgatctctctgtaagtttccgattctcgtcaatttggagattttatttttctgaatagagatgaaattgatcgaattttcgtttctctgttaggttttctctccggacgatgaaactctgaatcacgtgctgcgtggttgtatcggactcagcagcttaactctgaattgtctccgccttaacgctgcttctgtgcgtggagttctcgggccacatctccgagaacttcacttgctcaggtgttcacttttatcctccaccgtcctcacttacattggcaccctctgcccaaatctccggtacaattccttcttcccatgaacttttcaatgaattatcatgcttttcgtcgatgtttgtttctgaaattgatgaaaagtcacattgtttttctgaatttgtcactaattgaattgaatactctgtctttcccaagcctttacttatttgggattgctttggcttttgtcaattatattctttcttgatcagattttttcagtgtgatgcatgtagtttcgagctatatagttgaagttgtgataattgagtaatgagtgtttctgtttgggttcaatgacagggttcttactctggaaatggcagacctggattctcccgatgtttttcagtctaacttgacgcagatgcttaacgggtgtccttatctggaggtaatttgttaaagcttgctgaggcattggtccgacgaagcgagaaagtgtgaaattgaattgggttttatattcttgtgatgcttgcagtctctgcaacttaatatccgaggtatcctagtagatgccaccgctttccagtctgttagattctccttgccagaaactctcaaagctctaaggttacagccacttcttgagtctgaggcaattcttctcatgaacagattcaaagtgactggaacttatttatctcagcctgattataatagtgccttgctatctccttcaccttcttttactttgcaaagcctgtctcttgtcctggacttgatatctgacaggcttatcatagctatcacaggttctcttcctcaacttgtcaaactggaccttgaagatcgtcctgaaaaagagccatttcccgacaatgacttgacttacactgggcttcaggctctcggtttttgtcagcaactcacaagcctctctctggttcgaacttgttacaaccgcaagatatcattcaagagaataaacgatatgggtatatttcttctctccgaggcttgcaagggtttagagtctgtgagactcggtgggttcccaaaagtcagcgacgctggttttgcgtcgctccttcactcatgtcggaacttgaaaaagtttgaagttcgaggtgccttcctgttgtctgatttggcatttcatgatgtcacagggtcttcctgttctcttcaagaggtcagactctcgacgtgccctctcataacaagtgaagctgtgaagaaactggggttgtgtggcaatcttgaggtgctcgacttgggcagctgcaaaagtatatcagattcttgcctcaactctgtttcagccctcagaaagttaacttctctgaatctcgctggagctgatgtaaccgatagtggcatgcttgcacttggtaagtcagatgttcccatcacgcaactgtctctccgcggctgtaggagagtcagtgacagaggaatatcctatctgttgaacaatgaaggaacaatcagcaaaacattgtcaacacttgatctcggtcatatgccaggaatctcagacagagccatccacacaatcacacactgttgcaaggctttaacagagctgagtatcaggagttgctttcacgtaacagattcttcgatagagtccctggctacatgggaaagacaagcagagggaggaagcaaacaattgaggaagctcaatgtccataactgtgtgagcttaactactggagcactgagatggttaagcaagccgtcttttgcgggtctgcattggctcggaatgggacaaacacgattcgcgggtcgaaaagagacggttacagctatgatttgtggacagaggccgtggctcacgttgtgcttcgatggatgtgagcttggatgctctgatggttgggaattccacacgccacaacgccactgaagaactcattgtctcactagttcatgtattgtataaaatcgttcagaaacatgattcagtaggatgtgtaattttatttaaaccttttaaaaaatttgattgtaaacttgtaaaagttaa

SEQ ID NO: 27 - DNA, 2149 bp, Arabidopsis thaliana
ttcttgtttgttgattaacccttaattaatccgggcgcgcctgatttatcacaagtttgtacaaaaaagcaggctcctgcaggacctcacaacaaaatttaatgaatcatgtctctgcttctaaagatgttattattttccttattcttcttctatatggcttcaatttctcaatgctcagacccaaccggtggacagtttagcttcaacggttacttgtacaccgatggagttgcggatctaaacccggacggtttgttcaaactcataacttcaaagacacaaggaggagctggtcaagttctttaccagttcccactccagttcaagaactcaccaaacggcactgtttcatccttctccaccactttcgtctttgctatcgtcgcagtacgtaaaacaatcgccggttgtggactttccttcaacatctctcctacaaaaggcttgaattcagttccaaatatcgaccactctaaccattctgtttcggttggatttcataccgctaaaagcgataaaccggatggtgaagatgtcaacctcgttggtatcaatatcgatagctcgaaaatggatagaaattgttcggctggttactacaaagatgatggtagattggtgaatctagatattgcaagtgggaagcctatacaggtttggattgagtataacaactcaactaaacagcttgatgttacaatgcattctattaagatatctaaacctaagattcctctgctttcgatgcggaaagatctttctccatatctacatgagtatatgtacattggctttacttcagtgggaagtccaacttcttctcactacattcttggctggagtttcaacaacaaaggagcagtttccgatataaatctctctcgtcttcctaaagtccccgatgaagatcaagaacggtcgttgagttctaagatcttggcgattagtttaagtatttcaggagttacactagttatcgtcttgattcttggagttatgttgttcttgaagaggaagaagttcttggaagttattgaggactgggaggtgcagtttggtcctcataaattcacttacaaagatctcttcatcgccacgaaaggtttcaagaacagtgaggtacttgggaaaggaggttttggaaaagttttcaaggggatcttaccgctgtctagtataccgatcgcggtgaagaagatttctcatgattcaagacaaggaatgagagagtttttagctgagattgctaccattggtagacttagacatccagatttagttcgtcttcttgggtactgtagacgtaaaggagaactctacttggtgtatgactttatgcccaaaggaagccttgataagtttctttataatcaaccaaatcaaattcttgattggtcacagagattcaatatcatcaaagacgtagcctcgggactctgctacttgcatcagcagtgggttcaagtgattattcacagggatattaagccagcaaatattcttcttgatgaaaacatgaacgcgaagctcggtgattttggacttgcgaagctatgtgaccacgggattgactctcaaacctcgaatgttgcaggtacatttggatatatatcaccggagctgtcgagaacagggaagtcaagcacaagttctgatgtttttgcatttggagtgttcatgttggagattacttgcggaagaagacccattgggccaagaggatcaccaagcgagatggttttgactgattgggtactagactgttgggacagtggagacatactgcaggtagttgatgagaaactagggcacaggtatcttgcggaacaagtaactttggttttgaaactgggattgctttgctcgcatccagtggcagccactagaccaagcatgtcaagcgtgatccaatttttagacggtgtagccactcttcctcataacttgctagaccttgtgaattctcggataatcaatgaaggatttgataccttaggtgtaacgactgagtctatggaagcgagtagtaacgtttccttggtcatgacggaatcgtttctctctagtggacgctaactcgagacccagctttcttgtacaaagtggtgataaattggagctctgcagagctttcgttcgtatcatc

SEQ ID NO: 28 - DNA, 2539 bp, Arabidopsis thaliana
atgccatgtactacttatcttcctcttcttcttctcctcttccttcttccaccaccatctgtacaaagcaaagttatcatcaaaggaaaccaaaccattctgagtttcaaagctattttccggcttggtttcttcagcaccaccaatggttcctccaattggtacttgggtatctcttacgcttctatgccaactcccacccacgtttgggtcgccaatcgaatccgacccgtttcggatcctgactcttccactctcgagctcacctccaccggatacctaatcgtcagtaacctccgtgacggcgtcgtttggcagacggataacaaacaacccggaaccgatttccggttctctgaaaccgggaatctgattttgatcaacgacgacggttctccggtttggcagagctttgacaatccgactgacacgtggcttccggggatgaatgtcaccggtctaacagctatgacttcgtggcggagtctcttcgatccttcgccggggttttactctctgagactgagtccaagcttcaacgagttccagcttgtttacaaaggaaccacaccgtattggtccaccggaaattggaccggagaagccttcgtcggcgttccggaaatgaccattccttacatctacaggttccatttcgttaacccttacactcccacggcgtcgttttggtacatcgtcccaccgttggactccgtttccgagccacggctgacgcggttcatggtcggcgccaacggccagctgaagcagtacacttgggatccacagacgcagagctggaacatgttctggttgcagccggaggatccttgccgcgtttacaatctctgtggtcaattagggttttgtagcagcgaattgctcaagccctgtgcttgcatccgcggtttccggcctaggaacgacgccgcgtggagatctgatgattacagcgacggatgccgccgtgaaaacggtgattccggcgaaaagagtgatacttttgaagccgttggtgatctacgctacgatggtgatgtgaagatgtcacggttgcaggtaagcaagagctcttgcgccaaaacttgcttaggaaactcttcttgtgttggtttttatcataaggagaagtctaatctctgcaaaattttactcgagtcgccgaataatctgaagaattcgagctcgtggactggagttagtgaagatgtattgtatatcagagaaccaaagaaagggaattcaaagggaaacatctctaagtctataattatattgtgcagcgttgttgggtcaatctcagttcttgggtttacattgttagtgccattgattctgttgaagaggagtcgaaagaggaagaagactaggaaacaagacgaagatgggtttgctgtgttgaatcttaaggtattttctttcaaggagcttcaatcagctaccaatgggttctcggataaggtcggacacggcggttttggggcggtgtttaagggaacattaccgggttcttctacattcgtggctgtgaaacgcttagaaagacctggaagcggggagagtgagttccgggcagaggtatgcaccattgggaacattcaacatgtcaatctcgttaggcttagaggtttctgttcagagaatcttcataggcttcttgtctatgattacatgccacaaggatccttgagttcctatctgtctagaacaagccccaaattgctaagctgggagacccgtttcaggatcgcgttaggtactgccaaagggatcgcgtacttgcatgaaggatgcagggactgtattatacactgtgatatcaaaccggagaacattcttttggacagtgattacaacgccaaagtgtctgattttggcttggctaagctccttggacgtgacttcagcagagttctagccacgatgagagggacatggggctacgtggctcccgaatggatatctggtttgcccatcacgacaaaagctgatgtgtatagctttggaatgacattgctcgagctgatcggtggtagaagaaatgtcattgttaatagcgatacactgggagagaaagagacagaaccagagaaatggtatttagagaatgtcttttacttggaatcaattgtaagagagaaaaaaacatatacattgaatcaatgaatcccttttcaggttctttccgccatgggcagcgcgtgagatcatacaaggcaatgtggactctgtggttgactctagactcaacggagaatataacactgaagaggtgacgaggatggcaacggtggcgatatggtgcatacaagacaatgaagagataaggccagcaatgggaacggtagtgaagatgcttgaaggagttgtggaggtgacggttcctccaccgcctaaattaatacaagctcttgtctccggcgattcataccgaggagtgagcggcacaagctgtagtgaaggccatggctgttcggatctcaatacaggtttgtctagccctggctcacggtcgtcttttggtagaccttctccttga

SEQ ID NO: 29 - DNA, 1439 bp, Arabidopsis thaliana
acaagtttgtacaaaaaagcaggctcctgcaggacctattggacatggtgagaaagtgatgatggtgtttgtggtttttgttatgtgtaggtataagattttggaagagcttggtgatggtacttgtggtagtgtatataaagcagtaaatttggaaacatatgaagttgttgctgttaagaagatgaagagaaagttttattattgggaagagtgtgtgaatctgcgagaagttaaggctcttcgtaagctaaatcatcctcatatcataaagttgaaggagattgtgagagaacataatgagctttttttcatctttgagtgcatggatcacaatctgtaccatataatgaaagaaagggaacgacctttttctgaaggagaaataagaagttttatgtctcagatgctgcaagggctcgcacacatgcataaaaacggttatttccatcgagacctgaaacctgagaatttgctggtgaccaacaatatcctgaaaattgctgactttgggttggctagagaagttgcatctatgcctccttacactgaatatgtgtccacacgttggtatcgagctccagaagttttgctacagtcttcattatacactcctgcagttgacatgtgggcagttggagcgatactagctgagctttacgctttaactccgttatttcctggtgaaagtgagatagatcaattatacaaaatctgctgtgttcttggcaagccggactggaccacgttccctgaagcgaaaagcatatctcgaattatgagtattagtcacacagagtttccgcagacacgaattgctgatttacttcccaatgctgctcctgaagctattgatttgatcaatcgactttgctcatgggatccattgaaacgaccaactgctgatgaggcactaaatcatccatttttcagtatggctacgcaggcttcatatcctatccatgaccttgagctgaggcttgataatatggcggcgttgcctaatcttgagctaaatctctgggactttaacagagaacctgaagaatgttttcttggcttgacactagctgtgaaaccaagtgctcccaaactagaaatgctccgcaatgtatctcaggacatgagcgagaattttctcttttgccccggggtcaacaatgatcgagaaccatcagttttctggtctctgctctctcctgatgaaaacggcctccacgcgccagttgaatcatctcctttatctttgtctttcagtccaatgcagcaacacacagttggacctccacagtcgagtggcttcacaatgacatcatcaatgcaaccgaatatgttggaccgcccgtggatggccgtgtctgcgccgtttcaacaaagtcattacctctgatctaataaacccatacccctcgagacccagctttcttgtacaaagtggt

SEQ ID NO: 30 - DNA, 1868 bp, Arabidopsis thaliana
ttaattaaggaaggaggtgaatttcagagtttgtcaatggagaattacgaggttcttgagcaaattggaaaaggttcctttgggtcagctcttcttgtgagacataaacatgagaagaaactgtatgttttgaagaaaatccggcttgctcggcagactggtaggacaagaagatctgctcatcaagagatggagttgatttcaaagatacataatccattcattgtggaatataaagattcttgggttgaaaagggatgctatgtgtgcattatcataggctattgcaaaggaggagacatggcggaagcaataaagaaaaccaacggcgtacacttcactgaagagaaactctgcaaatggcttgttcagatcttattggctcttgaatacttgcatgccaatcacattctccatcgagatgtcaagtgttcgaacatatttttgacaaaggatcaagatatacgccttggcgattttggactcgctaaagtcttaacatcagatgacctcgcgtcttcagtggttggaacaccaagctacatgtgtcccgagctactagctgatataccctatgggtccaagtctgatatttggtcgctaggatgttgtatgtatgagatgacggctatgaaacctgctttcaaagcttttgacatgcaaggactaatcaacaggattaacagatcaatcgttcctccacttccggcgcaatattctgctgccttccgaggtctcgttaagagtatgctccggaaaaatccagaactcagaccaagtgctgctgagcttcttagacaaccgctgcttcaaccgtatatccagaagattcatttgaaagtgaatgatccaggaagtaatgtgttacctgcgcaatggccagaatctgaatccgccaggagaaacagttttccagaacagagaaggcgtcctgctggcaaaagccatagctttggtccaagcaggtttaggggtaacctagaagattctgtttcttccataaaaaaaactgtgcccgcatatctgaatcgtgaaaggcaagtggacttgtctacagatgcaagcggtgatggaacggttgttcgtagaacttcagaggcttctaagagttctaggtatgtaccagtgagagcttcggcctcacctgtgagacctagacagcctaggagtgaccttggtcaacttcctgtttcatcacaacttaaaaaccgaaaaccagctgctttgatacgtagagcctccatgcctagctcaagaaaacctgcaaaagaaatcaaagactctctgtacatttcgaaaaccagttttctccaccagataaattctcctgatgtgtcaatgaacgcaccaagaattgacaagattgagtttccgttagcgtcatacgaggaagagccttttgtcccggttgtgcgtgggaagaaaaagaaagcatcgtctagaggttcctacagtccacctccagagccaccactagactgctcaatcacaaaagacaaatttactcttgaaccaggccaaaacagagaaggagcgattatgaaggcggtgtatgaagaagatgcatatctggaagacaggagtgaatcatctgatcaaaatgcgacagctggagcatcaagcagggcttcgtcgggtgtaaggagacaaagatttgatcctagctcttatcagcaacgagccgaggcattggagggattgcttgaattcagtgcaaggttgcttcaagatgagaggtacgatgagctcaatgtcttattaagaccatttggtccaggcaaagtttcacccagagaaacagcgatttggttgtccaagagcttcaaggaaaccactactactaagctgggagattgaatttaaattgg

SEQ ID NO: 31 - DNA, 1868 bp, Arabidopsis thaliana
atggacaccaaaatcggatcgatcgatgattgcaagccgacgaacggcgacgtctgtagtccaacaaacggcaccgtcgcaacaatccacaactctgttccttcctccgctatcaccatcaactactgcgacgcgactctcggccgtcacttagctcgtcgtctcgtccaagccggcgttacggatgttttctctgttcccggagatttcaacctcactttgcttgatcacctcatggctgagccggacctcaacctaatcggatgttgtaacgagctaaacgccggttacgctgccgacggttacgctagatctcgtggagtcggcgcttgcgttgttaccttcaccgttggtggactcagcgttttaaacgcgatcgctggtgcttacagcgagaatcttcctcttatctgtatcgtcggaggtcctaactctaacgattatggcactaaccggattcttcatcacaccattggattacctgattttagccaagagcttaggtgcttccaaacggtgacttgttatcaggcggtggtgaacaatttagatgatgctcatgaacagattgataaagcaatatcaacagctttgaaagagagcaagcctgtgtatataagtgtaagctgtaacttagcagcgattcctcatcatacatttagccgtgatcctgtccctttttctctagctccaagattgagcaacaagatgggtttagaagctgcggtggaagcaacattggagtttctgaataaggctgtgaagccagttatggttggtggtcctaagttgcgtgtggctaaagcttgtgatgcctttgttgagctagctgatgcttcaggctatgctttggcgatgatgccttctgcgaaaggctttgtaccagagcaccatcctcatttcattggaacttattggggagcagtgagcactcctttttgctctgagattgtggaatctgcggatgcttacatttttgcaggtccaatcttcaacgactatagctctgttggttactcgcttctcctcaagaaagaaaaagccatcgttgtgcaacctgatcgtatcactgtggccaatggtcctacttttggttgcattttgatgagcgatttcttcagggaattgtctaagagggtgaagcgtaacgagactgcatatgagaactaccataggatctttgtccctgaaggtaagccattgaagtgtgaatcaagagagccattgagagttaacacaatgttccagcacattcagaagatgctctctagtgaaaccgctgtgattgctgaaaccggtgattcttggttcaattgccaaaaactaaagctgccaaaaggatgtgggtacgagtttcagatgcagtatggatcgattgggtggtctgttggtgcaactctaggatacgcacaggcatcaccagagaagcgagtgttggcattcatcggtgatgggagtttccaagtcacggttcaggacatatcaacaatgctgcgtaatggacagaagacgatcatcttcttgattaacaatggtggctacaccattgaagtagagattcatgacggtccttataacgtgattaagaactggaactacactggtctcgttgacgccattcataacggtgaaggcaattgctggactgcaaaggtgagatacgaagaggagttagtggaggcgattacgacagcgacgacggagaagaaagattgtctatgtttcatagaagtgattcttcacaaggatgatacgagcaaagagttgcttgagtggggctcacgcgtctctgctgctaacagccgtcctcccaatcctcagtagaagaagcaacacagaatcttcaatgcttcttaccaatttagtga

SEQ ID NO: 32 - DNA, 1452 bp, Arabidopsis thaliana
atgatcgcgcgacggatctggcgaagccaccggtttctccgcccattcagctcgtcatctgtttgctctccgccgttccgggtaccggagtatctttctcagtcgtcttcctctccggcgtcgcgcccattctttgttcaccctcccactttgatgaaatggggtggaggaagtagaagctggttttcgaacgaagccatggccactgattcaaattcagggttaattgatgtgccactagctcaaactggggaaggtattgctgaatgtgagcttctcaagtggtttgtcaaagagggagattctgtggaagagtttcagccactctgtgaagttcagagcgataaagcaactatagagatcacaagtcgttttaaagggaaagtggctctgatttcacattctccaggtgacattattaaggttggagagactctggttaggttggcggttgaagactcgcaggattcgcttctaaccactgatagttcagaaattgtaactctgggaggttcaaagcagggaacagaaaatcttcttggagctctctcaacgcctgcggttcgtaaccttgcaaaagaccttggcatagatatcaatgttataactggaactggtaaagatggtagagttttgaaagaggatgttctccggtttagtgaccagaaaggatttgtaacagattcagtttcttctgagcatgctgttataggaggagactcggtttccactaaagctagtagtaactttgaagataaaacagttcctctaaggggattcagccgagcaatggtcaagacaatgactatggctacaagtgtaccgcattttcattttgttgaagagataaactgcgactcacttgtggagctcaagcagttcttcaaagagaacaatacagattccaccatcaaacacacttttcttcctactttaatcaagtctctgtcaatggctctaaccaaatatcccttcgtgaatagttgcttcaacgcggaatctctcgagatcattctcaaaggttcacataatattggagttgcaatggccactgaacatggccttgtcgttcctaatataaagaatgttcagtcattatctctgctagagataaccaaagagctgtcccggttacaacatttggcagcaaacaacaaacttaaccccgaggatgtgactggtggaaccataactctgagtaacattggagcaattggtggtaaattcggatcccctcttttaaacttaccggaagttgcaatcatcgctcttggaagaatcgagaaagttccaaaattctcaaaagaaggaactgtctatcctgcatcgataatgatggttaacattgctgcggatcatagagttctagatggggcaacggtagctcggttttgctgccagtggaaagagtatgtcgagaaaccggagctgctgatgcttcaaatgagataa

SEQ ID NO: 33 - DNA, 1623 bp, Arabidopsis thaliana
acaagtttgtacaaaaaagcaggctcctgcaggaccgaagtgagaattgacacagcaaatgggtcttccgggaaaaaataaaggtgcagttttgtcgaagatagcgactaacaatcaacacggagagaactcagagtactttgatggatggaaagcttacgacaaagatccttttcatctttcccgtaacccccatgggatcatccaaatgggtcttgcagagaatcagctttgcttagatttgatcaaagattgggtcaaagagaacccagaagcttctatttgcacccttgaaggtattcatcagtttagcgacatcgctaatttccaagactaccatggtcttaagaagtttagacaggcaattgcacatttcatgggaaaagctagaggtggaagagtgacttttgatccggagagggtggttatgagcggaggagccaccggagccaatgaaacaatcatgttctgccttgcggatcccggcgacgttttcctcattccctccccgtactatgccgcatttgatagagacttgaggtggcggacaggtgtcgagataatcccggttccttgttcaagctccgacaatttcaaattaaccgttgacgccgcggaatgggcttataaaaaagcccaagagtccaataaaaaagtcaaaggtctgattttgaccaacccatcaaatccactcggtacaatgttggataaggacacactcacgaacttggtccggtttgtcacgaggaagaacattcacctagtcgtcgacgagatctacgccgccacagtcttcgccggaggagatttcgtgagcgttgctgaggtggtcaatgatgtggacatctccgaagtcaacgttgacttgattcacattgtctatagtctttctaaagatatgggacttcctggttttagagtcgggatagtctattctttcaatgactcggtcgtgtcttgcgcaagaaaaatgtcaagtttcggacttgtttcgtctcagacacaactcatgcttgcttcgatgttgtccgatgatcagtttgtggataattttctaatggaaagctcgagaaggttggggataaggcataaagtttttaccacggggatcaagaaagcagatattgcttgtttgacaagcaacgctggtttatttgcgtggatggatttgagacatctactgagagatcgtaactcgtttgaatctgagatcgagctttggcatataatcatcgatagagttaagctcaatgtgtctcctggctcttccttccgttgcacggaacctggatggtttaggatttgctttgccaacatggacgatgatactctccatgtggcgcttggacggatccaagatttcgtgtctaagaacaagaacaagatcgtcgagaaagcatctgaaaatgatcaggtaatccagaacaagagtgctaaaaagctgaaatggacgcagaccaatcttcgactaagtttccgacgactttacgaggatggtctctcgtctccagggataatgtcaccacactcacctcttctccgagcatgaaaatcttaaggcataacgtctgagagattggattaactcgtccctcgagacccagctttcttgtacaaagtggt

SEQ ID NO: 34 - DNA, 1524 bp, Arabidopsis thaliana
atggcgatggcgagcttagctaggagaaaagcgtactttctcaccagaaacatctctaattctcccactgatgctttcagattctctttctccctcactcgcggcttcgcttcgtcaggatccgacgacaacgacgtcgtcatcatcggcggcggtcctggaggttatgtggcggcgattaaagcggcacagctcggtcttaagactacctgtatcgaaaagcgaggcgctctcggtggtacttgtcttaacgtcggctgtattccttcaaaggcccttcttcactcttctcacatgtaccatgaagcaaagcacgtttttgctaaccatggtgttaaggtctcttcggttgaggtagatcttcctgctatgttggcgcagaaagacacagccgtcaagaatttaacccgtggagtcgaaggtctgttcaagaagaacaaggtaaactatgttaagggctatggtaagtttctgtccccatcggaagtctctgtggacacaatcgatggagaaaacgtggttgtgaaaggcaaacatatcatagttgcaactggctcggatgtcaagtctttgcctggaatcaccatcgatgaaaagaagattgtctcatcaaccggggcactgtctctgacagagatcccaaagaaactcattgtcattggtgctggctatattgggctagagatgggttctgtatggggacggctaggatcagaggtcacagttgttgagtttgcagcggatatcgtaccagcaatggatggtgaaatccgcaagcagtttcaacgctcactagagaagcagaagatgaaatttatgctcaaaactaaagtcgttggggtagattcatctggagatggtgttaaactcatagtggaacctgctgaaggtggagaacagaccactctagaagctgatgtggtcctcgtctcagctggtagaactccgttcacatctggacttgatctagagaaaatcggagttgagacagacaaaggcgggagaattctggtgaacgagagattctcgacaaatgtttcaggcgtttatgcaattggagatgtgattccaggaccaatgctggctcacaaagccgaagaagatggtgttgcatgtgttgagtttatagcaggcaaacacgggcatgtggattacgacaaagtccctggggttgtctacacgtaccctgaagttgcgtcggttggtaaaaccgaggagcagctgaagaaagaaggtgtaagctacaatgttggaaaattcccattcatggccaatagcagagccaaggccatagacacagcagagggaatggtcaagattttggctgataaagagacagacaagatcttgggagttcacattatgtcaccaaacgcaggagaattgatccatgaggcggttctagctatcaactatgatgcatcaagtgaagacattgctcgagtctgtcacgctcatcccaccatgagtgaggctatcaaggaagctgccatggctacctatgacaagcccattcacatgtag

SEQ ID NO: 35 - DNA, 1940 bp, Arabidopsis thaliana
atgatctctctcactccctcgttgtttctgaacaagacggttgttcctggatgttccacacgcctctctctgcgccagcctagaactataattactcctcctgcttccttgagagtcttttcctctctcggatctaaccaggatcccaccggcagcgttttgattgagaccactgccacttcatcctcctctctcgagacctccgccgccgacattgttcccaaatccaccgtatctggtggagttcaggatgtctacggcgaggatgccgccaccgaggacatgcctatcactccttggtctctctctgtcgccagtgggtatacgttgttgcgtgatccacatcacaacaaaggccttgcctttagccacagagagcgtgacgctcactatctacgcggcctcctcccccccactgttatctcacaagatcttcaggttaaaaaaattatgcacactcttcgtcagtatcaagttcccttgcagaagtatatggctatgatggatctccaggagaccaacgagaggctgttttacaaacttctcattgatcacgtcgaggagttgctacccgttatctacactccaacggttggggaagcctgccagaagtatggtagcattttcctgcgtccacaggggctttttatcagcttgaaagaaaaggtaagattcatgaagtgctgaggaactggcctgagaagaacatccaggtcattgttgtcactgatggggagcgcattttagggttaggagatcttggatgtcagggaatgggaatacctgttgggaaactttctctctacacagcccttggaggtgtccggccatctgcctgtctgcccgtaacaatcgatgttgggacaaacaacgaaaagctattgaacgatgagttctacatagggctccgccaaaggagagctacaggagaggaatactccgaacttatgcatgaattcatgacagcagtcaagcagaactatggggagaaagtcgttattcagtttgaagactttgccaaccataatgcttttgatctgttagctaagtatggtacaacacatcttgttttcaatgacgatattcagggcacagcatcagttgtgcttgctggacttatcgctgctcttagatttgtggggggatccttgtcagaccacagattcctcttcctcggggctggagaggctggcactggaatagctgaactaattgctcttgagatttcaaagaagtcccatattccattggaagaggctcggaagaatatttggctcgtggattcaaagggattgattgtcagttcccggaaagaatccattcaacatttcaaaaagccctgggctcatgaccatgaaccaataagggaacttgttgatgccgtcaaggcaatcaagccgacagttctgatcggaacatcaggtgtaggtcaaacattcactcaagacgtggtggaaaccatggcaaagctaaatgagaaacccatcattctttctctttcgaacccaacttctcagtcagaatgtacggcagaagaggcctatacgtggagtcagggacgggcgatctttgcaagtggaagcccatttgcgccagtagagtatgagggaaagacgtttgtgcctggacaggcaaacaacgcatacatcttccctgggtttggactcgggctaataatgtcagggacgatccgtgtccatgatgacatgcttctggcagcatcagaagctttggctgaggaactgatggaggaacactatgagaaggggatgatataccctcccttcaggaatatcagaaaaatctcagctcgtattgcagctaaggtggctgccaaggcctacgaactgggactggccacgaggttgcctcagcccaaggagctggagcagtgtgctgagagcagcatgtacagcccttcgtatcgaagctaccgctga

SEQ ID NO: 36 - DNA, 684 bp, Arabidopsis thaliana
atggtgggtgtgtcgccgaagatcgctccgtcgatgttgtcatcggactttgcaaatcttgccgcggaggctaagcggatgatcgatttgggcgccaattggcttcacatggacattatggacgggcattttgtttctaacctaacgattggtgctcctgtcatcgagagtttgaggaagcacacaaatgcatatcttgattgccacttaatggtgacgaaccccatggattatgtggatcagatggctaaagctggggcgtctggtttcacattccacgttgaggtggcccaagagaattggcaagaacttgtgaagaagattaaggctgctgggatgaggccaggtgtggctctaaagcctggaacacctgttgaacaagtctatcctctggtcgaaggtacaaatccggtcgaaatggttcttgtgatgactgtggagcctggatttggaggccagaagttcatgcccagcatgatggacaaggtcagggcattgaggaacaagtacccaacacttgatattgaggtggacggcggcttaggcccttccacaatcgatgcagcagctgcagctggagccaactgtatcgtcgcaggaagttcagtgtttggagctccgaagcctggggacgtcatatcccttttgcgggctagtgttgagaaagcacaaccctccacttaa

SEQ ID NO: 37 - DNA, 1450 bp, Arabidopsis thaliana
ttcttgtttgttgattaacccttaattaatccgggcgcgcctgatttatcacaagtttgtacaaaaaagcaggctcctgcaggacccacaatcagacaatgacatctctccatacgttactcttctcttctcttcttttcttcatcgtctttccaaccttcacgttttcctccaccttattgtttcagagtttcaattgggagtcatggaagaaagaaggaggattctacaattctctccacaactccattgacgacatagccaacgctggaatcactcatctttggcttcctcctccttctcaatccgttgctcctgaaggttacttaccgggaaagctatacgatctaaacagctccaaatacggttcagaggcggaactgaaatcgttaatcaaagcgttgaatcaaaaaggaataaaagctttggctgatatagtgattaaccacagaacagctgagaggaaagacgataaatgtggatactgttatttcgaaggtgggacttccgatgatcgtcttgattgggatccttcctttgtctgccgcaatgaccctaaatttcccggtaccggaaacctcgacaccggaggagattttgatggagcgcccgacatcgaccaccttaaccctagagttcagaaagagttgtccgaatggatgaattggcttaaaactgaaatcggattccatggttggagatttgattatgttcgaggttatgcatcttccatcaccaaattatacgttcagaatacatcaccggattttgcggtgggtgagaaatgggacgatatgaagtacggaggagacgggaaactagactatgatcagaacgagcatcggtcgggtctcaaacagtggatcgaggaagcgggtggtggtgtgttgacagcttttgatttcaccaccaaagggatcttacagtctgctgtcaaaggtgagctttggagactaaaggactcgcagggaaaaccgcctggtatgataggaatcatgcccggaaacgctgtcacattcatagataaccatgatacattcagaacgtgggttttcccttctgataaagtcttgcttggatacgtttatatacttactcatccaggaactccttgcattttttataatcattacatagaatggggactaaaagagagcatctcaaagctggtggctatcaggaacaaaaatgggattggtagcacaagctctgtaacgataaaagcggcagaggcggatctctacttggctatgattgatgataaagttatcatgaagattggaccaaagcaagatgtgggaacacttgttccttctaattttgctttagcttattcaggccttgactttgctgtctgggagaagaagtaacgcataactcctcgagacccagctttcttgtacaaagtggtgataaattggagctctgcagagctttcgttcgtatcatc

SEQ ID NO: 38 - DNA, 1077 bp, Arabidopsis thaliana
atgtctgcttttgtcagcaaatacgaagatgagctgatcaagacggccaagtacattgcaacgccgggaaggggcattttggcggcagatgagagcacagaaaccattgggaaacgattcgccggaatcaatgttgagaacactgagtccaaccgccaagcttaccgtgagctcctcttcacttcccctggcagttacccttgcctctctggtgttatactcttcgaggaaaccctctaccagaaaacctctgatggcaaacccttcgtcgatctcctcatggagaacggtgttatccccggaatcaaagtggacaagggtttggttgatctagcagggaccaacggcgagaccactactcaaggtctagactcgcttggtgcacggtgtcagcagtattacgaggcaggagcccggtttgctaaatggcgtgcattcttcaagattggggccaccgagccaagcgttctctccatccaagaggacgccagggtgctagcccgctatgccatcatctgccaggagaatggacttgtcccgatcgtcgagccagaggtgctgacaggtgggagccacgacatcaagaaatgtgcggcggtgactgagacggttcttgctgccgtgttcaaggccttgaactaccaccatgtcctcctcgaaggcactctgcttaaacctaacatggtcactcccggctccgacagcccaaaggttgcaccggaactaattgcggaatacacggtgactgctctgcgccgcacagtcccaccagctattccgggaatcgtgttcctctcaggcatacagcgcgaagagcaagcgacactaaatctaaacgcaatgaacaagcttgatgtgttgaagccatggacgctcactttctcttttggcggagccctccagcaaagtgctatcaaggcttgggccggtaagcccgagaacgtagccaaagctcaggccaagttcctgaccaggtgcaaggctaacaaggacgctaccctcgggaaatacaccggctgggcttctggtgactcggccgctttcgagaacttggttgtgataggatacaggtactag

SEQ ID NO: 39 - DNA, 597 bp, Arabidopsis thaliana
atggcgaccgatgatgtgaacgagcctctcccggcggcggcggaattaccggcgacagaggcggagaaacaaccacacaagctcgaaagaaagtggagtttctggttcgataaccaatcaaagaaaggcgccgcctggggagcttctcttcgtaaagcctatactttcgacaccgtcgaagatttttggggattgcacgagactatatttcagactagcaaattgacagcgaatgctgaaattcacttgttcaaagctggtgttgagccaaagtgggaagatccagagtgtgctaatggaggaaagtggacttgggttgttactgctaataggaaggaagctttagacaaaggctggcttgaaactttgatggctttgattggagagcaatttgatgaagcagatgagatttgtggtgtggttgctagtgtccgtccacagtcgaagcaagacaagctctccttgtggactaggacgaagtctaatgaagctgttctgatgggtattgggaagaagtggaaggagatacttgatgtcaccgacaagataactttcaataaccatgatgattccagaagaagccggttcactgtctga

SEQ ID NO: 40 - DNA, 1256 bp, Arabidopsis thaliana
ttcttgtttgttgattaacccttaattaatccgggcgcgcctgatttatcacaagtttgtacaaaaaagcaggctcctgcaggaccgcagtttgtagaatcatggagaggtacgaaatagtgaaggatattgggtctggtaacttcggagtagcaaagcttgttcgtgacaaattttccaaagagcttttcgctgttaagttcatcgagcgaggccaaaagattgatgaacatgtacaaagagaaatcatgaaccataggtcgctgatccatcccaatataataagattcaaggaggttttattgacggcaacacatttggcgttagtaatggaatacgccgccggaggagaactgttcggaagaatctgcagcgccggaagattcagtgaagacgaggcaaggtttttctttcagcagcttatatcaggagttaattactgtcacagtcttcaaatatgccatagagatttaaagctagagaacacgttacttgatggaagcgaagcgccacgtgtaaagatttgcgactttggatattcaaaatcaggagttcttcattcgcaaccaaagacaacagtaggaacacctgcttacattgcacctgaagtgctctccacgaaagagtatgacggcaaaatcgctgatgtttggtcttgtggagtcactttgtatgttatgcttgttggtgcttatccttttgaagatccttctgatcctaaagattttcggaagacgatcggtcggattctcaaagctcagtatgctattcctgattatgttcgagtttcggatgaatgcagacatcttctctctcggatattcgttgccaaccctgaaaagagaataacaatagaggagataaagaatcattcttggtttctcaagaacttgccggtagagatgtatgaaggatcattgatgatgaatggtccatcgactcagacagtagaagagatagtgtggatcattgaagaagctcggaaacctatcaccgtagctactggactcgcaggtgctggtggctctggtggaagcagtaatggtgccattggaagtagcagtatggatctcgatgacttggacacagatttcgacgacatcgataccgctgatctcctttcccctttgtgaacaattgtatcaaaaaccaaagatttcatgtttctgaagcctgctgatactacctcgagacccagctttcttgtacaaagtggtgataaattggagctctgcagagctttcgttcgtatcatc

SEQ ID NO: 41 - DNA, 2962 bp, Arabidopsis thaliana
aaactctttgtttcttgtttgttgattaacccttaattaaatgacaagtatgatcgtgaagacaacgccggagctcttcaaaggaaatggagtgttccgtacggatcatctcggagaaaaccgaatggttagtcgatcaaaccggctaggtgatggatcaaaccgtttccctagaaccggtacaatccattgccaacggttaagcatagcaaagaccggtttgcatcgtgagacgaaggctcgagccatacttagccctgtgtccgatccggccgcttccatagcccaaaagcgagtattcacctttggaaaaggaaggagcgaaggcaacaagggcatgaagtccttgttgggagggaaaggagccaacctggcggagatggctagcataggcttgtcggtgccgccggggctaaccatatcgacggaggcttgtcagcagtatcagatcgccggcaaaaagcttccagaaggtttatgggaagagatcttagaaggtcttagcttcatcgaacgtgacattggagcttccctcgctgatccctccaagccactcctcctctctgttcgctccggcgccgccatctcaatgcctggtatgatggacactgtacttaaccttggcttgaacgaccaagtcgtcgttggtctggccgcaaaaagcggagagcgttttgcttacgattcgttccggcgttttcttgatatgtttggtgatgttgtgatgggaattccacacgccaagtttgaagagaagttagagagaatgaaggagaagaaaggagttaaaaatgacactgacttaagcgcggctgatctcaaggaattggttgagcagtacaagagtgtttacttagaggccaagggtcaagagtttccttcagatccaaagaagcaattggagctagcgattgaagcggtattcgattcttgggatagcccgagagcgaacaagtacagaagtattaaccagataactggattgaaaggaaccgcggttaacattcagtgtatggtgtttggaaacatgggggacacttcagggactggtgttctcttcactaggaaccctagcacaggagagaagaagctttatggcgagtttctagttaatgctcagggagaggatgtggttgcagggataagaacaccagaagatttggatacaatgaagagatttatgcctgaggcttacgctgaacttgttgagaactgcaacatcttagaaagacattacaaagacatgatggatattgaattcacagtacaagaagagagattgtggatgctgcaatgcagagcgggtaagcgaacgggtaaaggcgccgtgaagatagcagttgatatggtaggtgaagggcttgttgagaaatcttctgctatcaaaatggtggagcctcaacatctagatcaactacttcacccacagtttcatgatccatcggggtatcgtgaaaaagtggtggccaaaggcttacctgcgtcaccaggagcggcggttggacaggttgtgttcacggcggaggaagccgaagcttggcattctcagggtaaaactgtgattctggttcgaactgagacaagccctgacgatgtgggaggtatgcacgcagcggaaggtatattgacggctagaggaggaatgacgtcacacgcggctgttgttgctcgcggttggggaaaatgttgcattgctggttgttccgagattcgtgtcgacgagaaccacaaggttctattgattggagatttgacgactaatgaaggcgaatggatctcaatgaacggatcaaccggtgaggttatattagggaaacaagcattggctcctccggctttaagtccagatttggagactttcatgtcctgggctgatgcaatcagacgtctcaaggttatggcgaatgcggatacacctgaagacgccattgcagttaggaaaaacggagctcaaggaatcgggctttgtaggacagagcatatgttctttggagcagataggattaaagcagtgagaaagatgataatggcggtaacaacagagcaaaggaaagcttctctcgacatcttgcttccttaccaacgttcggatttcgaagggatcttccgtgctatggatggtttaccggtaacaatccgtttgttagaccctccgcttcacgagtttctcccggaaggcgacttggacaacattgtacatgagctagctgaagaaactggtgtgaaagaagatgaagtcttgtcacggatagagaaactctctgaagtgaatccaatgcttggtttccgcggttgcaggctcggaatatcgtatccagagctaacggagatgcaagcgcgtgcaatttttgaagctgcagcgtcaatgcaggaccaaggtgttactgtcattcctgagattatggttccacttgtaggaactcctcaggaattgggtcaccaagttgatgtaattcgtaaagttgcaaagaaagtatttgctgagaagggtcataccgtgagctacaaggttgggacaatgattgagatccctcgagccgcgctcattgcagatgagattgcgaaagaggcggagtttttctcgttcgggacaaacgacttgacgcagatgacgtttggatacagtagagacgatgtcggcaagtttctaccgatttacctcgccaaaggaatcttacagcacgacccttttgaggttcttgatcagcaaggtgtagggcaattgatcaagatggcgacagaaaaaggacgagcagctaggcctagcctcaaggttgggatatgtggagaacatggaggagatccatcttctgtgggattctttgctgaagcaggacttgactatgtctcttgttctcctttcagggtcccaattgcaaggcttgcagctgctcaagtagttgttgcatgaggcgcgccaaaattggagctctgcagagctttcgttcgtatcatcggtttc

SEQ ID NO: 42 - DNA, 1542 bp, Arabidopsis thaliana
atggaagctctaaactctatcttaaccggctacgccgtggcagccctatcagtctacgctctttggttctacttcctgtcccgaagactaaccggtcccaaagtcttaccgttcgtaggaagcttaccgtatctaatcgctaaccggagccgaattcacgattggatcgctgataatctccgagcaactggtggtacgtatcaaacatgcaccatggtgatacctttcgtagccaaggcgcaagggttttacactgtgacgtgtcacccaaaaaacgtcgagcatatccttaagacacggttcgacaactatccgaaaggtccgatgtggcgcgctgctttccacgacctgttaggacaaggaatcttcaacagcgacggtgacacgtggctcatgcaacgtaagactgcagcgcttgagttcacaactagaactcttagacaagccatggctcggtgggttaacgggactatcaagaaccggttatggcttatattagaccgtgcggttcaaaacaacaaaccggttgatcttcaagatttgtttttgaggttaacttttgacaacatttgtggtctgacttttggtaaagacccggagacgctctctctggatctaccggataatcccttctctgtcgcttttgacaccgcgacagaggctactctaaagagacttctctacaccggtttcttgtggaggattcagaaagctatggggattggatcagaagataagctcaagaagagtcttgaagtcgttgagacttacatgaacgatgcaatcgacgctcggaaaaactctccctccgatgatcttttgtcacgtttcttgaagaaacgtgacgttaacggtaacgttcttccaacagatgttcttcagcgtatcgcgcttaactttgttctcgcgggccgtgacacttcttcggtggccttgagctggttcttctggctcgtcatgaataaccgggaggtggaaacgaagatcgttaacgagttgtcgatggttctgaaggagacacgtggcaatgatcaggagaaatggacggaggagccgttagagttcgacgaggcagataggctcgtttacctcaaggctgctttggctgaaacgctgcgcttatacccttctgtgcctcaggatttcaaatacgtcgtagacgatgacgttttgccggacgggactttcgtgccaagaggctcgacggtgacctactcgatttactcgatcggacgtatgaaaacaatttggggcgaagattgtctcgagttccgtccggaacggtggctgacagccgacggtgaacggtttgagactcccaaagatggttacaagttcgtagcgttcaacgccggaccaaggacttgcttgggaaaggacttggcttataatcagatgaagtcggtggcttcagccgttctcctccgttaccgggtttttccggttcccggtcaccgcgttgagcaaaagatgtcgctgacgcttttcatgaagaacggtttacgtgtttatttgcaacctcgtggtgaggtgcttgcatga

SEQ ID NO: 43 - DNA, 1845 bp, Arabidopsis thaliana
atgtcaggtcccgttgatcgattcgcaataccatgttttgagggaatattgagcagtgatgagaaaaaggaaagaaagtctgattttgagaactcagaagatgagaggagaacaagaatcggttctttgaagaagaaagcaatcaatgcatctaccaagttcaagcattctctcaagaaaaagagaagaaaaagtgatgtccgggtcagttctgtctccattgaggatgttcgtgatgttgaggagcttcaagcggttgatgagtttagacaagcattggtaatggaggagttgcttccccataaacacgatgactatcatatgatgttgaggttcttgaaggctaggaaattcgacattgagaaagctaagcacatgtgggctgatatgatccagtggaggaaggaatttggtaccgacactattattcaggattttcagtttgaagagattgatgaagttctgaaatattacccgcacggttatcacagtgtagataaagaaggcaggcctgtgtatattgaaaggcttgggaaagttgatcctaacaaactgatgcaagttactacgcttgatcgatatattagatatcatgttaaggagttcgagaggagttttatgctcaagtttcctgcctgcactattgctgccaagaagtatattgattcaagcacaactattttggacgtccaaggagtgggactgaagaacttcacaaagtctgctcgtgagcttattacaaggttgcagaagattgatggagacaattatcctgagaccctccaccaaatgtttatcatcaatgcagggcccggattccgtctgctttggagcactgtcaagagttttctagaccccaaaacgacttctaagattcatgtactcggctgcaagtatcagagtaaattgcttgagattattgattccagcgagttgcctgaattcttgggaggggcttgtacctgcgcagatcaggggggttgtatgctttctgataaagggccttggaagaatccagagattgtaaagatggtacttcatgggggagctcaccgtgcgaagcaggtggtgaaagttctgaacagcgacgggaaagtcattgcttatgctaagccgtcttatccatggataaaaggaagtgacacatcaactgcagaatcaggttctgaagctgaagatattgttgtgtctccaaaagcagtaaagagttattcccatctccgcttgacccctgttcgtgaagaggcaaaggttggttctggtgaaacgagttttgccggtagttttgcaggttatgatgagtatgttccaatggttgacaaagctgttgacgccacctggaaggttaaacccaccgccatcaaccgggctccttctaaaggagctcatatgcctccaaatgtcccaaaggatcatgaaagcttcagtgctcgtgtcctagtaactttcatggcttttgtgatggcgattctcacattcttccgtacagtatcaaaccgtgttgtgaccaagcagcttccaccgcctcctagccaaccgcaaattgaaggaagcgctgctgcagaggaagctgatctcctcaattcagtgctgaagaaattaaccgaacttgaggagaaaattggagcgctccagtcaaagccatctgagatgccttatgagaaagaggaactgcttaatgcagctgtctgccgtgtagacgcccttgaagctgagctcatagccactaagaaggctctttatgaagctctgatgagacaagaagaattactcgcttacattgaccgtcaagaggcagctcagcaccagaagaagaataagaggaagcaaatgttctgtttctag

SEQ ID NO: 44 - DNA, 324 bp, Arabidopsis thaliana
atgtctcacagtcacgggaacgcttcgtcggtgaacgatccacggcagccttcggcggcaaagccttacattccacggcctgtagcgccggaggatcttcccgttgactactccggattcatcgccgttatcctcggcgtctccggcgttatgttcaggtacaagatatgctcgtggcttgcaattatattctgtgcacaatctctggccaacatgaggaacttggaaaatgatttaaagcagatctccatggctatgatgtttgctataatgggattggttacaaactacttagggcctaacagacccgcgacaaagaaataa

SEQ ID NO: 45 - DNA, 1632 bp, Arabidopsis thaliana
atggcggtttcaagtgctttcgttggttgtccaaagcttgagactttattgaatcaccataatctatctccttcttcttcttcttcgtcctctgtttcacagacaccattgggtcttaatggggttcgtgttcttccgaagaacaatagaaccagacgaggtttgatccaaaaagctcgttgtgtgctctctgcttcttctgattctgcgtctaatgcagctagcatctctgctcttgaacaactcaagaactctgcagctgatcgatatacaaaggaaagaagcagtattgttgtgattggacttagtattcacacagctcctgttgagatgcgtgagaagcttgctatacctgaagctgaatggccaagagctattgctgaattgtgtggtttgaatcatattgaagaagctgctgtgcttagtacttgtaaccgtatggagatttatgttttagctttatctcagcatcgtggagttaaagaagttactgaatggatgtcaaatacgagtgggatcccagtttcagagatttgtcaacaccgttttctgttgtacaacaaggatgctacacagcatatatttgaagtctcagctggtcttgactctcttgtcctaggagaaggtcagatccttgcacaggtgaaacaagttgtgaaagttggtcaaggagtgaatggctttgggaggaatatcagcgggctgtttaaacacgcgataactgttggtaagcgtgttagaacagagacaaatattgcttctggtgcggtttcggttagctcagctgctgttgaacttgctctgatgaagcttccgcagtcttcaaacgtatctgctaggatgtgtgtaattggcgctggaaaaatggggttgcttgtgattaagcatttgatggctaagggttgcacaaaagtggtggtagtcaacagaagtgaagagagggtttcagctatccgtgaggagatgcctggtattgagattatatatcgacctcttgatgagatgctagcttgtgcttcagaagcggatgttgtgtttaccagcacagcctctgagacgccattgttcttaaaggagcatgtagagaatctccctcaagcttcaccagaggttggaggactgaggcattttgttgacatctctgttccgagaaatgttggatcttgtgttggtgaagtagaaacagcacgggtttacaatgtggacgatctcaaagaagttgttgctgccaacaaagaagacaggatgaggaaagcaatggaagctcaaaccataatcacagaggaatccacacagtttgaagcatggagggattcattggagacggttccaacgatcaagaagttaagagcttatgcagagagaatcagagtggcagagctcgagaagtgcatgtccaaaatgggagatgatatcaacaagaaaacaacgagagcggttgatgacttaagccgaggtatcgtgaacagattcttacatggtccaatgcagcatttgagatgtgacggaagtgacagtagaacgctgagcgagacccttgagaatatgcatgctttgaacagaatgtacggtcttgagaaagacattttggaggaaaagcttaaggcaatggcggaacaacaacataagtaa

SEQ ID NO: 46 - DNA, 1053 bp, Arabidopsis thaliana
atgggtcgaccagaccaaactccgagcccgaggatgaacaataactttaatccggtctttcatgcacaatctgaacaaccggttgacgagaaacgggttctgcaagctgagcagatatatcccaacaacggtggagtggttaaccaaccaaaccaagtaccgatgagacctggtccacctacgtatatcaatcaaagtgcaacatttaaccaaccatatggagtatcaatggccggaccggtccatacacagccatcgaactggacttcaggtctatttgattgcatgaacgacggcgaaaatggttagaattcaaaattttgaataattctatcttgaaggtccatccttacattgcaaaatgattcttctgtattcgttgtgtttttgtattagctctcatcacatgctgttttccattcgtcacgttcggacagatcgcagaggttatcgatgaaggagcgaccagtaagtatacattatcttttacattcaattcaagaaaacaaaagtatacaaaatcggtttttagtatgtgcaattgttgcatttgatactgtcatgtatacatatattttgataggttcaataattatcaatgtagcatgcataaacatatattatgtacgtttaagtatatatgcgtatgttgcaggttgtgggacggctggaatgttgtatgggttgatatgttgtttgtttgcgataccgtgtgtgtatacatgcacattccggaccaagctccgaagcaagtacgggttaccggatgctccagctccagattggatcactcattgcttctgtgaatattgtgctctttgccaagaatatcgtgaactcaagaatcgtggccttgacccttccattggtaaaccaacaagctcttagatctctttaaaataaatattctaaataatgggttttagaaatgattaatttgacttattgcatatcttggtgtatttaggatggattgggaacgtgcaaaagcagcgaatgggtcagcaacaagagatgatggctcctccaatgggtcaacgaatgatgggttga

SEQ ID NO: 47 - DNA, 729 bp, Arabidopsis thaliana
atggcgggagaagatagccgtgaagctcaacgaggcgacgaatatgaggaatcgagtcctctcttgaaggtgaacgagaatgacggcaagatctgctcgaaaagagatgccaaggcggcgcctcttgtgcctcctcccgcggcggaggaatacggctggacggcggatggattgcctgtgagccatggtagcgtgattggcgagccgatcaggagaaaccagtggaattctggtctttttacctgtcttggtcgcaatgatgaattttgcagcagcgatctcgaagtttgtcttcttggaagtgtggctccttgtgtgttgtatggaactaatgcagagagacttgggtctgctccgggaacattttcaaaccattgcttgacgtatttgggattgtactttgttggtaattctttgtttggctggaactgtcttgctccatggttctcttattctagccgttctgctattcgccgaaagtttaaccttgagggaagctttgaggctatgaacaggtcttgtggttgctgcggtggctgcatagaggacgagatgcaaagggaacacttggagacgacttgtgactttgtgacacatgtcctttgccatacatgtgccctttgccaagaagggcgtgagctccgcaggaaggttcttcacccaggtttcaatgctcagtccaccgttgttgtgatgccacccatagaacaaactatgggtcgtaagtga

SEQ ID NO: 48 - DNA, 1195 bp, Arabidopsis thaliana
  misc_feature (5)..(15): n is a, c, g, or t
atgannnnnnnnnnnagaaaacactcgatcggctatatatatacgtacaacacataagaaacccgagccaaccccttcactctctctaatcaaaaagcttttaacctcagccgttaaatctttctccgatcatgccgaccagaaacatcgccattggtggagtccaagaagaggtctatcaccccaacgcacttagggcggcgctcgctgagtttatctcgactttgatcttcgtcttcgccggctcaggctccggaattgctttcaacaagatcactgacaatggagcaaccactccttccggcctcgtcgccgctgccttagctcatgctttcggtctctttgtcgctgtctctgttggcgctaacatttccggtggccacgttaaccctgccgttaccttcggtgtcttactcggtggtaacatcactctcctccgtggtattctctactggattgctcagcttcttggctccgtcgccgcttgtttcctccttagctttgccaccggtggcgagccaattccagcgttcggtctctctgccggagtcggatcattaaacgctctcgtcttcgagatcgtgatgaccttcgggctcgtctacaccgtctacgccacagccgttgaccccaagaacggtagtctcggaacaatcgcaccaatcgccataggtttcatcgttggagctaacatcctcgccggtggagctttcagcggagcttccatgaacccagccgttgctttcggaccagccgtcgtaagctggacgtggaccaaccactgggtttactgggctggtcctcttattggtggtggactcgccggaattatctacgactttgtcttcatcgatgaaaatgcccacgagcaattgcctaccaccgattactgaagacgtcaaattcaacgttgttaatctgatgaatttttcgtgatttgcttttttaatttgcatcgtaatgggtttctggccgttggatcatttttagatgaatctttgtctattgattgatcatttatgtgtctttgggtttgttgttggagttgtaatatctctggaaggcttttgtgcaattgtattgtacggtttaataactataattgagaaaaccagggaatgtgaattatgaaaatgaattatataatcatgcgaagtcatagctcgtctatagtcaacgaaattcatccattttc

SEQ ID NO: 49 - DNA, 1266 bp, Arabidopsis thaliana
atggcgagagcagcttgtagcagtgtcgtcacggctatggctttgttaccctctaagtctcttctctgtagaaaccagttattattctccggtaattccaagttcgtcggagttttgactctccagaagcgatgcttttcctccaaagtaagcatgagtttgaaagctggtatcgtcggtcttcctaacgtcggaaagtctactctttttaacgccgtcgttgagaatggaaaggctcaagctgctaattttcccttttgtacgattgagcctaatgtgggtattgttgctgttcctgattcgcgtcttcaagtgctttctaaacttagtggttctcagaaaacggttcctgcttctattgagtttgtggacattgctggtcttgtcaagggtgctagtcaaggcgaaggtttaggcaataagttcttatctcacatcagagaagttgattccatcctccaggtggtgagatgttttgaggacaatgacattattcatgtgaatggtaaagttgatccaaagtctgacattgatgtcatcaatctcgagcttattttctgcgacttagatcagattggtaaaaggatcgagagactaaagaaagggaaggctaaggattcacaatccaaagtcaaggaggaagctgaaaaatctgctttggaaagaattcaggaagctcttctggaaggaaaacctgcacggtcagttgcattgtccgatctcgagatggaagttgtaaagcatctctgcttgcttacaatgaaacctatgatctacgtggcaaatgttgctgaaactgatcttgctgagccagagaagaatgcttacgttgaagaagtgaagggtctttcttctgatttgcagtccggacatgtagttgtttcagcacaggttgagtcagagctaaccgaacttcctcttgaagaacgcacagaatatttgaactctcttggtgtcagtgaaagtggcctcgggaaccttatcagggcaacatacagcctgctaggtttgcagacatatttcacttctggtgaaaaggaaacaagagcatggacaatacacgctggcatgactgcaccacaagctgctggcgtcattcattctgactttgagaaaggttttattagagctgagactgttgcatatgaagattttgtcactgctggatctatagcagcagcaagggagaaaggacttttgagatcagagggtaaagagtacattgttaaagaaggagatgtgatgcttttccgcttcaacgtatag

SEQ ID NO: 50 - DNA, 1464 bp, Arabidopsis thaliana
atggaaagcgaagcagcagcgactgttcaagccaccaggccgagaagagcacctaggactccggtgacagccattttgacggataagagaagacggaaacctaagagcaacaacgagtctcagttaccatttttgctacagcagagtcaaaaggccaccgttgacgacacttactctcagtggaagactcttcttcccattctctatgattcgtttgttaatcataccctcgtctggccctctctctcttgcagatgggggccacagcttgagcaagcaggttctaagactcaacgtctctatctctcggaacaaacgaatggcagtgtgcctaatactttggtcatagccaattgcgaaactgttaataggcagcttaatgaaaaggcacactctccatttgtgaagaagtacaagaccatcatccaccctggagaggtcaacagaattagggaactccctcaaaatagcaagattgtagctactcacaccgacagtcctgatattctcatttggaacactgagactcaaccagaccggtatgctgtgcttggagctccagattctcgtccagatttgttactaattgggcaccaggatgatgctgaatttgctcttgcaatgtgcccaaccgaaccttttgttctctctggaggcaaggacaagtccgttattttgtggaatatccaagaccatatcacaatggctggttcggattccaaatcccctggatccagcttcaagcagactggtgaaggtagtgataaaactggtggtccttctgttggccctcgaggcatatataatggccacaaagatactgttgaagacgtggcattctgtccatctagtgcacaagaattctgcagtgttggtgacgattcttgccttatgctatgggacgcaagaactggcactagtcctgccatgaaggttgagaaggcacatgatgctgatcttcactgtgtcgattggaatcctcatgacaataatctgatcctgactgggtcagcagataacactgtccgtgtgtttgaccgccgaaaccttacctcaaatggagttggttcacctgtttacaaatttgaaggccacagagctgctgttctttgtgttcagtggtctcctgataaatcatctgtttttgggagttctgcagaagatggtctcttgaacatatgggattgtgatagggttggcaagaagtctgagcgtgcaaccaaaactcctgatgggcttttcttccagcatgctggtcacagggacaaagtggtcgacttccactggagcctattgaacccttggactattgtcagtgtttctgataattgtgagagtatcggtggaggtggtacattgcagatatggcggatgagtgacttgatttacagaccggaagatgaagtcctgacagagctagagaaattcaagtcacatgttttcacatgtacctccaagtcttga

SEQ ID NO: 51 - DNA, 963 bp, Arabidopsis thaliana
atgggcaatccgggatcagacacagagagaaacaagggaaatgtggtctcaagtgtgtttgatcctgcactctctcgattcgttggattttcccagaaactccaaactcgtcttaagtcccagctgaagaatttgacagatgataagcatgggattggttcttcatggaggcaagataaaggaaactcatcgatctccatgcaaattgatctggagaaacagttagattgttggagggaaaacccttcgtggactgatcagatcccagtcgttaaggtgggtattccaaaaggatcgctttgcaatcttaaagccgaggtgaatgttggtttacctcctgatgcagtctataacattgtaattgaccctgacaatagaagagtcttcaagaatatcaaggaggttatgtcgcggaaagtattggtagatgacgggttaaggcaagtggtggaagttgaacaagcagctttgtggagatttctctggtggtcaggaacaatctcagttcatgtcttggtggatcaggatcgggcagatcactctatgaaattcaagcaagtgaaaagtggattcatgaagagattcgaaggaagctggcaagtaaagcctttgtttgtggatgaacatatgtgcgatcgtttgaaaccgaaaacgctggaggagtataacaggtgcactggaggtaaagggaggatcggatctaaggtaacgctggaccagctaatacagccagcgattgttccacctccgcccatttcttggtatctcagaggaatcacggctaagacgacagagatgcttatccatgacttgttggctgagaccgccaggatccgtgcagctggagtaatggaggatggtcactcgcccgatgagcaacggattggcacacctggagatataaaagaaagatggtctgcacatagaagaacatcaaggagacgacgcaatgatttgtgttaa

SEQ ID NO: 52 - DNA, 1347 bp, Arabidopsis thaliana
atggtgaggaaaaaggtaccggaatggcttaatagcaccatgtggtctactcctcctccgccatcttcttacgacgatggtctcctccgtcattcccccgtcactaagatgaaggaagaggcagaatcgatttccgttgctcccaggcttaattctgctcctccgccttcttccaacacttcggttccatcgccgtcgcatagaccgaggaacggtaacagtatctctggcggtagtggcgaatatggacattccgttggtccttccgccgaagacttttcccgccaggctcatgtctcagcggagttgtcgaagaaggtgatcaatatgaaggaattgaggagtctagctttacaaagtttgccggattctcccgggatccgttctactgtctggaagcttttgcttggttacttgccacctgaacgttcactctggtcaactgagttgaaacaaaagagatcccaatacaagcactacaaggatgagcttctgacgagtccttcagaaatcacatggaaaatggtgaggtcaaaagggttcgacaactatgacttgaagagtgaaagccgatgcatgcttgcccgatccagaattactgacgaggaccatcctttaagcctagggaaggcgagtatctggaatacatacttccaggatacggagaccatagaacaaatagacagagatgtcaagcgtacacatccagacataccctttttctccggtgaatcatcgtttgcgcgttctaatcaggaatctatgaagaatatattacttgtatttgcgaagttaaaccaaggcatcagatatgttcaagggatgaacgaaattttagcacctatcttttatgtattccgtaacgaccctgatgaagatagttcatcccatgctgaagcagatgcattcttttgctttgttgaattgttgagtggatttcgagacttctactgtcaacaactcgacaatagtgtggtgggaatccgatctgcaattacgaggctctcacaacttgtgaggaagcatgatgaggaactgtggcgtcatctagagatcaccacgaaagtaaatccacagttctatgcatttaggtggatcactctcctcctaacacaagagtttagtttctttgacagtcttcacatatgggatgcactcttaagcgaccctgaaggtccgctggaaagcttactggggatatgttgtgcgatgctggtactggtgaggaggaggctaatcgctggggatttcacgtcgaatatgaagttacttcaacactatccaactacaaacatcagtcatctcttgtatgtagccaataaacttcgttccaaaatgttagtataa

SEQ ID NO: 53 - DNA, 1703 bp, Arabidopsis thaliana
ttaattaatttctacaaatgggtttccaaagatctatctcttcttcttctgcattaaaatggcttggatttgtaacagcggtttgggttcaatccatctccggcaacaactacactttttcaaactactccggtgctcttaagtctctcatgaatctcaaccagctcgagctcaacaacctctctgtcgctaaagacgtcggaaaagcctttgggatcctggctggccttgcctctgaccgtcttcccactccggtcatcctccttattggttgctttgaaggtcttcttggttatggtgtacaatggctcgttgttagccgcaccatccaaccaatcccttattggcagatgtgtatattcctctgtatgggagggaacagcacaacgtggatgaacacggcggttctagtgacttgcatacgcaattttcgacgaaaccgtggtccggtctccgggatattgaaaggatatgtcggtttaagcacagctatattcactgatctctgtactgctctgttctcaaacgatccggcgtcgtttttggttttactagccgtggtgccttttgccgtatgtctcacggcggttttcttcctccgtgagatcccaccagcatcttccgcagctgaggagaacgaagagactcgttactttaccatattcaacattgtggccgttgttgtcgccgtgtatcttcagtcttacgacatcattggaatcaaaactggagtgttctctgtcgctttcgcttctatacttctcttcctcttggcttctccaatagccattcctttccactccttcatcaagagcttgaactacggtgaacaagatgacttagaaggacggattcaagaaccgttgcttagatccgagatagcggcagcggagaaagaagtaatagttgtagctgcggtggcagcggaagaggaggagaagaagaggaagaaaccggttttgggagaagaccacactataatggaagcagtgttgaccgttgacttttgggtgctttttgtgtccttcttgtgtggtgtaggaactggtttagctgtgatgaacaatatgggtcagataggtcttgcccttggatacacaaatgtctcaatctttgtctccatgactagtatttggggattcttcggtcgcattctctccggtactctctccgaatactttctcaagaaagctggaacaccaagaccactatggaatgcagcctctcaaatccttatggccgtaggatatatactaatggctttagccgtgcctaattcactctacatcggttcaatggtggttggagtatgttacggtgtccgtctagccataactgtaccaacagcttccgaactctttggtctcaaatactacggtctcatctacaacatcttagtacttaacttgccacttggctcgtttctcttctcgggtctcctcgctggcttcctctacgatgcagaggcaacaccaactcctggtgggggcaacacgtgcgtaggagctcattgctaccgtctcatcttcatagtcatggcattagcttctgttatcggagtcggtttggatcttgtgttggcttataggactaaggagatttacgctaagattcacgctagcaagaagtcaaagaaatctggtggtagccttagttaagacactgtatatctagttccggtgcactacattgtttggcgcgcc

SEQ ID NO: 54 - DNA, 1329 bp, Arabidopsis thaliana
atgagcagcagcagcgatactcatgccggagaatctcgtcatcgccgtaacccgatccggtggctactcggtttcggtttcttcgtacaaggattcagaggattcccatggcttggagccaatttcttcctcacagaacagctccgtgttaatccttcagtgcttcagcttcttcaaaactcagccaatcttccaatggtcgctaaacccatctacggcgtcgtttcagactctgtctacttctttggccaacatcgaatcccatacatcgccgttggagctttgttacaagcaatctcatggctagctatagcattcttgtcaagatccaatgtatcaatcttagctttatcgatatatcttctccttagtaatctcggtgcttccttagtagaagtagcgaatgatgctattgttgctgaatccggaaagcaaaaaacctcagagacgcaatccggtgagctaccgtcatttgtttggatggtttcttctcttggtggaatcttaggtaaccttttaggtggtattgctatcaaaacgttttcagctcagtcaacgtttcttgtgtttgggatcttggctcttcttcagttcttggtaactataaacatcagagaaaagtctcttaatcttccggaaaatccatcaccagctggtggtattaggaaacatctctctgatctttcgcatgtgttgaggaagcccgagatttcttattcgatagcttggatcgcggtatcaaccgctgtggttccggttttgacagggactatgtttttttaccaaacaaagtttctgaagattgatgcatcacttttagggatctccaaggtgtttggtcaaattgcaatgcttctttggggttttgcatataatcgttggctaaaagctatgcggccgaggaaactgctgacagccattcaggtgacgatagctttctttgtgatatccgatctcttgtttgtgaaaggcgtgtaccgggatttgggagtgtcggactctgtatatgtactcttcttttctggattcttggaaactctattttacttcaagattctgccgtttactgtcttgatggctcgtctctgtcctcctggatgtgaagggtctctcatggcatttgtcatgtcagccattgctcttgcattcatagttagcggatatcttggaatcgttcttgcatcgtttgtcggtgtaacagaggatgatttctcggggtttactcgcggactcgctatagaagcgtgctgcgttgggattccgttgatcttaacttcttggatatatgatgaagcggaaacaaaagagaagagtaaaaagatagagtga

SEQ ID NO: 55 - DNA, 2797 bp, Arabidopsis thaliana
ttaattaaatgagaaagggagttctaaatcctgacagagatcgtcagatagtggaacatgagttgcaggaaactgggtttagtccagaaacagagaaagtcaagaacaagaattttgaagaagatgaagaggaagaagatgaatctgtggagaagatatttgagagtagagaagtaccttcttggaagaagcagttgacggtgagggcttttgtggtgagctttatgctaagcatcttgtttagtttcattgttatgaagcttaacctcacaacgggaatcatcccttcgctcaatgtctctgctggtcttttgggtttcttctttgtcaagacatggactaagatgctccataggtctggtctcttgaaacagccatttactcgccaggagaatactgttattcagacctgtgttgttgcctcttctggcattgccttcagcggtaaagaaactcatcttcacattgaaccagataattgagttagaaattgattgtgtattgccatacttttgcttgtgcgtgtgtttgtgacattctgatataaaagtacaaatccttagtcttttgtactcaaaactcaactgctttctctctctttctagttagttatgttaaggtttttgcttaataataaatgcatctacttgggcatatgaaaatatacaggaggttttgggacatacctctttggcatgagtgaacgaattgcgacccaatcaggagatgtatcccgtggcgtcaaggacccttctttgggttggattatcggtttcctctttgtcgtcagctttcttggcctcttctcagttgtccccctgcgaaaggttggtcgcagtttttgtttcctgctttctctcttatgaaccaaaaaggaacaatgagtttatgagatcttgcattgccaatttctgtgtgtttgcagataatggtaatagacttcaaactaacatacccaagtggtactgcaacagctcatcttatcaacagctttcacacccctcaaggcgccaagctagccaagtactaacctttcacttcactttatgcgcttttatgtctttagttctctgcttccttttgactcgatgctgctctctgcatcaggaaacaagtgagggtgttggggaaatttttctctttaagcttcttctggagtttcttccaatggttctttaccggaggagaaaattgtgggttctccaacttcccaacatttggactcaaagcttaccagtacaagtaagccaataaacaatatatgtaacttgaaattatagagcattggcttgaaccacaatctggcttattgttttgtcagtaatcccaatgctcgttcctttctggtgagagcctgatgtagaaacaggttctactttgatttttcagcaacatatgttggtgttggaatgatatgtccgtatataatcaacatctctgtcctattgggaggaatcctctcttgggggataatgtggcccctcattgaaaccaaaaagggagattggttccctgataatgtcccatccagcagcatgcatggtctccaagcttacaaggtaactaaactctccatagcattcctttgttaattatctctatggatcttcctgcttcaagttaatctctctgtactggaccaacttttttccctctttcaggtgtttatagctgttgctataatcctaggagatggcttatacaacttttgcaaggtgctgagccggactctttcaggattatttgtacagctccgaggccctactacatctatttcaagaacctccttcacacttgaagaagaccctcatgcttccccactaagcccaaagcaatcttatgatgaccaacgtcgtacaagattcttcctcaaagaccaaatccctacttggtttgctgttggaggttatatcacaatagctgcaacatctacagcgatactccctcacatgttccaccagctgagatggtattacattctggtcatctatatctgcgcgcctgtcttagctttctgtaacgcttatggagctggactcacagactggtccttggcttcaacttatggaaagttagccatattcacaattggagcttgggctggctctgagcacggtggtatgctggctggtctagcagcatgtggtgtcatgatgaacatagtctcgacagcttcggatctaacacaagacttcaagacaggctacctcactttatcatctccaaagtcaatgtttgtgagccaagtgattggaacagcaatgggttgtgtggtatctccttgcgtgttctggctattctacaaagcgtttgatgatttaggcctcccaaacactgaataccctgctccatttgctactgtatatcgaagcatggctaaactaggagtggaaggtgtcgcatctctaccgagagaatgtcttgttctatgctacgcgttcttcggtgtggcgattctcgtaaacatagtaaaagatagtctccatagcaattggggaaggttcattccacttcccatggcaatggctataccgtttttcttgggaccttacttcgcaattgacatgtgtgtgggaagtttgatactttttatctgggaaagagtagatgcagccaaggctgaagcttttgggacagcggtggcttctggtttgatatgcggagatggcatttggtctttgccgagctccgtgctcgctatagccggagttaatcctcctgtttgcatgaagtttctctcttctgcaaccaattcaaaggtcgacaacttcctgaaaggatccatttaaggcgcgcc

SEQ ID NO: 56 - DNA, 1494 bp, Arabidopsis thaliana
atggatttgcagagaggctttgtgttcttgtctttggttctatcttttatgataatcgaaacgacggcgtatcgagagagacagctgctgctgctgcaaccaccgcaagaaacggcgatagataccgcaaacgcggtggtgacggttcaagatcgaggtttgaagacgcggcgaccggagcataagaacgcatacgcaacgatgatgtacatggggacgccaagagactacgagttctacgttgcgacacgtgttttgatcagatcgttgagaagtcttcacgtggaagctgatctcgtcgtcatcgcttctctcgacgttcctctccgatgggttcaaaccttggaagaggaagatggagctaaagtggtgagagttgaaaatgtggataatccatacaggagacagaccaacttcaacagtagattcaagcttactctaaacaagctctacgcttgggctttgtctgattacgaccgtgtggtcatgctagatgccgataacctctttcttaagaaagccgacgagttgttccagtgtgggcgcttctgtgcggtcttcattaacccttgtatcttccacactggtctcttcgtgttgcagccatcagtggaagtgttcaaggacatgctccatgagctacaagttggaagaaagaatcctgatggagctgatcaaggttttcttgtcagttacttctctgatcttcttgaccaacctctctttagtcctccgagtaacggatctgtacttaatggtcacttgagacttcccttaggctaccaaatggacgcttcttatttctatcttaagctaagatggaacataccctgtggaccaaacagtgtgattacattcccgggagctgtttggttaaagccatggtactggtggtcatggcctgttcttccactaggtttctcatggcacgagcagcgtcgcgccactatagggtactcagccgaaatgcctttggttataatccaagcaatgttttaccttggaatcatagtggttacacgactagctcgtcctaacataaccaagctatgttatcgccgctctgaccgcaacttaacaacgatccaagctggttttaagttgatcgcgcttctctctgtagttgcagcctacatcttcccattcttcaccatccctcacactatccacccactcatcggctggtcgctctacttgatggcttcttttgctctctcttccatttcaatcaacactctcctcctcccaacgctccctgttctcactccatggctaggaattctcggcactctccttgtcatggccttcccttggtaccctgatggagtggtcagagccttgtcagttttcgcatacgcattttgttgcgcaccctttgtgtgggtttcattccgcaaaatcacatcgcacctccaggttttgattgagaaagaggtgttgttcccgcgattgggagactcaggggtcacttcaggcttcagcaaattgtattag

SEQ ID NO: 57 - DNA, 1089 bp, Arabidopsis thaliana
atgcccctgacaaaattagttcccgatgcattcggcgttgtgacgatatgtctagtcgctctgctagttcttttgggtctcctttgcatcgcttactcgttctatttccagtctcacgttcgtaagcaaggctatattcaacttggttacttcagtggtccctggattatccgaatcactttcattctctttgctatctggtgggctgttggtgagatttttcgattgagtttgttgaggcgtcacagaaggttgttgagtgggttggatctgagatggcaagaaaacgtttgcaagtggtacatcgtttccaatctaggatttgcggagccttgtctctttctgactctcatgtttcttctgcgtgctcccttgaagatggaatcaggggctttgagcggaaaatggaacagggacacagcaggttatattattctttattgtctcccgatgcttgctcttcaacttgcggttgtgttgtccgagtcacgcctaaatggtggtagtggctcttatgtaaagctgccacacgacttcacaagaacgtattcccgagttattattgatcacgacgaggtggccttatgcacatatcctctactgagtaccatccttcttggtgtgtttgcagccgtcctaacagcttacttgttctggcttggaaggcagatactgaaacttgtcattaacaagcgtttacagaagagagtatacactttgatattctcggtctcgagtttccttccattaaggattgttatgctctgtttgtcggttctcacagcagcagacaagattatattcgaagccctttctttcttggccttcctctccctcttctgcttttgcgtggtatccatctgcttgcttgtctacttcccggtttcagattccatggccctgagaggtctaagagacacagatgatgaggatacggctgtgaccgaagaacgcagtggtgctctgttacttgcaccaaactcttcacaaactgatgagggattgagcttaagaggtcggagagactcgggatcgtctacacaggagaggtatgtggaactcagcctatttctggaagctgagaactaa

SEQ ID NO: 58 - DNA, 1029 bp, Arabidopsis thaliana
atggcagtccactactggacagccctgtttctattgttgccatgccttttctgtatttcaaatgctagtgctggcgatgctgatccagattacaggacatgtgtttcagaatgtgagataagcggttgtgttggacaactttgctttcctcagtgcaattcttcatccgatggtggtccatggtacatccaagaacctttgtatttacaatggaaaaaatggggttgtcaaggtgattgccgttatcaatgtatggttaatagagagactgaacgggaaactctcggtcaagccccagtcaagtaccatggtaaatggcccttcaagcgtgtacttgggattcaggagcctgcttctgttgctttctctgtactcaacctagcaatgcatttccatggttggctttcctttttcatcatgatctactataagttgcctctgaaacaagataggacagcgtactatgaatacgttggtttgtggcatatctacggtctcctgtccatgaactcttggttctggagtgctgttttccacagccgggatgttgaccttacagagaggttggactactcatccgcagtagcgattctcggattctcactcatcttagccattttacgaacatttgatattcgggttgaggctgcaagggtcatggtatccgctccaatactagcttttgtaaccacccacatactctacataaacttctacaaactcgactatggctggaacatgattgtgtgtgtggcaatgggagtctcacagcttttcctatgggcaagatgggccgctgtctcaagccacccttctaattggaaactttgggtggttgtgatagctggaggattagccatgcttctagagatatatgattttcctccatatgaaggctacttcgatgctcactcgatctggcacgctgccacaattcccttaaccattctctggtggagcttcattagagacgatgctgagttcagaacttccagcctcctcaagaaaactaagacgaaggcaaagtga

SEQ ID NO: 59 - DNA, 1038 bp, Arabidopsis thaliana
ttcttgtttgttgattaacccttaattaatccgggcgcgcctgatttatcacaagtttgtacaaaaaagcaggctcctgcaggaccatggctctacgcagagcaatcactaaacgtctcattgactgttacagatccgatgtaacacaacaacactcatttttcagacaactctcaccctataacatgaagatccatcgtcagtacatgacttcacctaatggtccgaatcttacggaccggattgtcgggatccgcatcgagtccgtttctccgccgaggcgggaggaaacaccggtgatgggtttatcagttagtgagactaagaagttgttgaggctatatcaaatggagaaagtgaaagagagactcagagagattcctaaaagctctgtttcttattgggaatttattcagatctgttgtgagagttgtgggaatgatgagcaaggttctcaaatggctaagtctttggatcattcgggatgtgtcgtcgttttaggagacatagtttttcttcatccccatcagatagccaagtctatggaggcaatgatcaagcaaacatcagtacttccaaacgatccaaggaaagaagagttagttcagcttgcgactacaaagaagagtattgacatagaggcacgacgtatagtgcaggccgagttatattgtggtctcggtttcctagctgtgcaaactataggctttatgcgtcttaccttttgggaactaagctgggacgtaatggaacccatctgcttctttgtcacaaccattcatttcatcctcggttacatcttttttcttcggacatcgacggaaccatcattcgaaggactttttcgacagcggtttaagaccaaacagaagaagcttatggagaggcatggatttgattttctgaggtacaatgagctcaactctttgttcacaacatttccgtgtaaatttcattatccggtttagctcgagacccagctttcttgtacaaagtggtgataaattggagctctgcagagctttcgttcgtatcatc

SEQ ID NO: 60 - DNA, 465 bp, Arabidopsis thaliana
atgaagaatgttatgctgattattgacgagagcaacgcaagttatgatttactcatttgggcacttgaaaaccaaaaagataccattgagagctccaaagtttatatctttgcaaaacagccacaaaattcctttactcctcctaccgtactttcttcatcagtcggctttgctcaaattttctatccattttcacctaattcagaactcataagattggctcaagaaaagaatatgaaaattgctttgggtatattagagaaagccaagaagatatgtttaaatcatgggatcaaggcagagacatttactgatgatggagaccctaaagatctaatccgcaagataattcaagaacgaaatatcaatttaatagttacgagcgatcaacaaagtctcaaaaagtgtacacaaaatacagattgttctcttcttgtcgtgaagaaaagacttcgcaaagattaa

SEQ ID NO: 61 - DNA, 2662 bp, Arabidopsis thaliana
atacttgttttatttcatcttctccgagccgttgctttgctctatctcttttccattttactactttctccgttcactgtaaaaccatctctctcaattctctccgacaacgttgctctaatgcttctccactgcaacgttagctactacacctcaacgttttccttcatctcctcatctctccgccgtcaagacaacgccgacgattcacaagatacagtaatccgtcgccgccacaatgctagatccatttctctatacatccgccataatcgagacctaaagctcaacaaaaaccctaacgaatctcaagaaacctttgttcctcctcctcctcctccgcggcgagatttagacggtgaaaaccgatccaagctacttgagctctctcttgtaactagaagaactccacaatttcctggttcaatctacgctcaatctgcttctgatgctgatattgcttcttctcttccttcgcttcgtaattttctcggctctgatggtgatgatgatggagagagtgagagggagatgatagttaaagcgcttgagattagaaggaaagtgacgaaagagattatcaaagagtctttggttaggaaaggtagatttgggattacgtatgcgactaatgtcactgatcgtttgggtgatttcgttgatcatgttatgattcaagctgcggcgttgaaacggttgccggaattttcagagtctagattcaatcttcgcgctaggacggttattgaagactccaatttcgttcctcttgtaaggtcaagctccatttttttgtgcttctgggtttgtgtatattagtgcacataagttgttcgataatatgtctcttagaaacaagttcaaagaagtagtagaatatttttaactatgtttctgaattgtgcaggtggttgaagcaccatgagttgtcatataatagaatagcgaagatcatatgcatgtcaaaaggaaatctcgactccataaggatcatgatcgagtggctgaagagcattcatgtgaagggtgaattcattgcagttgcgttcttgagatctggggataatatattgcaacgtaaccgtgaggaactaaacgaaattgttgagtatctagagagcaatggtgtgaggagggattggatgggttatgtggttggaagatgtcctgagttgctgtctttcagcatggaagaagtgaaaagccgtgttgatttcttcttgaaaatgggtatgaatcagaatgactttggcactatggtctatgattatccaaagataattggcttcttctcattccaagtgatggagaaaaaggtactgaaagctctttttaatactccagcgttaagattgtcgtttaagttcataattgtgttgcttgtattaaaccagatcaattacctgaaagagtttggccttagcacagaagaagttgggagactattagcctacaagccacacctaatgggatgcagtattgaagaaagatggaagcctctagtcaaatatttctactaccttggaatccccaaagaaggaatgaaaagaatccttgtcgtgaaaccaattctttactgcattgatttggagaagacgatcgccccaaaggtagttgaacttcgttataacgtatgaactccctataccatacacacagcagattccattaactcagcttctctcttgtgtttttaaaggtaagatttttgcaggagatgggtatccctaatgaagccattggaaacatgttagtaaagtttccttctttacttacaaatagcctctacaagaaaatccgacctgtggttagtaattacttcctctatgaaacaaagatgttccatcgaatgttgttatgttagtgttgttactcataacatatgatgatttcagaagctgcatctgatattgtacaagttgtggttgtacaggtgatttttctcttaaccagagccggagtaacccaaaaggatatcggtaaagttatagcaatggatccagctctccttggatgcagcatagggacgaagctagaacccaacatgagatactatatatcattgggaattcgattttatcaactaggcgaaatgattgctgatttcccgatgctgcttcggtataacgttgataatctgcgcccaaaataccgttacttgcgaagaacaatgatccgtccgcttcaagatctcatagagtttcccaggtaccagaaaaagaattgataaaaataatcccttcaaagtgtagcttttgagaaccatggcacttgtaacagattttttagctactcactagagcgtcggataatcccaaggcacaccattatggttgagaacagagttaacttcaagctcagatacatgttggcttgtacggatgaagagtttgagaggagagtgagagataaagtggagagaagagagagattcgaagctggcctcgactctgaggattctcaaccgtcggatgagaacatctccgatcaggagattgctttctcagacgaagcggaagaagaagaggatttgacagaatgaagaggatttagcataatgaatagttctgtacagtttaacacaattataaacgaacgaatgtgtgaatgagtctatatttataaatactaaaatgagaatacttgttctttcatgtcctaa

SEQ ID NO: 62 - DNA, 1341 bp, Arabidopsis thaliana
atggcgtcgatccctccgccggagcttgacaacgactcactggcgtcatcgccgagatcggagtacgatagtcagccacgcgtacggttcatgtgtacttttggaggaaggatcttgccacgtccgccggataatcagctctgttacgtcggcggcgataatcgcatggtcgctgttcatcgtcacactactttcgcctctctccttagtaaacttgctaaactctccggtaaaagcaacataagcgtgaagtaccagctaccaaacgaagatcttgacgcgttgatttccgtatcaacggacgaagatgtagagaacatgatggacgaatacgaccgcgtcgcacagaatcaaaacccacgcgcctctcgtcttcgtctttttctcttcaccaaaaacgtcgccggagaagaagataacgatagtcgagctagcagtatcagctctctcctcgatagctctgttaatcgggagcaatggttcctcgacgctcttaacctcggttcttccgccgccgcaaccgcggtatctaacggtgggtccggtagagtctttgagcgagttagatctgaagtctcgtcgattgtttctgaagttcctgattatctctttggattggataatttcgatgaaactgctccgccgcatgagcttcgtgatcgtgatccgagagctaagatccaacgagaagtctcgacgctttcggatcctggttcgcctcgtcgcgatgttccttcgccgtatggttcgacgtcttcggctcctgtgatgcgaatatctacaccggaacttccaccaccagtttttattaaaccggaaagtccagaaccggtttcgactccgaaatccaatcctcaaccggaacaagtaatgcaacagagtaatctcccggttaactcgcaatggcaatatgcccctggcccaggccaacaggttcattaccagggtcataccattcaccaatcaccggtttattacgttcctggttcggttccgggtaatcatatggtccagcaaggaaatcatatggttcaaccgggtaatcatatggtacaaccggttcaaatgccgggtcagtatcttcaacaataccatcatgtaccaatgggataccaccaacctcagactcatcagatggctggtccgggtcaagtatatggtggaacggttaggccggttatgatggcagttgatggaatgaaccggacgggttattatggaatgaaaacacccggtccggttcaaatgtatcagcatcacactggtatggttgttcctggtgtagaagaacaacaacaatacagaaccgaaacggattcggatacgggtcgggcttcttag

SEQ ID NO: 63 - DNA, 1558 bp, Arabidopsis thaliana
ttaattaaatggagaaattctcgtacaactcttatccagattcaaccgactcgtcaccgagatctcgtgagatcgaattcgataacccgccgcctccatgggatgatcagaaccagaaccagcagcaacatagctacaaggtgaagtttatgtgcagctatggcggcaagattcagccacggcctcacgataatcagctcacttacgtaaacggagaaacgaagattctttccgttgatcgcgggattagattccctgttttagcttccaaactctccaccgtatgcggcggcggtgatggcggcggaggagaagttacgtttaagtatcagcttccgggagaagacttagacgctttgatctcggttacgaacgatgatgatctggagcatatgatgcacgagtacgatcgcttgcttcgtttgtcgtctaagccagcgaggatgcgtttgtttctcttcccggcttcttctggatttggttctcaaagttcgactcaatcggatcgagatcgcttcgtcgaggcgttgaacactgttcctaggctatctgaatcggagaaatccgtaactgctcctccgaataatgcggattttttgtttggatcggagaaagttgcagctccgccgccgccaccaccggctgaggtgaaattaccggttcctgtggcgttagaaccgcctttgtttaacgatccgcgtgtgattcaaccggatcacgtcgtaaatccgatggaaattcaaagacaaatgcaggaatttcagaggatgcatattagggatcaagaacaacaacaacaacaggaagctgtatacagaaggaagagtaacgaagacggtttaatagaaaccggaggtggatacttctctccaccgtacatacaaaatcctgcgccaccaccgccacagcagacgattcctcaaacgaatccgcaagctcctccgatgacgactttctggcaaggaaaccacaatccaggagtcgtatttccaacaaccacacatggattaggattaccagagcaaccagtttacatgatcccatctccatctccatctccggtgtaccacgcgccaccaccaccgcaaccgcaaggtgtcatcagaccaatacttacaggacaagtaaaccaaggcggctactatcctcaggtacagagagtggcttcagatacttacagagaaccacaccaatcaccgtacaacgtggctcagccacttcaggcacctataggaacaaaagcagcacaacaacaacaacctcctcctcctcagccttttacctctggtcctccaccaccgcaatacaccgcagtaccaccgccacgacaagtagtaggattaccagatacatcagcgtatactcaggtgacttacactggaggaatggggaaacaagtttattacacggaggctccaccgccgcagtaccatggagttggcttacctgtaactggtatgagtgaattgagaactggaccggacgggaagcttgttgctatgaacatggcacctaaagtttcatctcagagttcagattcggctgtttgaggcgcgcc

SEQ ID NO: 64 - DNA, 2478 bp, Arabidopsis thaliana
ttcatttatttgtcagctttcaaactctttgtttcttgtttgttgattaacccttaattaagatggcctttcacgtagcttgtccaattacatgtcgtcggatttgtcattgctccttagggttttctcgggatctccgtggagccaatgcgaaacataagtttttgaaagaggttattcgagtggaggagtttctcaaggatcctgctgtttcttctaatgtttttattggaggtaccgttcaagttagggttcctaaggttgttcctgctcctcagacggtttcgattttgggggttggagatggtgctattggttctggtgttgatgaattggcggaggaagcttctgctcagaagaaacgtgttgctcttcagagacaagctgctgttactgtcgaagctgctgaggattatgctcggaggtttgaatctggtgtcaatgaccttacctcaaacgatcatgctggtgaagaattaggccactccggcatgaatataatgtgcagaatgtgcttcctaggagaaggtgaaggaagtgatagagcaaggaggatgctttcttgtaaagactgtggaaagaagtaccacaagaattgtttaaagtcttgggctcaacatagagatttatttcattggagttcatggagttgtccctcttgccgggtttgtgaggtctgccgtagaacaggagatcctaacaagttcatgttctgcaaaaggtgtgatgctgcttaccattgttattgccaacatcctccacacaagaatgttagttctgggccatatctctgcccaaagcatacaagatgccacagctgtgattctactgtccctggaaatggcctgagtgtcaggtggtttttatcatatacttgctgtgatgcttgtggcagattgtttgttaagggaaattattgccctgtatgcttgaaggtgtatagggattcggaatcaaccccaatggtatgctgcgatatttgtcaacgctgggtgcattgccattgtgatggaataagtgatgacaaatatatgcagtttcaagttgatggaaagctacaatataaatgtgccacatgccgtggggagtgttatcaggtgaaggatcttcaggatgcagttcaagaactttggaagaaaaaagatgtggtggacaaagagttgattgctagtttaagggctgctgctggtttgccaacagaggaggaaatattttcgatatttccattttcagatgatgaagaaaatggacccgtatctgggcgctcactgaagttttcgattaaaggtttggtggaaaaatccccaaagaaaagcaaggagtatgggaaacactcttcaagtaaaaagcatgctagtaaaaaaggtagtcacactaagttggagcctgaagttcatcaggagattggatctgagagacgccgactaggtggtgttagaattgataatgtgggttttcagataaacgaacaatcggacgttaattcttctgtagctggaatttgctcaacacatgaacctaagattgtaaaacacaagagggttgatgatgttatggtgactgatgaagaaaagccgtcaaggatagtgagaataaagtgtagcaagcctcatgattctgatagcgaggataccctaaggaatgcaggggaggaaaaatctgtaaaggcaaagaagttggttattaatctgggtgctaggaaaataaatgtcagtggttcttcgaagtccaatgttgtttctcatttatcgagagacaaagatcagtccactttgggtggggataaagttgatcagactggggaagtaagaaccctgaagatctctggaaggtttgggaaaactcaatctgaaggaagtaaagctacatttgggtcagtcactcagttccctgctgcatcaacaagtgaaggaaatcatgtggatgacaaaacatccatctcaccagcattacagaaagaagcaagacctctgctgaaatttaaactcaggaaacctaattcaggagatcagacatcttcggttacaacgcagtctgaagatgaaaaattgagttctgcaaagggccaaagatcaaagagaaagagaccttcaagcttagtggacatggcttcattgaaagaagacggtgaagctacaacacattctcatcaggataattcaaggaacgacgagatgatggatgctaactggattttgaaaaagttgggtaaagattcaataggaaagagagtcgaagtccatggatctcaaaactcatggcgtaagggaacagtgacagacgtttctggagacacatccacattgtcggtttctctagatgatggaagcatcaagacatttgaacttgggaagcacagtgtccgcttcataccgcaaaagcaaaagaggtcaaggagctgaatttaaatacccagaaatacccagcaaattggagctctgcagagctttcgttcgtatcatcggtttcgacaacgtt

SEQ ID NO: 65 - DNA, 381 bp, Arabidopsis thaliana
atgagtaacacaccagcagcggcggcgtcatcatcgtctaaatcgaaagctgcgggaacttctcagccacaggaaaagcgcaaaactctctttcaaaaagaattgcagcatatgatgtatggatttggcgacgagcaaaaccctcttccagagtctgtggcgcttgtagaagacattgttgtggaatacgtcacagatttgacacataaagctcaagaaattggttcaaagcgaggaagacttctagttgatgatttcttgtatcttatccgcaaggatttgccaaaactgaaccgctgtagagaactgttggcgatgcaggaagagctgaaacaagcacgcaaagcttttgatgtcgacgaaaaggaactcgttgattga

SEQ ID NO: 66 - DNA, 837 bp, Arabidopsis thaliana
atgagcggtgaagtttggagatggaacaagcaagcagagatgaattcgataagagattgtttgaaacattgtaattccatcgctatcgacacagagtttcccggatgcttaaaggagactcccatggacgcaagtgatgaaattcgttatagagacatgaaattcaatgtggacaacacccatctcatccagttagggttaacgctattcggcaaaggaatcactaaaacctgggagatcaacttgtcagatttcaacgaatctaagagcttgaaaaatgataaatctatagcgtttttaaaaaacaatggtttggatctggataagatcagagaagaaggtattggaatcgaagagttcttcatggagttttctcagattctcaatgagaaacatggaaaaatgagatgggtgacttttcaaggctcttacgacaaagcttatctacttaaaggtttaactagaaaaccattacccgagacttcgaaagagtttgatgaaaccgtccagcagcttttgggaaggtttgtttatgatgtgaagaaaatggctggattatgcagcggactaagtagccgtttcggactacagagaatagcggatgtgttgcagatgaggcgtgttggaaaagctcatcacgctggatcagacagcgaattgacggctcgtgtcttcactaagttgattttcgatttggtcaatagtagaaaggagagtactggaagaagagctgatgatcagcaatatcaactagagcagcagcagcatcagcaacagcttatgatgactagatgttacatcccgataccggtccaaggaaggaactacgtattgtga

SEQ ID NO: 67 - DNA, 3479 bp, Arabidopsis thaliana
aatctcaaggtttagtctctgcaattctgattttgaacacagctagctagtagcagatttaagagttcgtcaaattaggattttgggtttgtttgggtccctttctcaccgaagttctgtatggcggctgggaggaatataagatatccagaccatgaactgagagaccaggaatcgaattctagattttccaggcgggatagtgcttatgcgaacgaggattataatcatgttaggaacggtgctattgataatggaaagggacgggttagtaatctaagacacggggatagagatagaattaagtctggagctagacaggaagagaacaaaatggttagtagtgggtttcggttatcgaagagcaatccaggtagtagagaagtatttatcgatcttggtcctaaaagatgcgggttttcagctaggtctgtggacagggaaccaggcgagctctctagtgagagtgggtcggatgatttgattgagtcggaatcactggcgaaagttaatggagttgtgaaggaggtagagaatagagctcaaagtcctgtggaaaagaagagaaagttttcaccaatagtatgggatagggatgaccatgagagaagtaatttgagcagaaatgaaaaacctgtggaggtcactcctcttcctcccccaccaccactagttaagaggtcaagccagtcacctagtgtcagttgtggtggtaattctcattattcacctgcaaagagtgacatgcatcaagatcctgtggaagttggtgtttctgcggtttctatgcctgctttgtcaccttcggtagagatgtcctctttgtgtgtggtagaacagtcatcaaatgctgagcaggatgacaaacaagagcatgcaacacacctggaagaggatgaaaacatgccaacacggcatatatcatcctctaggtgggctgctggtaatagttctccaactgatgaagttgaaatagtagaagaagttggggaaaagaaaaggaggaagaaaccatttcccgtgcaggggagatttcgcaatacctctcaaacacctgaggtcggggagttagtgagggaaggttatagatcatctgattccgatgaaagggggcaccattctttaccgggaagcagagatgattttgaggagagagatgctgttaagagtgacaagatggaaatagatgaggaggaacacagaagagaaaactctgttgacagccttagtgaaacagattcagatgacgaatatgtacggcatgagacacctgaacctgccagtactccactgagaagtataaacatgctccagggttgtagaagtgttgatgaatttgagaggttaaataagatcgatgaaggtacttatggtgttgtttatagagcaaaggataagaagacaggcgaaattgtggcattgaagaaggtgaagatggaaaaagaaagagaaggttttccattgacttctcttagggaaattaacatcctcctttcttttcatcatccatcaatagtggatgttaaagaggtggtcgtgggtagcagccttgatagcatattcatggtgatggaatacatggaacatgatcttaaagcattgatggagacaatgaagcagcgttttagtcaaagtgaagttaagtgcttaatgcttcaacttttagagggcgtcaagtatcttcacgacaactgggtgcttcatcgagatttgaaaacatctaacctgcttttaaacaatcggggtgagttgaagatatgtgactttggtttggctcggcaatatggcagcccgctcaagccttatactcatctggttgttacgctttggtacaggtaaagtgcgtttttaccctattcttgtttataaaaaaattaagtggtgtttacatttacgattgttatttgaattctggtggactttcttgtttttttttggccattgttagtataacattaggtgccacgtctcctttctggtatagctgtactacaccgtactcccttttctatttctgcacattaggatcaatgattttaaagtcctgtttttaaatggtgttccaaggtatctgatatttgttccaatggcaccacaaacttgagttttgtgactgccttggatccttatctttcctctttgagaatagtcttcataatatgccagcttagccattaaatacttaacacttttgcggtatttgcttggacaccacgtaccatgaaccaacgtaatctgggcacattaggaaatatacgtgcttcaacttccttgacttgttttgttccttgtgttgactctcccttcttgttttagcaataatcacttcctccgggaccaagcccaacgactgcatttgtttttccagggcacctgaacttctcttgggagcaaaacaatattctacagccattgacatgtggtcactgggctgtatcatggcagaactattaatgaaggcgccattgttcaatgggaaaacggagtttgatcaacttgacaaggtattttaaacatcggttttgatttggatctccagccatcctgggaccacatacagcttataaattactccttctttaatttacagattttcagaatccttggtactcccaatgaatctatttggcctgggttctctaaactacctggagtcaaggtcaactttgtcaagcatcagtaagtatttatagttccttttattttcagtttatatggaaggataaccttagtatatgcttaaagtctctaatattgttcccaggctttctagctttagatgatgtggtgtggctctctgactcattagtggatttatattgttttcatagttgttatgtcactcttctcaccgcttacctgtacttttaggtataacctattacgtaagaaattcccagccacttcgttcactggtgcaccagttctgtccgatgctgggtttgacttactgaacaagctcctaacgtacgatcctgaaagggtaatagaaaatatatatctgttgcatgcatgttaatccagtatgcaccttaattgttccttgacttttggatctctgtggcttcttctgcagagaataactgttaatgaagctctaaagcatgattggttccgcgaagtccctctgccaaaatccaaagatttcatgcctacttttcctgctcaacatgcccaagacaggtactgaggtctatctaaactgaaacgatcagtggttgactttaattctgtctcttactttttcttctatgcctaggcgtgggaggagaatggtaaagagccctgatcctttggaagagcaacgtaggaaggaattaacgcaaaccgaacttgggtctggcggtctgtttggctgaagtacagcacaccggtcgaagatagcagttggaatacaaccttgatattctcaaataccttggaattaccacattttaggcgagggctgctgcttaagcggaggttggaatatttgtatc

SEQ ID NO: 68 - DNA, 1415 bp, Arabidopsis thaliana
ttaattaaccggcgaagttttcttattcatcaatcaatctctggattcatcaatcatgccagagatcgagattgccgccggcagcggcgacaacaacgacgccttattcggtaaatatgagctcggaaagcttctcggatgcggcgcattcgccaaagtcttccacgcacgtgatcgtcgtaccggccaaagcgtcgccgtgaaaatcctcaacaagaaaaaactcctcacaaatccagctctagccaacaacatcaaacgcgagatctcaatcatgagaagattatctcatccaaacatcgtcaagctccacgaagtaatggcgacaaaatcaaagatcttcttcgcaatggagtttgttaaaggaggagaactattcaacaaaatctcaaaacatggacgtcttagcgaagatttaagccggagatatttccagcaactgatctccgccgttggttattgccacgctcgcggtgtttaccaccgcgatctcaaaccagagaatctattaatagacgaaaacggaaacttaaaagtttccgatttcggtctaagcgcgttaacggatcagatccgacccgatgggttgttacataccttgtgtggtactccggcgtacgttgcgccggagattctatctaaaaaaggatatgaaggtgctaaagttgatgtatggtcttgtggaatcgtcttgttcgttctcgtcgccggttatttaccgtttaacgatccgaatgtgatgaatatgtataagaagatttataaaggagagtatcgttttcctcgttggatgtctccagatctgaaacgattcgtttctcgtcttttagatattaatcctgagactagaatcaccattgatgagattttgaaagatccttggtttgttagaggaggttttaaacagatcaagttccacgatgacgagatcgaagatcagaaagtggaatcgtcactagaagctgtgaagagtttaaacgcgtttgatttgatttcttactcgtcgggattggatttgtcgggattgtttgctggttgtagtaattcgagtggtgaatcggagaggtttttatcggaaaagtcgccggagatgttggcggaggaagtggaggggtttgcgagagaggagaatctgaggatgaagaagaagaagaaggaagagtatgggtttgagatggaggggcaaaatgggaaatttggtatcgggatttgtatttcgcggttgaatgatttgcttgtggtggtggaggcacggcggagaggtggtgatggtgattgttataaggagatgtggaatggtaaactcagggttcaacttattcgcgtttgcgatcagacgtcgtcaacaaacgcggctatttaaaagaacgctatgaagttttctaccgtgctttcaattttaaaacgggcgcgcc

SEQ ID NO: 69 - DNA, 1542 bp, Arabidopsis thaliana
atggcggctgcggcttttgggcagttaaatctagaggagcctccaccgatttggggatctcgtagtgtcgattgcttcgagaagcttgaacagattggtgaaggaacttacggccaagtgtacatggctaaagaaattaaaactggtgaaatcgtggctctgaaaaagatccgtatggacaatgaaagagaagggtttccgataaccgctatccgggagatcaaaattctgaagaagctgcatcatgaaaatgtcatccatttgaaagagattgttacttctccaggtcgagatagggatgatcaaggaaagccagataataacaaatacaagggtggaatctacatggtctttgagtacatggatcatgacttgactggacttgctgatcgtcctggactgagatttacggttcctcagataaagtgttacatgaagcaactgctgactgggcttcactattgtcatgtgaatcaagtgcttcaccgtgatataaaaggttcgaatctacttattgacaatgagggaaatttaaagctagcggattttgggcttgctcggtcatattctcatgatcatactggaaacctcacaaatcgtgtcatcactttgtggtataggccccctgaattgttacttggtgcaactaaatatggaccagcgattgacatgtggtcagttggatgcatatttgctgaacttttgaatggaaaaccaatcttgcctgggaaaactgagaatgaacaattgaataagatttatgagctttgtggatcacctgatgaaagcaactggcctggagtttccaagatgccttggtataaccaaatgaaatcatctcggcccttaaagagacgcgtaagggagatctacagacactttgatcgccatgcccttgaactacttgagaaaatgttggtacttgacccatctcagagaatatgcgcaaaggatgctcttgatgctgagtacttttggactgatccgctgccatgtgatccaaagagtctaccgacatatgaatcatcacatgagttccagacaaagaaaaaacggcaacagatgcgtcataatgaggaagcagccaaaaaacagaaactgcagcatccacagcagcaacattctcgtttacctccacagcaacacggtgttggccagtctcatgccgctccactttggcctgctggaccaaaccaccctatgaacaacaacgcaccaccaccccaaatacctgctggtggccattactatggaggaaagccccgtggtggtgcacctgttccaaaccggtaccctcctagcggaaaccagactggtggttataataatcagagccgtggaggttacagcagcggagcatatcctccacaaggtcgtggtgcaccatatggcgccggtcctagaggacctagcggtggctatggtgttggaccacccaactactcacaaggtggtggtcagtatggtggatctggtggctctggaagaggtcagaaccctatgggtggtgctagaaaccaacaatatggatggcaaccgtaa

SEQ ID NO: 70 - DNA, 1428 bp, Arabidopsis thaliana
atgaagctacgattgagacatcacgagacgagagaaaccctaaaacttgaattggccgatgcagacactctccatgatctccggcgacggatcaaccccacggtgccttcctccgttcatctctcgctcaatcgtaaagacgagctcatcacgccttcgccggaggatacgctccgatctcttggtttaatatccggtgacctaatttacttctctctcgaggctggcgaatcttcgaattggaaattgagagattctgaaaccgtagcttctcaatcggagagtaatcagacgagtgttcatgattcgattgggttcgcagaggttgatgttgtccccgatcaagcgaaatctaatcctaatacctccgtagaagatccagagggagatatttcgggtatggagggtccagagccgatggatgttgagcagcttgacatggagctcgctgcagctggaagcaaaaggctaagtgaaccattcttcttgaaaaatatactgcttgagaaatctggtgatactagtgagttgactactttggctttgtcagtacatgctgttatgttagaatctggattcgtgctgttgaatcatggctctgacaagtttaacttttcaaaggagttacttacagtatccctgaggtatactctacctgagctgattaagtctaaggatacaaatacaatcgagtcagtttctgtgaagtttcagaatttaggccctgtggttgtagtttacggaactgtaggtggatctagtgggcgagtgcatatgaatcttgataagcgtaggtttgttcctgttatcgacttggttatggatacttctacatctgacgaagaaggctcttcgagtatctaccgtgaagtgttcatgttctggagaatggtaaaagatcgccttgttatcccgttgttgattggtatttgcgataaagctggcttggaacctccaccgtgtttgatgcgcttaccaacagagctaaagctgaagatactagagttgcttcctggtgtgagtattggaaatatggcttgtgtttgtacagaaatgcggtatctggcatcagacaatgacttgtggaagcagaagtgcttggaggaagttaataattttgttgtgacagaagcgggtgattcagttaattggaaggcgaggtttgctactttttggaggcaaaaacagcttgctgctgctagtgatactttttggaggcaaaaccagcttggaaggcggaacatttccacgggaagaagcggcatacgattccctcgaatcattggagaccctcctttcacatggtttaatggggatcgcatgcatggatccattggtattcacccgggacaatcagcacgtgggctcggcagacgaacatggggacagctctttactcccagatgcaatcttgggggactcaactag

SEQ ID NO: 71 - DNA, 1125 bp, Arabidopsis thaliana
atggaatcgtctccggtaaactgtcttccacctgattctctccaccagatcttctcatctcttcctattcgtgatatcatgatctgcagatccgtctgcaagttcttcaaccagcttttgacctctcagtgtttcatagagattatctcaactcgtccgccgttgaatctactcgctctccgacctcctcatcaccaccacagtcaccgtcacagcggaaacggacacgcaacgaatatccgaccgtacatccatgtatatgatccagagcagaatcaatggttcagattcaatctcgatttcctccctttccgatctcctcagcctgtagcttcttcaagcggattgatctatctttggggagattcgattgatttagctgaatctagcaaatcgctcgtcgcttgtaatccgttaactcggcagttcaaggttttgcctcagcttggctcagcttggtcacgccatggtactgttcttgttgattcggtgaatcgagtcatggtgctcactgagctcgctgcgttgtattactcaggtactgtagttgctaaccaatggctcaaattctcgtcgaatttaccatcgaaacctagaagtcctgtgttaatgtctagctcggttttcgcattgtgtgatgttggatctccatggagaagtcaatggaagcttttctcatgtaaattgacgaatctcacaatcactcataccaattgggtttgcttggagaaacatgaatggggtgatatattcgatatcatcaaacgaccgcgtttattgcgcggtaacggtgattctaagcttcttatgatcggtggattgaaatcgacgttttcgttgaacccggcttgttcaacgattctgatacttaggcttgatctagaaagcttggagtgggaagaagcaggtagaatgccgttagagatgtaccgaggttttcaagaatcgagtaagtttaaagtttttggaggtggagatagggtttacttctctgctaaaaggatggggaagcttgcaatgtgggattgttggcaaggttggagatggattgagggcgtccctggttatgcagatggattgtgtcgaggttttgtgtttgatgctaagcttacattgatgccatga

SEQ ID NO: 72 - DNA, 1428 bp, Arabidopsis thaliana
atgggttctgttatgagtttgagctgttccaagaggaaagcaacgagtcaggacgttgagtgttcaagcgaatctcgtaaaagacgaaagatatcttcagagaacgatgaagaagagtgttgtagattgattccaagtcttcctgatgagttatctatacagattcttgctaggcttcctagaatttgttactcgagtgttcggttggtttctcggaggtggagatcggctgtttcgacttctgaggtgtatagtttgaggaaagaacttgggaggactgaggagtggctctatgtgttgactaaaggtcatgaggataagcttttgtggtatgctttagatcctgtgtctactaaatggcagagattgcctccaatgccggttgttgtttatgaagaagagtctagaaagagtttatctggtttgtggaatatgattacaccgagctttaatgttggtgcgattgtgaggagctttctaggtaggagggactcctctgagcaaatgccgttttgtgggtgcgctattggtgctgttgatgggggtctttatgttattggtggactttctaggtctaaaacagtgagctgtgtttggcggtttgatccgattttgaactcttggagtgaagttagttctatgttggcgagtcgggcttattccaaaacaggtgtattgaataagaaactatatgttgttggaggggttgatcggggacggggaggtttatctcctcttcagtcagctgaggtttatgatccaagcacggatgcttggtcagaggttccgagcatgcctttctcaaaggcgcaagtgttgccaaatgcgtttttggctgacttactaaagcctattgccacaggaatgacttgctacaacggtaggttatgtgttcctcagagtttatactcttggcctttctttgttgatgttggaggagaggtttatgatcccgagacaaatctctgggttgaaatgccgtctggtatgggtgaaggttggcctgcgaggcaagcaggtacaaaactgagtgttgtggtggatggtgagttatacgcttttgatccttcttcttcgatggagaacggaaagattaaagtgtatgatcaaaaggaagatacttggaaggttgttattggggaagtccctgtgtatgacttaacagattcagaatctccttatttgcttgctgggtttcatggcaagcttcatttcattactagagaccctaatcataacgttacagtcttacgagctgatgtccccaacatcccagtctcctcatcatcatctagctccagttctgtttcaatcccacacttaaagaccaatgcacctaacaagtcagacactgttacatggaaactcattgcaaccaaggactttggtgctgctgaacttgttagctgccaagttatagatatataa

SEQ ID NO: 73 - DNA, 1947 bp, Arabidopsis thaliana
atggaggacgaattggaaggtctacgagctcattttcctgtttcgttcggtaagacatcgaaggtttcggcgtcaactgaagccattcacagcgcaactcgccgcaccgatgtagccaacgacgccggagtttcgtcggatatcaccacgaagaaacctgattccgataaatctggattcccgtctctatcttcctcatctcaaacctggctccgaagtgttcgcggtccgaatcgtaaccctaacagctccggtgatgtagcaatgggtccgccaccgccaccgtcatctaaacggacgcaagaggaagaggaggaggatgaagaagttatgatgggaccaccgccaccgcctaagggactcgggaacattaatgattctgatgatgagggggatatgatcggtcctccgccgccgcctcctgctgctcgagattcagatgaagattcagatgacgatgatgataatgacaacgaggagaatcgttaccagattccattgagcaacgagattcagcttaagggacatacaaagattgtttcatctctcgctgttgatagtgctggagctagagttctttcaggaagctatgactacactgtgagaatgtacgatttccaagggatgaattcgagactacagtcttttagacagatagagccatctgagggacaccaagttcgcagcgtgagctggagtcccacttctggtcaatttctatgcgttactggctctgcacaagctaagatttttgatcgagatggtcttactcttggtgagtttatgaaaggagatatgtatattcgtgatctgaagaacactaagggacatatttgtgggttgacctgtggagaatggcatccgaggactaaggaaaccgttctgacttcgtcggaagacgggtctttgcgtatatgggatgttaataacttcctaagccaaacgcaggttattaagcctaagcttgctagaccagggagggttccagttacaacctgtgcttgggaccgtgacggaaagcgtatcgccggtggtgtaggagatggatctatacagatttggagtctcaagccgggatggggaagccgaccagatatatacgttgggaaggcccacactgatgatataacctctgtaaagttctctagcgatggcagaattctgttgtcaaggagttttgatggttctctgaaggtctgggacttgcggcagatgaaagaagctctaaaagttttcgagggtctacctaattattatcctcaaaccaacgttgcctttagtccagacgaacaaatcatcctgactggaacatccgtcgagaaagacagcacaacaggaggcttgctatgtttctacgatcgcaccaaactagagatagttcaaaaagtcggaatctctccaacttccagcgtggtgcaatgcgcttggcacccgaggttgaatcagatatttgcaacatccggagacaaaagccaaggagggactcacattctttacgacccaagtcagagcgagagaggcgcatgcgtctgtgttgcacgtgcaccaaggaagaaatctgtagatgattaccaaccagaaccagtaatacacaatcctcatgcattaccattgttcagagacgcaccaagccgtaaacgagaaagagagaaagcattgaaggatccaatgaaatcccacaagcctgagatacccatgacaggtcctggtcatggtggaagagttgggactactggtagtggcttattaacacaatatcttctcaagcaaggtgggatgataaaagagacgtggatggaagaagatccaagagaagcaatattgaaatacgcagaggttgctgttaaagatccaaagtttattgcacctgcttactctcagacccagcctaagaccatcttcgctaaatctgatgacgaagaagaagaaggtgacactaaaaaataa

SEQ ID NO: 74 - DNA, 1620 bp, Arabidopsis thaliana
atggaatttgagtgccaagagagacttgaagctgcgaacgatcaaagaagtgagtctggtcttttgaataccgatttgagaataggtaatgatgggtctgttgagattccaaatgtgaagttgtgttgtcagaaaaagaagggaactttagtgcccagtggctcgaaacagttactctctgacaaggatttgtctactaccattattgatttacctcaggcattgatatctgagattcttaattgccttgacccaaaagagttgggtctagtgtcttgtgtttcaacttatctgcataggttagcatctgagcatcacgcttggaaggagttctatcgtgagagatggggactccctgtagttttcggagctgcaagttcagggctttctgatgagagatcatggaaagatctgtttgttgaaagggaatttaggagtaggacctttttaggacgttatagtattgatactctgtatggtcacactgaagcagtccggactgtttttctcttagcttctgccaagctcgttttcacttctggatatgattccattgttcggatgtgggacatggaagaaggcttgtctattgcggcatctaaacctctcggttgtacgattagggcacttgctgctgatacaaagctgttggtagctggcggtactgatggattcattcattgctggaaatcactggatggtctccggaacctgtttgatctcacaggttttcagaaagagaagactgagtttcggctatggggacatgagggtcctattacatctcttgccctggacatgacaagtatctttagcggttcatgggatatgtctgttcgtatatgggatcgatcttcaatgaagtgtgtcaaaaccttgaggcatagtgattgggtttggggacttgcacctcatgaaaccaccctcgctagcacgtcaggttctgatgtatatatttgggacgttagcagtgagactccattggcgatcatccctgatgctcatgagggtaccacttactctttggcaagaagccatactggggatttcctgtttactggtggagaagatggagggattaaaatgtttgagatcagaagatacggtagtgaaacaagcgttgtacttatatctcaatggatgcctcacactagtcctgtctactctctttcttttgagtttccttggcttgtctcagcatccggtgacggtaaactcgcacttatcgacgttaggaaactgttaaaaactaaccgttgtgcctattccaaaaggatttcttcgagtactgtggaaccgccacaacgaatgctgcacgggttcgggtcaaacttgttctctgtggacgtgggttatgaccgtatagtgtgtggaggtgaagaaggcacagtccggatatggaacttcacacaagcattggagatagagcgaaggacccgagctctgaaaggaatgaggcatgagaataggatgagacgaaggagaatgcaaatggagatgaacgcaaagaatggaaggcctgaccaatgctccattgctgctcataagaaccccatcaatggagaaaggaaccgagcctggcatagtaaacgaagagcaagcgggaaggcgaaggcctaa

SEQ ID NO: 75 - DNA, 2409 bp, Arabidopsis thaliana
ttaattaagggcatcatggtacattcagagtcatcaatacttagttccttgcgcggtggtgatggcggtggtattccttgttctaaggatgaactagcaataaatggtagttacaccgatcctatggggcggaggaagtccaagcggtttaaggttgctgcggaaagtgagttttcacctgattttggatcgattaccaggcagctcagatcgagaagaatgcagaaggagttcacagttgagacttacgagaccaggaatgtttctgatgtttgtgttctctcttctcaagctgatgttgagttgattcctggagaaattgttgcagaaagagatagctttaagtcggttgattgtaatgacatgtcggttgggttaaccgaaggagctgaatctcttggagttaacatgcaagaacctatgaaagataggaatatgccagagaacacaagtgagcaaaatatggtggaggtccatcctccaagcataagcctgccagaggaagatatgatggggtctgtttgcaggaaaagcatcactggaacaaaggagcttcacggaagaacgatctctgttgggagagacttatctccaaatatggggagcaagttttcaaagaatggaaagaccgctaaacgttctatatcggtggaagaggaaaacttggttctggagaagtcagattctggagaccatttgggtccatcaccagaggttttggaacttgagaaatcagaggtttggataattacagacaaaggggttgtaatgccttcaccagtgaagccttccgagaagaggaatggagattatggtgaaggatctatgaggaagaatagtgagagggttgccctggataaaaagagattagctagtaaatttcggttatcaaatggtgggcttcctagttgctcaagcagtggggatagtgctcggtataaagttaaggaaacaatgcgtcttttccatgaaacttgtaaaaaaattatgcaagaggaagaagcaaggcctaggaaaagagatggtggcaatttcaaagtggtttgcgaggcttcgaaaattctcaagagtaaagggaaaaatctttatagtggtactcagattattggaactgtgcctggtgttgaggttggcgatgaatttcaatatagaatggagctgaaccttcttggtatacatagaccaagtcaaagtggtatcgactatatgaaagatgacggtggggaactagttgccacgagtattgtatcctcgggaggttataatgacgtgcttgataactctgatgtcttgatctacacgggtcaaggcggaaatgtggggaaaaagaaaaataatgaaccacccaaagaccagcagcttgtaacgggaaaccttgcgttgaaaaacagtataaacaaaaagaaccctgtgcgggtcataagaggcatcaaaaatacgacattacaatcatcagttgttgcaaagaattatgtttacgatggattgtatctggtggaagagtactgggaagaaaccgggtctcacggtaaactcgtcttcaagttcaaactacggcgtattcctggacaacccgagcttccctggaaagaggttgcgaaatcgaaaaaatctgagttccgggatggtctttgcaatgttgatatcacagaagggaaagagacattacccatatgcgctgtgaacaatttagacgatgagaaaccgccaccgtttatctacacggctaaaatgatatatccggattggtgccggccaattcctccaaagagctgcggttgcacaaacggctgctccaagtcaaaaaactgtgcctgcattgtgaaaaacggtggaaagataccttattacgatggagccattgttgaaattaagcccctggtctatgagtgtggcccacactgcaaatgcccaccttcttgcaacatgagagtctcacagcacgggatcaagatcaagctggagatcttcaaaacggagtcaagaggttggggagtgagatcgctggaatctattcctatcgggagcttcatctgtgagtacgcaggagagcttctagaggataaacaagctgaaagccttaccgggaaagatgagtatctttttgatctcggggacgaggatgatccgttcaccataaacgcagcacagaaagggaacatagggaggtttataaaccatagctgctcgccgaatctgtacgcacaggacgtattgtacgaccatgaggaaataagaatacctcacattatgttctttgcactggacaatatacctccacttcaggaactctcgtacgactacaattataagatcgatcaggtatacgactctaatggtaatatcaagaagaaattttgctattgtggttccgctgagtgtagtggtaggctctactaatggcgcgcc

SEQ ID NO: 76 - DNA, 1050 bp, Arabidopsis thaliana
atggtggctgtgaggcgaaggagaacacaagcgtcaaaccctagatccgaaccaccgcaacacatgtcggatcatgattccgattccgattgggatacagtctgcgaagaatgcagttccggtaaacaaccagcaaagctgcttctttgcgacaaatgcgataaagggtttcatcttttctgtctcagaccgatcctcgtttcagttcccaaaggctcttggttctgcccttcttgttccaaacatcagatccctaaatctttccctcttattcagactaaaattatagatttcttccggattaagcggtctccagattcatctcaaatctcaagttcttcagatagtattgggaagaaacggaaaaagactagcttggtgatgtcaaagaagaagagaaggcttcttccatacaatcctagcaatgatcctcaaaggaggctagagcaaatggcgtctctggccactgcgttgagagcttccaacaccaagttcagcaatgagcttacttatgtatctggaaaggctccaagatctgcaaaccaagctgcttttgagaaaggaggcatgcaggttctatctaaagaaggcgtagagaccttagccttgtgcaagaaaatgatggacctcggtgaatgcccgccacttatggtcgtcttcgatccttatgaagggttcacagtagaggcggacaggtttataaaagactggacaattatcacagagtatgttggagatgttgattatctgagcaatagagaagatgactatgatggagacagtatgatgactctacttcatgcctctgatccttcgcaatgtctcgtaatttgccctgacagacgcagtaacatcgcccggttcatcagtggcatcaacaatcactcaccagaagggaggaagaagcagaacctgaagtgtgtgaggttcaacatcaacggagaagctagggttcttctcgtagctaatagagacatatcgaaaggggaaagattgtattatgattacaacggatatgaacatgagtatccaactgaacattttgtataa

SEQ ID NO: 77 - DNA, 1497 bp, Arabidopsis thaliana
atggaattggattcggagaacaaattgttgaagacgggtttggttatagtggcgacacttgttatagccaaactcatcttctctttcttcacttctgattctaagaagaagcgtcttcctcctactcttaaagcttggcctccattggttggaagtcttatcaaattcttgaaaggacctattattatgcttagagaggaataccctaagcttggaagtgtgtttactgttaatcttgttcacaaaaagattacttttcttattggtcctgaagtctctgctcattttttcaaagcttctgaatctgatcttagtcagcaggaagtgtatcagttcaatgtccctacttttggtcctggagttgttttcgatgttgattattctgttcgtcaggagcagtttcggttcttcactgaggcacttagagttaacaagttgaagggttatgtggatatgatggttactgaagctgaggattacttctctaaatggggagagagtggtgaagttgatattaaggttgagctagagaggctcatcatcttgactgcaagtagatgtttactgggtcgagaagttcgtgatcagctttttgatgatgtctctgctttgttccatgaccttgacaatggaatgcttcccatcagtgttctcttcccatatctcccaattccagctcaccgccgtcgtgaccgtgcccgagaaaagctttcggagattttcgcaaaaatcattgggtcgagaaaacgctctggaaaaacagagaacgacatgctgcagtgtttcatcgaatcaaagtacaaagatggtagacagacaaccgaatctgaagtcactggtttgctcattgctgctctgtttgcaggacaacacacgagctctatcacttccacctggaccggtgcttatctgatgcgatacaaagagtacttctcagctgctcttgatgagcagaagaacctgattgcgaaacatggagacaagatcgatcatgatatcttatccgagatggatgttctctaccgctgcattaaggaagcgttgaggcttcaccctccactcatcatgttaatgagagcctcgcacagtgatttcagcgtgacagctcgggatggaaaaacttacgatatcccaaagggtcacatcgttgcaacctcccctgcatttgccaaccgcttaccgcacatcttcaaagaccccgacacctacgacccagaaagattctcccctggaagagaagaggacaaagccgcaggggcattctcgtacattgcattcggagggggaaggcacgggtgccttggagagccgtttgcttacctgcagatcaaagccatatggagtcatttgttgaggaacttcgagcttgagctagtttcaccgttccctgagattgactggaacgctatggtggttggagttaaaggcaatgtgatggtgcgttacaagaggcgccagctttcttaaagacaagtttaaggttattgcagctttgga

SEQ ID NO: 78 - DNA, 597 bp, Arabidopsis thaliana
atgaatccggaacagaaacagcgcgaatgcatagtctgccgtgaaaaagagccgtcgttcatccacaccgtcatcaaaaccggcgctttccggcgactctgcaccgattgtttgctcaaagagtaccgagaacacttttgctctgtttgtttcaatctcttcgacaacgccgttcctccacaagctcgtatcatctgcgtcaattgcccatcaagcacccacctttcttgctcaactcagccgccgtcttcctccgccgcatcttcctcctcctccgctccaccaccagcttcttccttcacatgccagccatgttctaaccccaatttcaccttcttccccaaatctcgagtcaatgaagacgtccccgatgaaacgcctctcactccgaaatcggcaatggctcttgtcgcagctggaaatatctcggtggctaatatgaataaagcggtggctctgttaaaggaagaagctcttaagaagatcatagcagctaaaacggccaagttgagagctaaaggtgcattgacgaatcttcaggatattgttattcgacagagtaaggtcaccggcaagaggaaggaagatgaacgctga

SEQ ID NO: 79 - DNA, 2203 bp, Arabidopsis thaliana
ttcttgtttgttgattaacccttaattaatccgggcgcgcctgatttatcacaagtttgtacaaaaaagcaggctcctgcaggaccctctctcgaattcttttgtttcgaagccatggaaactgaatctgatgacgccaccattaccgtcgtcaaagacatgagagttcgattagagaatcgaattcgaacccaacacgacgctcacttagatctcctttcctcactccaatccattgttcccgatatagtcccatctctcgatctctcactcaaactcatctcttctttcacgaatcgacctttcgtagctacaccaccattaccagaacccaaagttgagaagaagcatcatccgattgttaaattaggaacccaactgcaacaattacatgggcatgattcaaaatcgatgcttgttgattcgaatcagagagatgctgaagctgatgggtctagtgggagtcctatggcgcttgttagagctatggttgctgagtgtttgcttcaacgtgtaccgttttctcctacggattcttctactgtgcttaggaagcttgagaatgaccagaatgctagaccggcggagaaggcggcgttacgagatttaggcggtgaatgtggaccgattcttgcggtggagaccgcacttaaatcgatggcggaagagaatggttctgtggaattggaagagtttgaggttagtgggaagcctaggatcatggttttagctatagatagaactagattgcttaaagagttaccagagagtttccaagggaataacgaatcgaatcgggttgtcgaaacgcctaattcaattgagaatgctactgtttctggtggcgggtttggtgtttccgggtcgggtaatttcccgagacctgagatgtggggaggtgatcctaatatggggtttaggccaatgatgaatgcaccaagaggaatgcaaatgatgggaatgcatcatccaatggggataatgggtagaccaccaccatttcctttgcctttgccgttgcctgtaccgtcgaatcagaagcttagaagtgaggaagaggatttgaaagatgttgaggctcttttgagtaagaagtcttttaaggagaagcaacagtctaggacaggtgaggagttgcttgatctgattcaccgtccaaccgctaaagaagccgctactgctgctaagtttaaaagcaaaggaggatcacaggttaagtattactgtaggtatttaactaaagaggattgccgtcttcagtctggttctcacatagcctgcaacaagagacatttccgtcgactaatcgcttcacatactgacgttagcctaggagattgttcctttctcgatacttgtcgtcacatgaagacttgcaaatacgtgcattacgagctcgacatggctgacgctatgatggctggtccagataaggcattgaagcctctacgtgctgattactgttctgaagctgaacttggtgaggcacaatggattaactgtgacatccgttcttttcgaatggacattttgggaacctttggagttgttatggcggatccaccatgggacattcacatggaacttccatatggaacaatggctgatgacgaaatgcgaactcttaatgttccctcgttacagactgacggtttgattttcctctgggtcactggtcgtgctatggaactaggccgtgaatgtttggagctttggggatacaagcgagtggaagagatcatatgggtaaagacaaatcaacttcaacgtattattcgaacaggaagaacaggtcactggctcaaccatagcaaagagcattgtctggttggaatcaaaggaaatccagaagtgaacagaaacatcgacacagatgtgattgtcgcagaggttagagaaacaagccggaagccagacgagatgtatgcaatgttagagaggatcatgccaagagcaagaaagctcgagttattcgcccgtatgcacaatgctcatgccggatggctatcacttgggaaccagcttaacggtgtccgattaataaacgaaggtcttcgagctcggtttaaagcatcataccctgaaatagatgtccagccaccatcaccaccaagagcctctgcaatggaaacagacaacgaaccaatggctattgactcaatcacagcttagctcgagacccagctttcttgtacaaagtggt

SEQ ID NO: 80 - DNA, 1327 bp, Arabidopsis thaliana
atgaaagggcttacgaggcttctcaattctctttcgcgacatacagcttccgtaacttgttctccatcttcttcttctcttctgatatcacgtcgctctctgtttatctcggcggcgacacactttccggtgaatttctcggagtcgataacaactaatgcttctcgtaactgttcgagatcttcttcatttcccttcaattggatcggtatggtaatttctaggtcgctaatcttcacatttgtatatcagtaaaatgttaaaagagtagtctttttgtcacatgattcttgaaaatgaaatctgatggcttgaaattggtgtaatgagcagagcaaaggaggacaatgtttatccaaacacaatcaacaccaaacccctcttctctaatgtttagtcctggtaaaccagttatggagattggaagtgctgacttccctaattctcgctctgctatgagttcacctttagctaaagccattttcgccattgatggtattcctcgtcttttgctacaacatacaattgtttcctcctcatataatccgtgttttgtgactaagattgtctctgttgatgcaggtgtagttcgagttttctatgggtcagattttgttactgtaacaaagtcagatgatgtaacatgggatatactcaagcctgatatctttgcagtggtaatggacttttactcttctggtcagcctttgtttctcgactcacaagctacagctgccaaggataccgctattcatgaggtaggctgctgccaatgtttgctagacttagacttttaaaaagccaaatactaatcaatgattgtttctcaggatgactctgaaactgtagcaatgattaaggaactcttggagacgcgtatccgaccatcagtccaagatgatggaggggacatcgagtattgtggattcgatacgtaagttttttatttgagttaaaagcaaatgttcaataagatcggatttatctttatcaaagctatttgttttggttagggaaactggtatagtgaagcttagaatgcaaggagcttgtagcggttgtccaagttcatctgttactttgaaatccggaattgagaatatgcttatgcattatgtttccgaggtaaagctgataaggagatgtcctaccatttatcatttctgttattcttttgctgttgagggagaatcatgatcttgttaatagtctactcttgttctctaatcattactcaccaaagcgtttgtgcaaaacacaggtcaaaggtgttgagcaagaattcgatggtgaagaggagggaacatcttctggtccaatggagtag

SEQ ID NO: 81 - DNA, 1682 bp, Arabidopsis thaliana
tttaattaaccaaaccaataatcagaacacagtgagatatttctctctgaagccaaagatggaaacggcgtcttctaatttctctctctcgcagatcctcaatattgaggaaccctacagctccgtaatgctcggtgtcgccgctctcttggccgttgtttgctatttctggatacaggggaagtccaaatccaagaacggaccaccgttgcctccgggaccttggccacttccgatcgtcggcaacctcccgttcctaaactctgacgtcctccacacgcaattccaagccctaaccctaaaacatggccctctcatgaagatccacctcggttccaaacttgcgatcgtcgtctcttcccctgacatggctcgcgaggttctcaaaacccacgacatcactttcgccaaccacgatctccctgaagtcggaaagatcaacacttacggtggtgaagacatcctctggtctccttacggtacccattggaggagacttcgtaagctctgcgtcatgaagatgttcactaccccaactctcgaagcttcctactccactcgccgggaagaaacccgacaaaccattgtccacatgtcggaaatggctcgtgaaggatcaccagtcaacctcggagagcaaatatttctttccattttcaacgtcgtgacaagaatgatgtggggcgccactgttgaaggagacgagagaacgagcttaggaaacgagctcaaaaccctaatatctgatatctccgacatagaagggattcaaaactactcagatttctttccgttgttctcaagattcgatttccaaggattggttaagcagatgaaaggccatgtgaagaagcttgatctcttgttcgatagagttatggagagtcacgtcaaaatggtgggaaagaagagcgaagaagaagaagatttcttgcaatacttacttagagttaaagatgatgatgagaaagctcctctgtccatgactcatgtcaagtctctcctcatggatatggttcttggtggtgtcgacacatcggttaacgcatccgaattcgccatggcagagattgtgagcagaccggaagtgttaaacaagatccgactagaacttgaccaagttgttggcaaagacaacatcgttgaggaatcacatttacctaagcttccttacctacaagcggttatgaaagagactcttaggcttcaccctacgcttcctcttcttgttcctcacagaaacagcgaaacctcggtggttgcgggatacactgtgcctaaagactccaagattttcatcaacgtttgggcgattcatagagatcctaagaattgggatgaaccaaacgagttcaaacctgagaggtttttggagaattcgcttgatttcaatggaggtgattttaagtacttgccttttgggtcaggaaggaggatttgtgcggcgattaacatggctgagagacttgttctgttcaacattgcttcacttcttcactcttttgattggaaagcacctcaaggacagaagtttgaggttgaagagaagtttggtcttgttcttaagttgaagtctccacttgtggctattcctgttccaaggttgtccgatccaaaactctatacagcttaagtaagtaagaaggaaatttggtttgagcttatgagaggaaatttaaata

SEQ ID NO: 82 - DNA, 1323 bp, Arabidopsis thaliana
atggcggaggatatggctgccgacgaagttacggctcctcctcgtaaggttcttatcatctccgctggtgctagccactccgtcgctcttctctctggtgacattgtttgttcttggggtcgaggagaggatggacagttaggtcatggcgatgcagaggatcgaccttctccgactcagcttagcgctttagatggccaccaaattgtttccgttacctgtggtgctgatcacactgttgcttattcacaatcaggcatggaagtctacagttggggatggggtgattttgggagattaggccatggtaactcaagcgacttgtttactccgctaccaatcaaagcattgcacggtattcggatcaagcagattgcttgtggggatagtcattgtttggctgtcactatggaaggagaggtccagagttggggccgcaaccagaatggtcaacttggtctgggggacaccgaagattctctagtgcctcagaagattcaagcctttgagggaatacgaatcaaaatggttgctgctggtgcagaacacactgctgcagttacagaagatggtgacctctatggatggggctggggaagatacggaaatttgggattaggtgaccggactgaccgcttagttcctgaaagagttacctctactggtggtgagaaaatgtcaatggttgcttgtggatggcggcacacaatatcagtttcctactctggagcattgtatacttatggatggagcaaatatggacagctaggacatggagacttggaggatcaccttattcctcacaaactggaagcactgagcaacagttttatctcccagatttcgggaggttggagacatacaatggcattgacttcagatggaaaactatatggatggggttggaataagtttggacaagtaggagtcggcaataatttagatcagtgttctcctgtgcaagtgcgatttcccgatgatcagaaagtagttcaagtctcatgtggatggagacataccttggctgtcactgaaagaaataacgtgtttgcttggggtagaggtacaaatggacagctcggcattggagagtcggttgacaggaactttcccaagattatagaggcactcagcgtcgatggagcaagtggacaacatatagaatcttctaatatcgatccatcttcagggaaaagctgggtgtcgcctgcagagagatatgcagttgttcctgatgaaacgggcctaacggatggttcaagcaaaggtaatggaggtgatatcagtgttccacaaactgatgtcaagcgtgtacgaatttga

SEQ ID NO: 83 - DNA, 1448 bp, Arabidopsis thaliana
ttaattaaatggaaggtgtggctatgaaactcccgtcgttccctaacgccatctccatcggccaccggagcttctcccgcgttcgttgctcctcttcgctatccgtttgttccgccgccgccgcttcctccgccaccatctccactgattccgaatccgtctctctcggccatcgcgttcgaaaagatttccgaattctccaccaggaagtgaatgggtcaaagcttgtgtacttagacagtgctgcaacttctcagaagccagcagctgtattggacgctttgcagaattactatgagttctataattccaacgttcatcgaggaatacactatttaagtgctaaagctacagatgaatttgagttagctaggaaaaaagttgctcgtttcatcaatgcttctgatagtagagagattgtttttacaaggaatgccactgaagccatcaatcttgtagcttattcatggggtctttctaatcttaaaccaggagacgaggttatacttacagttgctgaacatcatagttgcattgttccttggcaaattgtatctcaaaaaactggagcagttctaaagtttgtgactttgaatgaggatgaagtccctgacataaacaagttgagagaattgatttctccaaagacaaagctcgtcgctgttcatcatgtttctaatgttcttgcatcttctcttcctattgaagagattgtggtatgggcacacgatgttggagcgaaagttctagtggatgcttgtcaaagtgttcctcacatggtggttgatgtccagaagcttaatgctgattttctagttgcgtcttctcacaagatgtgtggacctacaggcattgggttcttatatggtaagagtgatcttctacattccatgcctccattcttaggtggcggagaaatgatctcagatgtatttcttgaccattcaacttatgcggaacctccatccagatttgaagctggaacacctgcaataggagaagcaattgcccttggagcagcagttgattacttgtcaggaattggcatgccgaaaatccatgaatatgaggtagagattggtaagtatttgtacgagaaactgtcttccctgcctgatgtgcggatatacggtcccagaccttctgaaagtgttcacaggggtgctctttgttccttcaatgtggagggcttgcacccaactgatttggcaacctttcttgatcagcagcacggagttgcaataaggtcaggacaccactgcgcacagccactccaccggtatcttggagtgaatgcaagtgcacgcgccagcctctacttttacaacacaaaggatgacgttgacgccttcatcgttgcgctggcagacactgtgagcttcttcaactctttcaaataagtggaacaccttcctgctggatctctcggctggtttgtatggcgcgcc

SEQ ID NO: 84 - DNA, 797 bp, Arabidopsis thaliana
atgactcaccgtatagctcctcgatgtttctccaccatcatgcttctatgtcttctatatacttcacgtaatctctctgcgtctgatacatatgaataagctttgttttttttcttcgcattctgaaaatttaaggatgcaacaaactaacttgatttttgtgatgattgatttcagctctagatgttatagctcagggtcagggaggacaaggtgatataccagttgttaatcctacagctccaggtggtagtaccacaacaccaaccataacacaaccgtcaccgccttccttgacattcccaggtccaactacaccaactggtggttatccacctcttgacggtaccacgccaaccggtggttacccaccactttatggtactacaccgccaggtggaggtgatgtaggtggtggaggaggcggatatggtggtggtacacctggtggaggtggaggtggaggtggtgacactggtgcaggtgctggaggtgggggttatggtggtggtggtgacactggtgcaggtggaggtgttggtagtggccagtggtgtatagcgaaagcaaatgcttcgccaacatcattacaggtggctttagattacgcttgtgggtatggaggagctgattgtggccagatacaacaaggtgcagcatgttacgagcctaacacaattcgtgaccatgcttcctttgctttcaatagttattaccagaagcatcctggttcagacagctgcaattttggaggggcagcacaacttactagcacagatccaagtaagacatcttaa

SEQ ID NO: 85 - DNA, 1452 bp, Arabidopsis thaliana
atggcggatttgttaagaaaagtgaaatcgataaagaagaagcaggatcagagcaatcatcaagctctgatccttggcaaatacgaaatgggtaggcttcttggccacggaaccttcgctaaagtctatctcgcacgaaacgctcaatctggagaaagcgtagcgatcaaggtaattgacaaagagaaagttctcaaatccggtttaatcgcacacatcaaacgcgagatctcgatcttgcgccgtgttcgtcatcctaacatcgttcagctattcgaagtcatggcgacgaaatctaagatctatttcgtaatggaatatgttaaaggaggtgaattgttcaacaaggtagctaaaggaaggttaaaagaagaaatggcacgtaaatattttcaacagttgatctcagccgtatcgttttgtcacttccgtggtgtttatcatcgagatttgaaaccggagaatcttcttttagacgaaaatggaaacctaaaagtctctgattttggtcttagtgctgtttctgatcagattcgacaagatgggttatttcatactttttgtgggacccctgcttacgtggcaccggaggttcttgctcggaaaggctacgatggagctaaagtcgatatttggtcttgtggagtgatcttgtttgtgttaatggcagggtttcttccttttcatgatcggaatgttatggctatgtataagaagatttacagaggagattttaggtgtccgagatggtttccggttgagattaaccggttattgattcgaatgttggagactaaaccggagagacggtttacaatgccggatattatggagactagttggttcaagaaaggttttaagcatattaagttttatgttgaagatgatcatcagctttgtaacgttgctgatgatgatgagatcgaatcgattgaatcggtttcggggaggtcttctacggtttctgaaccggaagacttcgagtcttttgatgggaggagaagaggtggttcgatgcctagaccggcaagtttgaatgctttcgatctcatttcgttttcgccaggttttgatctttcgggtttgtttgaggatgatggtgaaggatctaggtttgtgtctggtgctcctgttggtcagatcatttctaagttggaggaaatcgcgaggattgtgagttttactgtgcgaaagaaggattgtaaagtgagtcttgaaggttcaagagaaggaagtatgaaaggtccattgtcaattgctgctgagatatttgaactgacaccagctttggttgttgttgaagtgaagaagaaaggaggtgataaaatggagtatgatgagttttgtaataaggagttgaaacctaagttgcagaatttgtcttccgaaaatggccaacgggtttctggttcgcgttctttgccatcgtttttactttctgatactgattag

SEQ ID NO: 86 - DNA, 1207 bp, Arabidopsis thaliana
atgtctgaatgtggatgtttttcggcaacaactatgttgagaatttgtgtagtattgataatatgtttgcatatgtgttgtgcctcgagtgattgtacaagtcacgatgatcctgtgtctcaagacgaagcagagaaagcgacgaagctaaagcttggttcgatagctttacttcttgtagccggaggagtcggcgtgagtctaccgttgatcgggaaaaggattccggcgttacaaccggaaaatgatatcttcttcatggtgaaagcttttgctgcaggagtgatcctctgcacaggtttcgttcatatcttaccagacgcgttcgagagattgagctctccatgtcttgaggacactacagctgggaagttcccgtttgctggttttgtagcgatgctgtcggcgatggggactcttatgatcgacacattcgcgacagggtattacaagaggcaacattttagcaataaccatgggagcaagcaagtgaacgtagtagtagatgaagaagagcatgcgggtcatgttcacattcacacgcacgctagtcacggacacacacatggttcgaccgagttgatcagaagacgtatagtgtcgcaggtgcttgagattgggatagttgtgcattcggttattatagggatatcacttggagcttcacagagcatagacaccataaagccactcatggctgcactatctttccatcagttctttgaaggtcttggcctcggtggatgcatctccctggttagtctcttccaaatcgtttatggtcataggtagcttagcttagacgaatcgtgtcacaacaatcattttttcttcattgttcaaaattcaattgattgatgatagcatgatgatcatgttgtgtgtatatgaataggcggatatgaagtcgaaatcgacagtgctaatggcgacatttttctcggtgacggcgccacttgggataggaatagggttggggatgtcaagtggtttaggctacaggaaagagagcaaagaggcaataatggtggaaggaatgttgaatgctgcatctgctgggatactcatatacatgtcacttgttgatcttcttgctactgattttatgaatccaagattgcaatccaatctctggcttcacttggctgcttatctctctctcgtcctaggcgcaggttccatgtctctcctcgccatctgggcctga

SEQ ID NO: 87 - DNA, 1113 bp, Arabidopsis thaliana
atgaacaccggcggtggccaatacacggattttccggcggtggaaactcacggaggacagttcataagttacgatatcttcggtagtttattcgagatcacatctaagtatcgtcctccgattataccaattggtcgtggagcttatggaatcgtttgctctgtgttggatacggagacgaacgagctagtagcgatgaagaagatagctaatgcttttgataatcatatggatgctaagcgtacgcttcgtgagatcaagcttcttcgtcatcttgatcatgaaaacattatagctataagagatgttgttccaccaccactaagaagacagttcagtgatgtttatatctctactgaattaatggatactgatcttcatcaaatcatcagatctaaccagagtttatcagaagaacactgtcagtacttcttgtaccagctacttcgaggactgaagtatatccactcagctaacattattcatagggatttaaagccgagcaatcttctgttgaacgcgaattgcgatttaaagatttgtgatttcggtcttgctagacctacttcagagaatgattttatgactgagtatgttgttacgagatggtatagagcacctgagcttctgttgaactcttcagattacacagctgctattgatgtttggtctgttggttgtatctttatggagcttatgaatagaaagcctttgttccctggtaaagaccatgttcatcaaatgcgcttattgacagagttgcttggcacaccgacagaatctgatctcggttttactcacaatgaggatgcgaaaagatacatccggcaacttcccaacttcccacgtcagcccttagctaaacttttctctcatgttaacccaatggccattgatcttgttgacagaatgttgacgtttgaccccaacagaagaatcactgttgaacaagctctgaatcaccagtaccttgctaaattgcacgacccgaatgatgagccaatctgtcaaaagccattctcttttgagttcgaacaacagcctctggatgaggaacagataaaagagatgatctaccaagaagccatagcactcaatccaacatacggttag

SEQ ID NO: 88 - DNA, 1053 bp, Arabidopsis thaliana
atggagaacggagacattccagaggacgctaacgagcattgcccaggtcctcaatcagaatctgctggaaaatcagattcttgtgctggctgccctaatcaggaagcttgtgctactgctcctaaaggacctgacccagatttggttgccatagcagagaggatgagcactgttaagcacaagattctggttttgtctggcaaaggtggagttggtaagagtactttctcagctcagctctcgtttgcccttgcgggcatggatcatcaagtaggtctgatggacattgatatatgcggtccaagcatcccaaaaatgttaggacttgaagggcaagagattcaccagagtaaccttggatggtctccggtttatgtggaagacaaccttggtgtcatgtccataggtttcatgctccctaactctgatgaagctgtgatctggagagggccacgcaagaatggtctcatcaagcagttcttaaaagacgtctactggggagagattgattaccttgttgttgatgccccaccaggaacctcagatgaacacatctccatcgtccagtaccttctacccacggggatcgacggtgccatcattgtcacgacaccgcaggaagtctccttgattgatgtcagaaaagaagtgagcttttgcaagaaagttggagtcccggtgctaggagtagtagagaacatgagtggtttatctcaaccgttgaaggatgtcaagttcatgaagctggcgacagagaccggctcctccattaacgtgactgaagacgtaatcgcttgcttaagaaaaaacgcaccagagcttctcgacatcgtggcttgtagcgaagtgtttgacagcagcggaggcggtgcagaaagaatgtgtcgggaaatgggagtaccgtttcttgggaaagttcctatggatccacaactttgcaaagcagctgaacaaggtaagtcatgctttgaggataacaagtgtttaataagcgcacctgcgcttaaaagcatcatacagaaagtcgttccttcaacagtgatgaccgagtga

SEQ ID NO: 89 - DNA, 1172 bp, Arabidopsis thaliana
ttcttgtttgttgattaacccttaattaatccgggcgcgcctgatttatcacaagtttgtacaaaaaagcaggctcctgcaggaccggtcaaaagacctcttgataagcaaaatatgggagaaatgattgtttcaatggaccaagatatccgactggatacaacacgagcaagattgtcaaaccttctcaagaggcatcgagaattgtcagaccgtcttactagggattctgataagacaatgttagatcgcttaaacaaagaatttgaagctgcacggagatcccaaagtcaggaagtcttcttagatggggaagagtggaatgatggtttgttggccacattaagggaacgggtgcatatggaagctgacagaaaggcagataacggtaatgcaggtttttcactagtttgtcatcctgaagaacgaattacttacagagtgggaaataaggtgatatgttgcctagatggatcgagaattggaatacagtttgaaacatctactgcaggagaaacttacgaggtttaccactgtgtgcttgagagcaagtcgtttttggagaagatgattgtgcttgagcacacaattcctttctttttgccgctaagtgacttggaaaatgatcttcttttttcgaatgctaagaaattcatcgataatgttggggatctcctgcaagcatatgtggacagaaaggaacaggtccggcttatcaaagagctctttggacatcagatcagtgagatttatcacagtcttccttaccacatgattgaattttctatggatgattgtgactgcaagttcgtggtgagccttagatatggagatcttctgtgtgaacttccgacaaaagtgagaattctagtatggccaatgcatcatctgtcgaagaaacagtgtacaagccctggaagtccagcaatccctgtgcgtttaccatttgccgaggatgctttccggatccaatcactacctgaagcatacgcagagattatgccgaacatgccgaatgaaattcggcaattatttcagactagtccaagctaaaagttgaagctgtgtgcaaactttctacttgtctcgttgcttcgttgtactcgagacccagctttcttgtacaaagtggtgataaattggagctctgcagagctttcgttcgtatcatc

SEQ ID NO: 90 - DNA, 282 bp, Arabidopsis thaliana
atggcgtttttactcaacacctcgatttcatctcacctccgatcttcttcccagaagacggatggtgctttagctcaatcccgtcgcgggttccatgtggagctaggtgctcgtgagaaagctctcttggctgaggatgcatctttgaggagattcaagtcgcataagaaaggtgttcatagattgaaaagaattggagatgtgctcacagttgtcgttgtcgctggatgctgctatgagatctatgcgagagtgatgagaaaggaagctcaggctgcatga

SEQ ID NO: 91 - DNA, 991 bp, Arabidopsis thaliana
atgccaggtccagttattgaggaagtgaatgaggaggctcttatggatgccattaaagagcagatgaagctccaggtattgtaatcttcttcttctctatttgttttttaagagaatcgatttttgttcgattttgatttggtttgtgttatggagcagaaggagaacgatgttgttgttgaggatgtgaaagatggagacgaagacgatgatgatgttgatgacgacgacgatgagattgctgatggtatttttactcttttactcgatttgattgttttcgtttggtggtttagggatgtttctggaatcatgttgtggatttgtgattgaatcaatctgtttcgagtctggattaggttttctaggttttgctatgtatgacatttgttagggttttgatgttgttattgttgttgttgttgttgtttatgtgaaggagctggtgagaatgaggcttccaagcaaagtagaagcgagaagaaaagccgaaaggcgatgctgaaactcggaatgaaacctgttactgatgttagcagagtgactatcaagagatcaaagaatgtaagtaatgacctaattgactgtattccattattgtgtagcgatgtttgattctgtatgttattgtatcatttaggtgttgtttgtcatctcgaagccggatgtgttcaagagtccgaactctgagacctatgtgatattcggtgaggctaagattgatgacatgagctctcagctacaagcacaagctgctcagaggttcaagatgcctgacgttgcgtctatgatccccaacactgatggttctgaagcagccacggttgcacaagaggaggaagacgatgaagatgttgatgagactggtgttgaagccaaggacattgatcttgtgatgactcaagccggtgtctcgaggcccaaggctgttaaggctcttaaagagagtaacggagatattgtttccgccattatggaactcactacatag

SEQ ID NO: 92 - DNA, 2526 bp, Arabidopsis thaliana
catttatttgtcagctttcaaactctttgtttcttgtttgttgattaacccttaattaagatgggacgctctcgagttcaagttaacaaagctcacaagactcgtttctcctctaaatcttctcgtaatctccatagaaccaaccttcaagatagtggccggattgggaaatcggatagtaactatgttaaaggagctaaagctgctcgtgttcaacgtggtaagatgcttagagagcagaagagagcagcagttttgaaggagaagagagcatcaggaggaattaacagtgctcctcgtgttatcgttttgtttcctctctctgcttctgtggaattgaattcacttggtgaagatgttttgaagttgttatcttctgatggttctggaattgcttcttcgacagttgcatcttctgagtataagctacgagcaactgtgttaaaggcgcctcatggggatcttctgacatgtatggaaatggccaaggttgctgatttgatggcttttgttgcatctgcaagtgctccgtgggaagagaatagctctaacttcatagattctttcggaagtcagtgtctttctgtgtttagatcaattggtctaccaagcactactgtgttgatccgtgatttgcccagtgatgtgaaaaagaaaaatgagatgaaaaagatgtgtgcctctcaacttgcttctgaatttcctgaggattgtaagttttatccagcagataccagagatgagttgcataagtttatgtggttattcaaggcgcaaaggcttactgtgcctcactggcgaagtcaacgatcatacattgtggctcgcaaggctgggatgctggtggatgatgaaagctcaggaaagtgcactctacttctctctggttacttgcgtgctcgcaaactgtctgtaaatcaactggtccatgtttctggcgttggggattttcaattctccaaaattgaagtgctgaaggatccatttcctttgaatgaaaggaaaaatcagaattccatggaattagatgattcacatgatgaagaggtattgaagtctctggttcctgatcccatgaaacaagagcctttagtaattgaaaacactccagatcctttagcaggggaacagacatggccaacagaggaagaaatggctgaggctgacaaaaatcagaagcagggcaggctaaagaagaagactttgccgcgagggacttcagaatatcaggctgcttggattgtggatgaaacagatgaagaggattccgataatggtgattctgatgataatggtatggtattggatagaggagaggattccaatcaagaaggaatgtatgaccaagaatttgaggatgacggaaaatcattgaacctgcgggatattgatactgaaactcagaatgaatccgaaatggtggacgatgaagacttgacagaagaacaaattaaggatgaaatcaagaaaatcaaagaggcatatgctgatgacgaagaatttccagatgaagtagagactcccattgatgttcctgcaagaagacgttttgcaaagtacaggggtcttaaatccttcagaacctcctcgtgggatccaaatgagtctttacctcaggactatgctagaatttttgcttttgataatgtcgcaaggactcaaaagcttgtgctcaagcaagccctgaagatggaagaagaagacagagatgattgtgtaccaattgggtcatatgtacggctgcatattaaagaagtgcctcttggtgctgcctctaaactatcttctcttgtgaacacaacgaaaccaattataggatttgggcttctgcagcatgaatccaagatgtcggttctgcattttagcgtaaagaagtatgatggttacgaagctcctattaaaacaaaagaagagctaatgttccatgttggtttccgtcaattcattgcaaggccggtatttgcgaccgacaatttcagctcagacaagcacaagatggagagattcctgcatccagggtgtttctcgttggcttcaatatacggccccatatctttcccaccccttcctttggtagttctgaagatttctgaagggtcggatcctcctgccattgctgcccttggttccttgaaaagcgtagaacccaacaaaataatcttaaagaagataatattaactgggtaccctcagagagtatcgaaaatgaaagcttcagtcagatatatgttccacaaccccgaagacgtgaaatggttcaagcctgttgaagtatggtcaaaatgcgggcgtcgtggtcgcgtgaaggaaccagtaggcacacatggggcaatgaaatgcatattcaatggagtggttcaacaacatgacgtagtgtgcatgaacttgtacaagcgcgcttatcccaagtggcctgaacgtctgtacccacagcttctctgaatttaaatacccagaaatacccagcaaattggagctctgcagagctttcgttcgtatcatcggtttcgacaacgttcgtcaagt

SEQ ID NO: 93 - DNA, 1648 bp, Arabidopsis thaliana
ttaattaatctcttacttgtattgttacgactctctgcttgaagattatggacggcgccgatggaaccgttcgcgtcaagcctggtcgcggattcgaaacggagacggatgttgcggtttcgtcgccagtgacacgtcagaaagctgctgcagctaagcaattcatcgagaatcattataagaattacttgcaaggcttgcacgaacgaatggagagacgcagggagtttcagaggaaagtgcaagaagctcagttacctgttgaggaacaagacgagatgatgaggaatctggctcgtcgtgaaactgagtatatgagacttcagagacgtaaaattgggattgatgattttgagcttttgaccgttattggcaaaggtgcctttggtgaggttagattatgtcgtttgagatctacatctgaagtttatgccatgaagaaattgaaaaaaactgagatgcttagccgtggacaggtagagcatgtcaggtccgagaggaacttacttgcagaagttgacagccgttacattgtaaagcttttttactcttttcaagattctgaatgtttgtatcttatcatggagtatttacctgggggtgacatcatgacactactcatgagagaagacattctttctgaagatgttgcccgtttttatattgctgagagcattcttgccatccattcaattcatcaacacaactatgttcacagggacatcaaacctgataatttgatactagacaaaagtgggcatttgaagctttcagattttggtttatgtaagccacttgatgacaagtattcttcattgctattagaagacgatgaaatgttgtctcaggattcagagaaccagtcaggaaaatcagacgctgacaaagcaccctggcaaatgcctaaagagcagttactgcagtggaaacgcaatcgccgtgcattggcttattcaaccgttggaactcttgattacatggctccagaagtactcctaaagaaaggatatggaatggaatgtgattggtggtctctcggcgcaattttgtatgagatgttagttgggtatcccccattctgttctgatgacccccgtataacatgccgcaagataattaattggagggtatgcttgaagttccctgaagaaccaaaaatatcagatgaagccagagacttgatttgtcggttgctttgtgatgttgattcaaggttgggaaccagaggtgttgaggagataaagtcgcatccatggttcaaaggcaccccatgggacaaactgtatgacatggaggcagcttatagacccattgtcgatggagaactagacacacaaaattttgagaagtttcctgaagttgaaggatcaccatccgaagcaccacaagttggtccttggagaaagatgttgacgtccaaggacaccaacttcataggatttacatttaagaagtcagacatcacaagatcaatggaaagttcaggtgcagacatgaaatcaaatggatcaggggaagccccgtcgttgatatcattgttaggtcggatcaatatggaagaaggtgaaggtggtgagttaaaccacaagacatagggaaaatacaaatattattgattttttatccgcttgcagttgtttggcgcgcc

SEQ ID NO: 94 - DNA, 2161 bp, Arabidopsis thaliana
atgtgttttaataacattgaaactggtgatgaagtggaaaccgagaggcaagtgtttggttcatctgaagaagatgaatttcgagttgaagatactgctagaaataccaacaatgtacagatttctcaacaacagcagcaaccgctagctcatgttgtgaagtgggagaggtatctcccagttagatcgcttaaggttcttctggtggagaatgatgactcaacacgccatattgttactgcccttttaaagaattgcagctatgaaggttttcttatattgaattgatcatccttgtttagcaatcacatttttgcttttgactaacagttgtaaatttggaaactttttgtcagttactgctgttccggatgtccttgaagcctggagaattctagaagatgagaaaagttgcattgatcttgtcttaacagaggttgacatgcctgtgcattcaggaaccggtctgctgtccaagattatgagccataagacacttaagaacatccccgtcataagtatttactcaaatccttgattaaatttttgtttatccagcttcaatatgccatgctcagtttgtgtaactcaagatgtgatgtttctttttgtagtgatgtcatcacatgattctatggttctggtctttaagtgtttgtcgaatggtgctgttgattttctcgtgaaacccattagaaagaacgaactaaagaatctttggcaacatgtctggagaagatgtcacagcgtaagagttctgatttggttacctgttttacaaaagttactctgtgtttttttcttacttatgcgtttattgatttaccagtctagcggaagcggaagtgagagtggaatacatgacaagaagtcggtgaaacctgaaagcacccaagggtcagaaaatgatgccagcatcagtgatgaacacaggaatgaaagtgggagtagtggtggtttgagtaaccaagatggtgggagtgataacgggagtggaactcaggtaatctgttctatggctatagataataacaatgtctgaataaatcggtttataaatttttgattggttttgcatttataaaaatatgtagagttcttggacaaaaagagccagtgatactaagagcacctcgccttcaaatcaatttcccgatgcacccaacaagaaaggaacctatgaaaatggatgtgcacatgttaatagactgaaggaggctgaagatcagaaggaacaaataggtaagaacgcaaattaattagtcaattaaaatgtgagtacactgatcttgtggaacaattccttgagattctctctgatttactttaattcaaaacaatgactttagatgatattgtattaggcacgggatcacagacaggaatgtctatgagtaagaaagctgaagaaccaggagatcttgaaaagaatgcaaagtattctgttcaagctttggagagaaacaatgatgacacgctgaatcgctcttctggtaactcacaagtagaaagcaaagcaccttcatctaaccgagaagatttgcaatcactcgagcaaactctgaaaaaaacaagagaggatagagattacaaagtcggtgatcgaagtgtgttgaggcattcaaatctctctgcattctcaaagtaagttcttgacattaactgcaaatgaaatgtcgaacctgtgactgatttggagttattggttctcttgtgatatgcagatacaataatggtgctacttctgctaagaaggtaacttttcatgatgcttggcgctgtctttgaaatttatgccggtttcatcaaaaactttgaacttttgctgagttaggctccagaagaaaatgtggaaagttgttctcctcatgacagtcctattgcaaaactgttgggttcgagttcaagcagtgacaatcctttaaagcagcagtctagtggaagtgaccgatgggcacaaagagaagctgctttgatgaagtttcgccttaaacgtaaagagcgatgttttgagaaaaaggtaagctctaaacaagcttaagctcttgtttcctgagacgaaactaacgttttttttggtatcctttaggttaggtaccatagcaggaagaaactagctgagcaacggcctcacgtcaaaggtcaattcattcgcaagtaa

SEQ ID NO: 95 - DNA, 981 bp, Arabidopsis thaliana
atgttgtttagtggttcagcgatcccattaagcagcttctgctctcttccggagaaaccccacactcttcctatgaaactctctcccgctgcaatccgatcttcatcctcatctgccccggggtcgttgaacttcgatctgaggacgtattggacgactctgatcaccgagatcaaccagaagctggatgaggccataccggtcaagcaccctgcggggatctacgaggctatgagatactctgtactcgcacaaggcgccaagcgtgcccctcctgtgatgtgtgtggcggcctgcgagctcttcggtggcgatcgcctcgccgctttccccaccgcctgtgccctagaaatggtgcacgcggcttcgttgatacacgacgacctcccctgtatggacgacgatcctgtgcgcagaggaaagccatctaaccacactgtctacggctctggcatggccattctcgccggtgacgccctcttcccactcgccttccagcacattgtctcccacacgcctcctgaccttgttccccgagccaccatcctcagactcatcactgagattgcccgcactgtcggctccactggtatggctgcaggccagtacgtcgaccttgaaggaggtccctttcctctttcctttgttcaggagaagaaattcggagccatgggtgaatgctctgccgtgtgcggtggcctattgggcggtgccactgaggatgagctccagagtctccgaaggtacgggagagccgtcgggatgctgtatcaggtggtcgatgacatcaccgaggacaagaagaagagctatgatggtggagcagagaagggaatgatggaaatggcggaagagctcaaggagaaggcgaagaaggagcttcaagtgtttgacaacaagtatggaggaggagacacacttgttcctctctacaccttcgttgactacgctgctcatcgacattttcttcttcccctctga

SEQ ID NO: 96 - DNA, 765 bp, Arabidopsis thaliana
atggcgaggggagaatcggagggagagagctcaggaagtgaacgagagagttcgagctcgagttccggcaacgaatcggagccaacaaaggggacgatctcgaaatatgagaagcagaggttgtcaaggatcgctgagaacaaagcgagattggatgcactcggcatctctaaagccgccaaggctcttctgtcaccatctccagtttcgaaaaaacgtagagttaagcggaattccggtgaagaagacgatgattatacacccgtaatcgccgacggtgatggtgatgaggacgatgacgaagtagaagaaatagacgaagacgaggagtttctgtgtaaaagaaagaacaagtcctctgcatccaagagaaaagtctcatctaggaagattttgaatacatcagtttcccttggtgaggatgatgatgacttagacaaggcaatagcgctttctctacagggctctgttgcaggaagcgataaagaggctgcaactatgaagaagaaaagaccggaattgatgagcaagacgcagatgacacaggatgaattggtcatgtacttctgtcagtttgatgaaggtggaaaagggttcattactctgagagatgtggcgaaaatggcaactgtgcatgacttcacatggacagaagaggaattacaagacatgattcgttgctttgacatggacaaggacggaaagctaagcttggatgagttcaggaagattgtgtcgcgatgtcgcatgttgaaaggttcttga

SEQ ID NO: 97 - DNA, 414 bp, Arabidopsis thaliana
atgcaaggaacgatttcttgtgcaagaaattataacatgacgacaaccgtcggggaatctctgcggccgctatcgcttaaaacgcagggaaacggcgagagagttcggatggtggtggaggagaacgcggtgattgtgattggacggagaggatgttgcatgtgtcatgtggtgaggaggctgcttcttggacttggagtgaatccggcggtccttgagattgatgaggagagggaagatgaagttttgagtgagttggagaatattggagttcaaggcggcggaggtacggtgaagttaccggcggtttatgtaggagggaggttgtttggagggttagatagggttatggctactcatatctccggtgagttagttccaattcttaaggaagttggggctctgtggttgtga

SEQ ID NO: 98 - DNA, 333 bp, Arabidopsis thaliana
atggcgtcgaatctcctgaaagccctaatccgatctcagattcttccatcttccaggaggaatttcagtgtggcgaccacacagcttggcattccaacagacgatctagtcggcaatcacaccgccaaatggatgcaggatagaagcaagaaatcacctatggaactgattagtgaggttccacctatcaaagttgatggaaggattgttgcttgtgaaggagacaccaatccggccctaggtcatccaatcgagttcatatgcctcgacctaaatgagcctgcgatctgcaagtactgcggccttcgttatgttcaagatcatcaccattga

SEQ ID NO: 99 - DNA, 629 bp, Arabidopsis thaliana
atgaacgaagaggagccagacaaagaacacgtggcggattctactatgtcggcggcggcgattgatggtgtggcggctctgagatcggtgtttcagcgggtaaaccaggcggcggagaaagcgggtcgtgggtcggatcagatacgggtcgtagcggtgagtaagacgaaaccagtttctctgattcgccaagtatacgacgctggtcagaggtcttttggagagaattatgtgcaagagatcattgagaaggcacctcagcttccagaagatatagagtggcatttcattgggaatttgcagagcaacaaagtgaagcctttgctatctggtgttcctaaccttgtgaccgtggaaagtgttgatgatgaaaagattgcaaatatgcttgatcgtgtggttggtaatatcggaagaaagcccttgaaggtatttgtccaagtgaataccagtggtgaagactctaaattcggcgtggaaccctcgggatgcgtaggactggcgaaacacgtgaaggaagcttgctcgaatcttgagttttctggtttgatgacaatagggatggctgattacacttcaaccccagagaatttcaagttgcttgcgaaatgcagaagtgaagtgtgtaa

SEQ ID NO: 100 - DNA, 476 bp, Arabidopsis thaliana
aactctttgtttcttgtttgttgattaacccttaattaagtgtgaagatggcatcgaagttgatacaagttcaatcaaaggcatgtgaggcttcaaagtttgtggctaagcatggaacttcctactacagacagctgttggagaagaacaagcagtatatccaggaacctgccactgttgagaagtgccaagagttgtctaagcagttgctctacacccgtcttgctagcattcccggacgctatgaaaccttctggaaggaagtagactacgcaaagaacctatggaagaacagatccggtctgaaggtagaagatgcaggaatcgctgcattgtttggtctcgaatgctttgcatggtattgcgcaggtgaaatcgccggcagaggattcaccttcacaggctattacccatgaacgacaatttaaatacccagaaatacccagcaaattggagctctgcagagctttcgttcg

SEQ ID NO: 101 - DNA, 1176 bp, Arabidopsis thaliana
atggcgtcttcttccacctttctggaattaactccatttcaatggaatcaacctctcccatacacacaacgaccccatcatcgtactgttcttctctactccaaacctcaaaggagatcaaattcgattcgtctccaaatctccgtcaaatacaagcaatcaacatcttcttcagatccagatttgagatccaatttcaatccatttgaacaaatcgcgattcaggtcaaaaaagcgttagattcgttgaagaaacctgctatagctgcggttttacttggtttgcttttgttctatgatcctaattcggctttagctgcgtctggtggtagaattggtggtaattccttctcgtcgaggtctcggagctcttcttcttcttcttcgcaatcgtattctgtgccgagaacatcgaatccgagcttttcgtactctgctaggaccgctccgtactatggaccgtcacctttcggtgggggttttgtgggcccggcggttggttttgggtttggtggtttttcgagcttctccttgattttggttggtttcgctgcgtttgttttggtctctggattcctctcagatcggtcacaggatgatagcattttaacagatactcagaaaactagcgtcattaagctacaggtggggttgcttggtttggggaggacactacaacaagattttaatcgtcttgctgaaagttcggatacatccacaccggagggtctgagctatgttttaaccgaggcaacattagctttgctgagacaccctgattactgcatctcttgttattcatcagtggatgtgaagccgagtatagaaaagggagagaagcgatttaatcaactctccattgaagaacgaggaaaatttgatgaggagacacttgttaacgtgaatagcataaagagacaaagctcgaagattcggaaagctagcggtttcagcaatgaatatattgtggtaaccatcttgatggctgcagagggtatacataaactgccaccaataaacggaactacagatctgaaggaagccttactgaaactcgggtcaataccaagaaacaaaataatggcagtagaagtactatggacaccgcagaacgaagccgacgcattgtcagaaagggaactacttgaagattacccacttttgaggcctttgtaa

SEQ ID NO: 102 - DNA, 861 bp, Arabidopsis thaliana
atggcggagaaaaagagagtcaagtacttcattgttgatgcattcgctgaatctgccttcaaagggaatccagctgctgtttgctttctagaagacgataacgagagagacgacgcgtggcttcagtctcttgccaccgagttcaatatctccgagacttgtttcctcactccgatcatcggagacttgcctcgcttccgtctccgttggttcactccagtcgctgaggtggatttgtgtggtcatgcaactttagcatctgctcacgttctcttctcaactggtttggttggttcagagacagttgagttcgacacattatcagggattctaacagctaaacatctcaaaaatgatgatgatggagaagaatcaagtatcgaattggatttccctgttgttccaacatatgaagtcaactacattgatgatgatctctctttgttctccaaagccttgaatggagctaccattcttgatgtcaaagccacaaagaaagacctcctcgttgtgctttcatcttgggaagctgttattgatttgaagccaagattagatgagatatcgaaatgcccttgtgaaggaatgatggtgactgccgctgcttctgatggatctacttatgatttctgtagtcgctactttgccccgagattcggaatcaatgaggaccctgttactggaagtgctcattgtgctttagctcattactggagcctcaggatgaacaagtgtgatttcttcgcctaccaggcttcaagcagaggaggaacgttgaaggtgcacctggacaaagagaagcagagggttctactgagaggcaaagcagtcactgttatggaaggttatgtcttagtgtga

SEQ ID NO: 103 - DNA, 942 bp, Arabidopsis thaliana
atggctaaagccagtagtactctgtttgctgtttcctgctccgcttcagctcgtttctctttcctccgacgctctgaatctcttaaaccctcagtttcaagagcgagattcgccgttccaatggctatggccgccgcgtcagctgccaccgctaaaaaactagcgcctgctgtgattgtgggtggcggaagagtcggaagggcgttacaggaaatgggtaatggcgaggatttgttggtgaagagaggagaagcagttccggttgattttgaaggacccattttggtttgtacaagaaatgatgatctcgatgctgttcttgaagctactcctcagtctagatggaaagatttggtcttcttccaaaatggaatgatggagccgtggtttgagagcaaaggtttgggtgatacagaccaagtgttggcctattttgctgtgtcaaagctcggcgagcctcccgtggatggaaagactgacactaacccagaaggtcttactgctgcttatggaaaatgggcttcagagatagctgcaagattgcaatctggtggcctctcttgcaaggtacttgacaaagaagcttttcagaagcaaatgttggagaaactcatttggatttgtgcatttatgcttgttggagctcgtcatccaggtgcaagtgttggcacggtggagaaagaatacagagatgaagtgtcgagactcatccaagaacttgcagcagctgctgccgcggaaaaaggactaacctttgaagagaacatggtggaaagactatgtgcttattcacgagctgtttctcatttcccaactgctgttaaagaatttaaatggaggaatggttggttttattcactctcagagaaggcgattgcggaagggcaaccggatccgtgtcccctccataccgaatggctgaaagagcttaaagtgatatag

SEQ ID NO: 104 - DNA, 1071 bp, Arabidopsis thaliana
atggagttggatcttacacctaagttgcccaagaaggtttacggaggagatggtggatcttactctgcctggtgcccagaggagttgccgatgctcaaacagggtaacattggagccgctaagcttgctcttgagaagaatggcttcgctgtccctcgttactctgattcctctaaggtcgcttatgttcttcaaggatctggaactgctggaattgttctcccagagaaggaggagaaggtgatcgcaatcaagcaaggtgattcgattgctcttccctttggtgtggtcacatggtggttcaacaacgaggatcctgagcttgttatcctcttccttggtgaaacccacaagggtcacaaagcagggcagttcactgagttctatcttactggcacaaacggtatcttcactggtttctccactgagtttgttggcagagcctgggaccttgatgagaacaccgtgaagaaacttgttggttctcaaaccggtaatggcattgtgaagcttgatgcgggctttaagatgccacagcccaaggaggagaaccgtgctgggtttgtcttgaactgtttggaggctcctcttgatgtagacatcaaggatggaggcagggtcgttgtcttgaacaccaagaaccttcctttggttggagaggttggctttggagctgatcttgttcggatcgatgcacactccatgtgttcgcctggtttctcttgtgactctgctcttcaggtgacttacattgtgggtggaagtggaagagtccaggtggttggtggtgatgggaaaagagttcttgagacccatatcaaagctggttctctcttcattgttccaaggttctttgtggtttctaagattgctgatgctgatggcatgtcttggttctccattgtcaccactcctgatccgatcttcacacatttggccgggaatacatcggtgtggaagtctttgtcccctgaggttttgcaggcagcgtttaaggtggctccggaggtggagaagtccttccgatccacgaggacttcatcagccattttcttccctccttccaactga

SEQ ID NO: 105 - DNA, 631 bp, Arabidopsis thaliana
aaactctttgtttcttgtttgttgattaacccttaattaagaactggagaagcatccactcgacaatggagactgcgatttgtgggagattagctctcgcaccatcctctctcttcaattctaaatcaggggacaaacatttagtctcaaaaggaccatgtgtgaatcgtagcattctcatgaccttgtctacatctgctgcattgggtaaaggaggtggtgtcttagacaaaccaattatagagaaaaccactcctggtcgtgaatccgagtttgatttaaggaaatcaaagaagatagctccaccttacagggtgatactacacaatgacaacttcaacaagagggaatatgtggttcaggtgttgatgaaggtaatacccggcatgactgtagacaacgcggttaacattatgcaagaagctcatatcaacggtttggcagttgtgattgtttgtgctcaggctgatgcagagcaacactgtatgcagctgcgcggtaacggccttctcagttctgttgaacctgatggtggaggctgctgaaactaattagactcagtatagattttcccaccttccaggactggcgcgccaaaaattggagctctgcagagctttcgttcgtatca

SEQ ID NO: 106 - DNA, 468 bp, Arabidopsis thaliana
atgggagtcgctgttcttcatcctcatgattctataatcaatcatttctccacaaacacgtcccctcctctccgtcataaaaaaccgatcaccaatcgccgtcgccggagtccgtcaagtcaccaatcccagatctctcatcctcctccgtctcctcataaccacaccaatcatgtacgaattctgaagcgtggcgaagatatcaacgttaagataccgattgaaaaaccagatctgaaatctaatcgtcagatcggatcagatccgatgaaaatttcgactccgatcagaatttcaaatcggaaatccatgccggctttgttttacgctggtccagtcacatcaacatctccgccgccgagtgaagtccctttaccggctttcttcgctaataaaaccgtcgccggattcaaaccgaccgatgcaaccaacgatctgatcaaaatcctgcgattagatatcgcatga

SEQ ID NO: 107 - DNA, 2053 bp, Arabidopsis thaliana
ttaattaaatggaatcaatgacgccaatctcgtgccctacgactcctcgttggaaccaagacagaccatttctcactggtcgcttccatcaggaaacgagggcaagctccaagtttgctgattctaagaggtttactttagactcgtctagttctggagtagagcaggcaattggctgctatgacacaccggttcaggagcttatcgtcattgatgatctcttatctgcgttggttggaattgaagggagatatatttcaattaaaagattccatgggaaggaggatagtatagctttccaagttgatccatcaatggatttggcactacaggaattggcgaaaagaatatttcctttatgtgaatattatctgctgattgaccaatttgtggagtcaagctcgcagttcaagaacgggctagttaaccatgcattcgcggctgcactcagggcactcctccttgattatcaagccatggtggcacaattggaacatcaatttcgacttggaagactttctatccaaggattatggttttactgtcagcccatgatgggatccatgcgcgcattggctgcagtaattcagcaggcttcaacgaagcagtttgtgggttctggtgttcttaatctcttgcaaagtcaggctaaagcgatggctggtgataattcagtgaggtcattgttagagaaaatgacggagtgtgcaagcaacgcatacctaagcatattggaaaggtgggtctatgaagggatcattgatgatccgtatggggaatttttcattgccgagaacaggtctctcaaaaaggagagcctcagtcaggactctacagctaaatattggagccaaagatacagccttaaggatactattcctggcttcctagcaaacattgctgcaacaatattgaccacagggaaatatctaaacgttatgagagaatgtgggcacaatgttcaggttcccatatcagagagatctaagttaacaatatttgggtcaaatcatcattatcttgaatgcataaaggctgctcacgaatttgccagtatagagcttgtgaatctcatcaaggataagtatgaccttgttggaaggcttcgatctataaagcactatcttcttctcgaccagggtgatttcttggttcattttatggacattgctcgagaggagctcaacaaaaaagtgcatgaaatatctgttgaaaagttgcagtctttgctagatcttgctctacgtaccacagcggctgcagcagatcctcgtcacgaagacttgacttgttgtgtggatcgagcttcattgcttacgactttgggaatgcacaaggacactgatagcaatagtattgaggacccaatgagcatcactggtctagagacattttccttgagctacaaggttcaatggccactatctattgtcatatcaaagaaagcattgtcaaagtaccagttaattttccgctttctttttcattgcaaacatgtggaacgccagctttgtggtgcttggcagatacatcaagggattcggtctatgaactctaagggtacagcaattcttagatcatcgcttctctgccgtagcatgcttaaattcatcagtagccttctacattatcttacattcgaggttctcgaaccaaattggcatgtaatgcacgatagactacaatccacaaggagtgtagatgaggtgatacaacatcacgacttttttcttgataaatgtctgagaggatgcttgcttcttttacctgacgtccttaagaaaatggagaagttgaaatcagtgtgtctgcaatatgctgcagccacacagtggttgatatcatcgtctatcgacatcaatagccagtctcatccacagaagacaatgataagagacacaaccgttacagagtccatattcaatttcgaaagggagttcaactcggagttgcagagcttaggaccagtcttgagcaaaggctcccaggctgagccatacttgactcatctctcccagtggatccttggtgtttcgaaagaataaggcgcgcc

SEQ ID NO: 108 - DNA, 600 bp, Arabidopsis thaliana
atggcttgcaccgtagatttccggtgccttgacgaaggattcggcggcaaaacctacaaacgcaaacgcgaatctcaagaacaagccgccgccgaagcaatcgccgatgaagcttccatggacatcgatggtgctcctcctgccgcgaaacgtagcgccgtcgcttcctctgaaaatccagacaaacctattgctctagctgtcgagagaccaacctacgacggtgtaatcgccgggaaagtctccggacggaactggaaacagccgcgaactcatagatcttcagggaggtttgtgaagaacaggaaaccagatctggaggagatgaagaggcaaagggagattaagaaagcgtataaggagagggtgaatgagctgaaggaagagattaggagtaataaggttgagaagaggaagaagaaggaagagagagagaagcggaagaaggagaatgttttgagaactggtactaagttgcagaagattacaaatcccaagactttgaagaaaatttctatgtctaagaagcagaggaagcagcttaagaaaattcctgacgagatgttgagtggtggtagcaagaagagtatcacgaattag

SEQ ID NO: 109 - DNA, 627 bp, Arabidopsis thaliana
atgagcttgaagggtacgatcgtattactagggctcttatggagcttccaggctacgttagggattagattcgtgatagaccgtgaagaatgtttctcccacaaggctgaatatgaaggtgatacgcttcatgtctctttcgtcgtcatcaagtctgactctcaatggcattttaacgaggatggtgtagatcttgtgatacatggcccaacaggcgaacaaattcatgacttcagggagcagataagcgcaaagcatgattttgttgtccaaaaaaaaggggtttacagattctgtttcacaaacaagtctccttatcatgaaaccattgacttcgatgtacagcttggtcactttgcatactacgatcaacacgcaaaggacgagcatttcactcccttgatggagcaaatatcaaagttagaggaggctctttacaacatccaatttgaacaacattggttagaagctcagaccgatcgtcaagctatcgtgaacgagaacatgagcaaaagagcagtacacaaagctttgttcgagtcgtttgcactgattggggcaagttttctccaagtttatcttctgcgtcgcttgtttgaacgcaaactcggcatgtctcgtgtctaa

SEQ ID NO: 110 - DNA, 2514 bp, Arabidopsis thaliana
ctctctaatgattccttcgtacgcatcctcatcttcttcttcttctctcttctactgtatttaaacactctctcgtcttctccttggatccagagagagacacaacacaccatctcaatcatgtcttcttcgtttctctcctccactgctttcttcctcctcctttgtctaggattctgccacgtgtcctcttcctcctccgaccaaggaacttacatcgttcacatggctaaatctcagatgccgtcgtctttcgacctccactctaactggtacgattcatctctcagatctatctccgactcagccgaattgctctacacttacgagaacgcgattcatggattctcaacacggctaactcaagaagaagccgactcgctcatgactcaacctggtgttatctccgttttaccggagcaccgttacgagctacacaccactcgtactcctctcttcctcggtctcgacgaacacaccgcagatctgttccctgaagccggctcttacagcgacgtcgtcgtcggagttctcgataccggagtttggcccgagagtaaaagctactccgacgaaggattcggtcctattccttcctcctggaaaggcggatgcgaggccggaaccaatttcaccgcttctctctgtaaccgtaaactaatcggagcaagattcttcgctcgtggttacgaatcaacgatgggaccaatcgatgaatctaaagaatcaagatctcctagagacgacgacggtcacggaactcacacctcatcgaccgccgctggatccgtcgttgaaggagctagcttattaggctacgcttcaggaacagctcgtggtatggctccacgcgctcgtgtcgctgtttacaaagtctgttggctcggtggttgtttcagctcagatattttagctgcaatcgataaagccatcgccgataacgtcaatgtcctgtcgatgtcactcggcggtggaatgtcggattattatagagacggtgttgcgatcggagcattcgccgccatggaaagagggattttagtatcttgctcagctggtaatgctggtccgagtagttctagtttatcaaacgtagctccatggatcacaactgttggtgctggtactttagatcgtgattttccggcgcttgcgattctcggtaacggcaagaatttcaccggagtttctttgtttaaaggagaagctttaccggataaattgttgccgtttatttacgctgggaatgctagtaatgctactaatggtaatctctgtatgaccggaactttgatcccggagaaagtaaaggggaagattgtgatgtgtgatagaggaattaatgctagagttcagaaaggtgatgtggttaaagcagcaggtggagttggaatgattctggctaacactgcggcgaatggtgaagagcttgttgcggatgctcatttgttaccggcgaccaccgttggtgaaaaagccggtgatataatccggcattacgtgactactgatcctaatcccaccgcttcgatttcaatcttaggaacagtcgtcggtgttaaaccatctccggttgtcgcagcgtttagctcacgtggaccgaattcgattacaccgaatattcttaaaccggatctgatcgctcctggagtaaacatcctcgccgcgtggaccggtgctgctggaccaaccggactcgcttccgattctcgccgcgtggagttcaatatcatctctgggacgtcgatgtcttgccctcacgttagtggtttagcggcgcttctcaagtcggtgcatcctgaatggagcccggcggcgattagatcggcgcttatgaccaccgcttacaaaacctacaaagacggtaaaccgttactcgacatcgcgacagggaagccttcgacgccgttcgatcacggtgcaggacacgtgtcaccaacaactgccactaatccaggactcatctacgatctaacgacggaggattacttaggcttcctctgcgcattgaattacacatcgccgcaaattcgaagtgtctcgagacgtaattacacttgcgatccgagtaaatcgtactcggtcgctgatttgaactacccgtcgttcgccgttaacgttgatggagtcggtgcgtataagtacacgcgcacggtgacgagcgtgggaggagctgggacttactcggttaaagtaacttcggagacgacaggagtcaagatttcggttgaaccggcggttttgaatttcaaggaagctaacgagaaaaaatcgtatacggtgacgtttactgtagactcgtcgaagccgtctggatctaacagctttgggagtattgaatggtcggatgggaaacacgtggtgggaagtcccgtggcgattagctggacatagtcgtaaattatgagaaatgaaaggggttttatggaaaagaaaaggtgtttacagatttattgtaatgccgtttttagatacgaagaaacctctgtttagcaaaaacgacatgcagtctgt

SEQ ID NO: 111 - DNA, 1553 bp, Arabidopsis thaliana
acaagtttgtacaaaaaagcaggctcctgcaggaccggggaagaagtagaagaagaagatgattaagttgtggatgatgacttctctccaactcgcggagctcttcgtgagctctattgtgcatttgctttatgggttttatatatttagctccgccgttgccggagatatctctcagacgttgaatgattacttgtttaagtccaatgtcgctttcggagaaaccggtcaaaatcaaaccaatgttgagggtttgcctcctattgtattggttcatggcatctttggatttggcaaagggagattaggaggcttatcttactttggcggtgctgagaagaaagatgagagggttcttgttcctgatttgggttccttaacaagcatctatgacagggcaagggaattgttctattatttgaaaggaggggtagttgattttggcgaagagcatagcgaggcttgtggacattctcggtttggaagaagatacgaacaagggcaataccctgaatgggatgaggatcatcctattcattttgtggggcattcagcgggtgcgcaagttgtgcgtgtattgcagcaaatgcttgcagatcaggcatttgaagggtttgaagaaacgaatgagaattgggttctgagtgtgacatcgttatccggggcattcaatggaactaccaggacctacttagatggcatgcggacagatgatggagtgagcatgaaaccgatatgtttgttgcagctgtgtcgtataggcgtgataatgtacgattggttggacatttcatggctaaagacttattacaatttcgggttcgatcacttcaacatttcttggaagaagaccggtgtgagaggtctcgttgattgcctaatgggaaacgcaggtccttttgcttctggcgattggatcttacctgatctcacaatccaaggctcaacaagtattaactccaatctccagacgttcccaaacacttactacttcagctacgcgactaaacgcacccgcagagtcatgggtatgacaatcccttcaggtgttcttggaatccacccgatgctcttcctccgcgtctttcagatgagccaatggaaattcccacaagatgtctctcctccttataaaggctacagggatgaggactggcaagagaacgacggggcattgaacacaatatcaatgacacatccgaggctacctgttgagcatccgagccggttcataaggagcgattcggaatgtcaaacattacaacccgggatctggtattataagatagtggaagcagatcacataatgttcatagtgaacagagagagagctggtgttcagtttgatctgatatacgacagcatcttccaacgttgcaggaaacatgtttttagaaagattcctcagactctccccaatcaatctccttcttctcctcgttcatcatcatcacccagaataaacaactttgtacattgatcacatgcaaaaaaaaaatgttttagggttgttacgttgaggctcgagacccagctttcttgtacaaagtggt

SEQ ID NO: 112 - DNA, 387 bp, Arabidopsis thaliana
atgacggtagaaggagtgaaccctaaggcgtatccgttagctgattctcagttatcgataacgattcttgatcttgttcaacaagctacgaattacaaacagttaaagaaaggagctaatgaagctaccaagacattgaaccgtgggatctctgagttcattgttatggctgctgatactgagcctctcgagattcttcttcatcttcctcttcttgctgaagataagaatgtgccgtatgtgtttgtgccatcgaaacaagcccttggaagagcatgtgatgtaaccagacccgtgatcgcttgttccgttacatcaaacgaggctagtcagttgaaatctcaaattcagcaccttaaggatgccattgagaagctcctcatctag

SEQ ID NO: 113 - DNA, 970 bp, Arabidopsis thaliana
atgcaaggtgtgattcgatccttcgtctccggtggaaatgttgtgaaaggctctgtgctgcaacatctccgtgtgattaacccggcgattcagccttctgtgttttgttcacgctctgaatcaactcaacctgcacgtatggaggaatctggattcgagagcacaactatttccgatgtcatgaaatccaaaggcaaaagtgctgatggatcttggctttggtgtactactgatgacactgtttatgatgctgttaaatccgtatgcttatactactctctttttccttttttagatatctcgatgtggatttggaattgattgtgtttgattttgtttagatgacacaacacaatgttggtgccttggtggttgtgaaacctggtgagcaacaagctcttgctggtatcattacagagagaggtaaaattagatctaatcattaataatttttttgttgtgtcttgtggtatgtgtgattcacttttcggcattgtgatttctctagattatctacggaagatcattgtgcaagggagatcatccaaatcaacaaaagttggagacattatgactgaagaggtatgtaaatgcacgattgtacgattttttttttgcttttgtggattgaaactgactggatctgtgaactggcaattgcagaataagcttatcactgtgacaccggagaccaaggtcttgcgtgctatgcaactgatgacaggtaagcagacaacttgatatttttccactaaagatacaagcttttgggtttaaaacctactgaagcaaataaaaatgcgggtttgtgtttttgtaatgtacagataaccgaatcaggcatattccggtaatcaaagacaagggcatgattggaatggtgtccataggagatgttgtccgtgcagtggttcatgagcatagagaggagcttcaacgcctaaatgcgtatattcagggaggttactag

SEQ ID NO: 114 - DNA, 1512 bp, Arabidopsis thaliana
atgtctcttttctccttccccatctccactgagttgcttccatggcttctcctacttttgattcctccacttcttatcttctttcttcttcgttcccctaaaaatcttccaccaggtccaccaagattacctatcttaggaaacatccaccagctcggatccctccctcaccgcagtctcagagatctctctctcaaatatggcccagtcatcaccgtctatctcggcagcgtccgtaccgtggttgttcactctccggagacggcggaggaagttctaaaacttcacgactccgagtgttgtactcgtccaaagctatctatcaccaaaagctttttctatgatggacttggtctagggtttactaaatggggtgattactacagagatgtgcggaaactctgtgttcttgaacttttctccgttaaacgagccaactcgttccggaacataagagaggaggagctgagtcgactcgttaactcgttttctgactcggcgtcatctggatcttccgttgaccttaccgcaaatttggctaagttcgtcgcgagctttacgtgtcgaatggcgtttggattgagttttcaaggaagtggaatggataacgagacgtttctggagctgttcacggaggcgaacagagtgatcggaaaattcgcggcggcggatatattccccgggtttggctggatcttggatcggatcagtggtcttgattctagccggaggaagagttttcaagatcttgatacgttttaccagaaagctattgttgaccatcgggagaagaagaaaactgaagaccgtgaagatctcattgacgtcttgctcaagttacagagtcaagaaaccaaacttggttcttcaagaatcaccgatacacatatcagagctattattatggatttgtttgtagcaggagtagacacatctgttatcactttggattggacaatggcagagctttcaagacatccaagagtaatgaagaaagtacaagccgagattcgtgaacacgtaggagacaaaggtatagtgacatacgatgatctcgaggctctagtctacatgaaaatggtgatcaaggagacttggaggttacacgcaccgagtcctattctgattccaagagaagcaatgactaacttcaagatcaagggttatgatatttaccctggaacgcgtattcatgtcaatgcttgggctattggacgtaaccctgatgtatggaaggatcctgatgagtttataccagagagatttgttgatagcaatgtggaaactaaagggacaagttttgagctgttgccgtttgggagtggacgcagaggttgtcccgcaatgtacgtgggattaagtacggtggagtacacattggcgaatcttttgtatcattttgattggaaagcgactgaggaagtgagtgttgaagaagcacctggtctcactagccacaggaagcatcctcttcaccttgttcctgttaatgtcatcaaccgcaagctttag

SEQ ID NO: 115 - DNA, 1862 bp, Arabidopsis thaliana
ttaattaaagacaatttcgattaagcccttctcgatcttcttcctttcgtcggatggaatcttctccggcttcttcttcgtctccgacgccggtaaccgattcatctgctgattctttagcgaaagatctgcagaatcaaagtctgggagctgttgatgaaggtgttaagattaaaaagaagctcgaagattttaactgggaccattcctttgttaaggaattgcctggtgatcctagaaccgatgttatctcgcgtgaggtattacatgcttgctattcaaaagtttccccatcagtagaagtggatgatcctcagcttgtagcatggtctgtctctgttgcagagctattagatttggatcctaaagaatttgaaaggccagatttccctctcatgttgtccggcgctaaacctttaccaggagcaatgtcttatgctcaatgctatggaggacaccagtttggcatgtgggctggacaactaggggatggacgtgccattactctgggagaagttttgaactccaaaggtgaaagatgggaacttcagcttaaaggtgcgggtagaactccatatagccgttttgctgatggccttgcagtgctccgtagtagcatcagggagttcctttgcagtgaaactatgcattgtcttgggatccctaccacgcgtgccctttgtcttctcaccacaggtcaaaatgtcactcgcgacatgttttatgatggcaatccgaaggaagaacccggcgcaatcgtttgcagggtttctcagtcatttctacgctttgggtcataccaaatacatgcctctagaggaaaagaggatcttgatattgttcgtaagttggcagactatgccattaaacatcatttcccacatatagagagcatggatagaagcgatagcctatctttcaaaaccggtgatgaagatgattcggttgtggatctaacttccaacaagtatgcagcatggatcgttgaaattgctgagcgtacagctaccttagttgcaagatggcaaggtgtaggtttcacccatggtgtgctcaacactgacaatatgagcattttgggtcaaaccattgactatggcccatttggtttcttggatgcttttgatccaagttacaccccaaacacgacagatctcccaggaagaagatactgttttgcaaatcagcctgacatcggcttgtggaatattgctcaattttctaagactctggcggttgctcaactgataaatcaaaaggaggcgaattacgccatggagaggtacggtgataaattcatggatgagtatcaagccataatgtctaagaagcttggtcttaccaagtataacaaggaggtcattagcaaacttttgaacaatatgtctgttgataaagttgattacaccaacttcttccggcttcttgcaaatgtaaaagcaaatcccaacacacccgaaaatgagttattgaaacccttgaaagctgtgctcttggacatcggaaaggagagaaaagaagcatggatcaaatggatgagaagctatatacaagaggtgggtggtagtgaggtatcagatgaagaaagaaaagcaagaatggattcagtgaacccaaagtacattctgaggaactatctgtgccaaagtgcaatagatgcagctgaacaaggcgatttctcagaagtcaacaatttgatccgtctaatgaaacgtccttatgaggaacagccggggatggagaaatatgctcggttgcctcctgcctgggcttacaggccaggcgtctgcatgctttcttgttcctcctagttcttctccttcctgcttttgttttgccatttatagaaaggaaggcgcgcc

SEQ ID NO: 116 - DNA, 1617 bp, Arabidopsis thaliana
ttaattaacctcatgatgacaaactccgattccgaccactgtactccggcgaaaacctcaatttctggggatggattagaaaaagagagcgactttaagaagcaactgaactctgagatagatccacaagcttcttcctcgcaaaacgatgcaataactatggaagatggagccgtctctgtaaacaatagggatctgcaagagataaaggaatcatccttctctaaaggaagtgagcaatatcgagttgatggagcccttgaagaaagtttgaattttgaggagaaggaacaagaatctgaagctcagagactattggaagcagagaagagaagattgctggctgaaatcgaacttgggtcaatctttaggaagagtgttgatgtggatacgttgcctaagatcgaagagacgatggataatgatgttgataagattgaattggttgatcatactgcgttggttgatgttgttcatcatcctaagagaccagggactgctcaaaatgagaaggatacacctagaaagcttaagaaaattggagataagagaaatgttattgaggggagtggagtagaaaacaatgggaagcagtttaggagattgtacactaggaaacaattggagtcaatgaggtttgcccacattgtgaatcagaagaacctgtggagtgagatgtattctaggattctacctgaggtggtgactgagtatgaaagtttagtttatgtgaagaattacaagagttcaaagtctaatcgtgttcgtgggcgaacggagagtggcaatgaagaaaatttggggactgaagaaggaacggaggaccctgaagactacactgacgataatgatgattacaatagcattttgagacctgcgtttgaagtagatggagaacctgattttagtactggaccaccagaagatgggcttgaatatttaagacgagtcaggtgggaggctaagggaattccgaatgtaagagtagccaagatagatgaaagcacgtacataaagaaagagcaaagtgtttatatgccactaattcctgaaatccccaaatgtccagagtacctgttacccatgaaggaatgggaggactcgttgcttttggactttgtacaccttcgccagactctaacacaaagtgccaacagctgtgaggatgagataatatcaagtcagtgtgtagaagatttgcttgtggagatgttcaataagcatctccacacagaggaggatgagtcttttggtgaggtggtaacagacatacaaggaatggactcggtgacgcgggtatcaaagctgaaaaagcgtatatgtttggttgagaaggagagcggtttacagagtagcgattgcaaatgggtagtagcgttgtgtgcatcattggagactcctttggatgccgatacttgtgcttgtctaaggggtcttctgaggaagtgtgctagtgttcgtgcagagacatcattagaggttggagatgaagaagttatcaccatggcaaatatgctcatcaccatcgccggcagatactttggccaaatgggacagtaataagtgaagaagagagtggacatgacatgcccttacttttctctcatatggcgcgcc

SEQ ID NO: 117 - DNA, 1685 bp, Arabidopsis thaliana
ttaattaaatggaacctccaaaggaacaacaaaacacgccggagaaatcaatctccgatgctccagccaccatatcctccgcctttcctccttccggatgctgcacaaactgcggcggaccaacgatttcagaagcaccaccaccactagcttcattcccagagatgtcaccaccaccaaactatcgtccgatccgagctccagcaatcaatctcccacacaactctcaagcaataatcctctctcccgttcctcacgccgaacaagtccccgtcgtatctccgccctatcatttccaatctcccgtcaaacgaatccactctcccgacgatatccgccgatttcacgaatccgcttcttgtaagaacttcttaggattcgtagtatctctctcagaatcgatccgtggatttaagatctcagatccttgtcatatctcaccaaccgtcgccgccatagtttcaatccttgaaacattgttacaatggatcgatgagattcctcctgctcaacaatcagctcgatacggtaacgtttcgtttaggtcatggcatgaacggctccgtgagagaggtgaatcgcttatacttgagtttcttcctgaggaatttaaagaatctgtgattgagattgttccttacttcttcgatagctttgggaactcaagtaggattgattacggaacgggacacgaaacaaatttcgcggcgtggttgtattgtttagctaggatggggatagtgaaagaagaggattatcatagtttggttgctagggtttttgttaagtatttggagttgatgaggaaattgcaaatggtttattgtttagaaccagctggatctcatggagtttggggacttgatgattaccatttcttgcctttcatatttgggagttctcagttgattgatcataagtatatgaaaccgaaatcgattcataacgatgatattttggagaatttctctagtgaatacatgtacttgtcttgtattgcatttgtgaagaaggttaagaaaggtttgttcgctgagcattcgccgttgttggatgatataagtggtgtaccgaactggaagaaagtgaatagcggtttgcttaagatgtatagagttgaagtgcttgagaaagttccgattatgcagcatttcctctttggctggctcatcaaatggtatgattcttcttttttccttttgtctcgtttttagctgatctctattgctttaaaatagaaacctttggttgtgtaatggtttgtcgattggattatctatcttgagattaatatctagaatgatatttcatgttggtgatcttaacctgtgatgatattgtgaattcattgatggcataccaactttagaatagatgataccggattttctagtatgcggtttcacatttgtgatcattagttggatacttatggagaataatttgctgaaaactgatgtgtaacagctgcacaatattgtttgcgccattgtctacccaaatttgcatcccatttttcattagacatgaatattgacagcttctcattggcctctatagctaaatctcttgttgagttctacacagctgaatcgttcgtttattttgcgccaaatgttttaaaacattatcgtggaatctaattgcgtaaaaaatggtgttggcagggaagagtgaggcgcgcc

SEQ ID NO: 118 - DNA, 406 bp, Arabidopsis thaliana
ttaattaaatgacgatcgcaccggcattgcagacgacgttcgtgtcatcaaccaacttcctgaaacattcttcttcgtggggatcaccatcaccgaacaatgtgattcttcccaaaaacaagagatcttcttcctccgtagttgtcgccgccgtcggtgatgtctcttctgacggaacaatctacttaatcggcggagccatcgccgttgcactcgtcggaactgcattcccgatcctcttcaaacgcaaagacacgtgtccggaatgtgacggagcaggatttgtgaggaaaggaggagtgactctgagagccaacgccgcacggaaggatcttcctcagatcgtttgtgctaactgcaatggactcggaaagcttaaccagattgataaatcataaggcgcgcc

SEQ ID NO: 119 - DNA, 1675 bp, Arabidopsis thaliana
tgtttcttgtttgttgattaacccttaattaatttgtttgttattcgaatggagctcctgagcacgatcaatctcttagcaatagctctagtgcttcttgtagttccgaagatatatggagcttgtcggatccttgtttggcggccatggatgctatcgagaagattcaagaagcaaggaatctctggtccaaaatacaggatcttgtatgggaacctccgagagattaggaagatgaagaacgaagctaagcttatggttcttgatccaaactccaacgatatcgtccctcgcgtcttacctcatcttcagcaatggaagtctcaatatggagagacctttctttactggcaaggaacagatccaaggttgtgcatctcagatcatgagctcgcgaaacagatcttatcgaacaagtttgtttttttttctaaatcaaagacaaaacctgagatccttaaactttctggtaatggacttatcttcgtaaatggtcttgattgggttcgtcacagacgaatcttaaaccctgcattctctatggacaaactcaagctcatgacccaattgatggtggattgcacttttagaatgttccttgagtggaaaaaacagaggaatggtgtagaaacagagcaatttgtgttgattagcagagagtttaagagattgaccgctgatatcatagcgacggctgcgtttggaagcagttatgcggaaggaattgaagtatttaaatcacaattagagctccaaaagtgttgtgctgctgctcttactgacctctatttccctggaatccagtaccttcctacgccttcgaatcttcaaatatggaagcttgatatgaaagtgaatagctcgatcaaaagaatcatagatgcgaggttaacatcggaatccaaagattacggaaacgatcttctgggaatcatgttaacagctgcaagctctaacgagtctgagaaaaagatgagcattgatgagatcatagaagaatgcaagacgttcttcttcgcaggacacgaaactactgcgaatctattgacatggagtacaatgttgcttagcttgcaccaagattggcaagagaaactcagagaagaagttttcaatgaatgcggtaaagacaaaatcccagatgcagagacatgctccaaactaaaactgatgaacacggtgtttatggagtcccttcgtctatacggaccagtgttaaatctgctccgattagcatcagaagatatgaaattaggaaacctagagatccctaaaggcacgactataatcctcccgattgcgaagatgcacagagacaaagccgtttggggaagtgacgccgacaaattcaaccctatgcggtttgcaaacggtctttctcgggccgctaatcatccgaacgctctcctcgcgttttcaatgggaccaagagcttgcattggccaaaactttgcgataatggaagccaagaccgttctcgccatgattcttcaacggttccggctcaatctctccgccgattataaacatgcgccggcggatcacctcactcttcaacctcagtacgatctacctgtgatacttgaacctatcgacggttgaagcaaatgcttctacactactctgtatatgaaccttcatgggcggcgaaattggagctctgcagagctttcgt

SEQ ID NO: 120 - DNA, 1214 bp, Arabidopsis thaliana
ttaattaacgaagaaatttacagagagacaaaaatggcgataaagaaactgttgatgatctccttctctcttacttcactcctcttctctcttctctacatcatccccacgaccaagactctattcacttcctcaaaaatcccttctttacccctcgaatccaaccaaaactccaactctaccctcccctgttttgcttacctaatctctgcatccaaaggcgacgccggaaaactcaaacgcctcctccgatctctctaccaccgtagaaaccattatttgatccatctagacttggaggcacccgaggaagagcatttggagatgatacggttcgtagccggagagcctctgtttcagccggaaggtaatgtaatgatcgttggaaaaccgaatctggtgacttacagaggaccaacgatgcttgcgacgacgttacacgcaatggctttgctcttgagatgttgtcggtgggattggttcattaatcttagtgcttctgattatcctctcgtcacacaagacgatctgatctatgcattttctgagttgcctagagatctcaacttcatacagcacacgagccgattaggatggaaaatgaacaaaagagggaaaccaataataatagatccagggctttatagcctcaacaaatcagagatttggtgggttagtaatcagcgaagcctccctacttctttcaagctcttcacaggttctgcttggacattcctatcaagaccgttcgcagaatattgtataataggttatgacaacttaccaagaacactgcttctctactacacaaacttcgtttcatccccggaaggctattttcagacgcttatatgcaactcggatgagttcaagaacacgaccgtgaaccacgacctccattacatcgcgtgggacaatccgccaaagcagcaccccaagatattagggacaagggattacagaaagatggtaatgagcaaccgaccattcgctaggaagttcaagagcaatgaccccgttctcaataggatagaccgggagattctgagaaggaaacggaaacttgggtcgaaacccgatcttggtcctggtccgggggctagaagattgaagagtttactaatgaggcttttgttgagaagaaactttgtcaatagacaatgtagataggaagtgtgacttacacagctctatatggagatacttggcgcgcc

SEQ ID NO: 121 - DNA, 1255 bp, Arabidopsis thaliana
atgtctccacttcactcttacattatcttcttctcccttctcatgaccatccttcttcaatcatcaacaacatcatcccaatcaaatctctgcagatcttcttgcggcaacattccgataaattaccctttttccatcgacgacggttgtggtagcccttattacagacacatgctcatttgctccgacaacgataccaagctcgaacttagaacaccatctggtaaataccctgttaaatctataagctactctgatcctcaccttcttgtctccgatccattcatgtggaactgtcaagatcgagacaattttcgacccactagatcttttagcatcgattcaagtacacacttcactgtctctcctcaaaacgactacttgttcttcaactgcaacaccgataaagttatcgtcgaaccaaaaccgctcttctgcgaaaggtttccagatagatgtgactcgtcctgcgatagttctagctatctatgcagacatttgcctgaatgtggctctgctttgggatctagggtttcttgttgttcgtattaccctaaagcgactcaatctcttaggctcatgctgcaggactgtgcgacgtatacaagtgtgtattggaggagtacaggtgtggagaatgcaccgtatgatcagtttccagagtacgggataagggttgattacgaatttccagtgacaatgaagtgccttctttgccaagaaacgactaaaggtggtggagtttgtgggtttaatacgaggacacgagattttttgtgcctttgtaaacaaggcaatgtcactacttattgcaaaggtcaaaatgtctatgttcatatcttttcgtcctaactacaatttctattgagaactatttaactactattagatagttttttttttggtagggactattagatagtactaatacgtattttcaatcattttgatacattctgcagatccaagcctcgtaaaccataaacgcgtaggagctatcgcaggtaaataagcaagtttactataactacaacatgaagtttgtggtcatcttattactatatgactttatatatacttgtaagttgtgacctgatttgaaccggaaaatttgtcgctaacaggaacagtgacggcagtttcagcggcaggagcgattggcgttgccggtggagtatattggtacttgaggaaagtgagagccaatgctccggtcacttgtggagttcaaagcaatgagaacagaattttctaa

SEQ ID NO: 122 - DNA, 868 bp, Agrobacterium tumefaciens
ttaattaaatgactgaaaaaagcacacccctcttctccttcggcattgtcgccgatccccaatatgccgacgccgatccccgcccggatatgggccgttattatgccgaaagcccgaaaaagctggctgaggcgatcaatgtcttcaacagcgaggacctcgccttcgtggtgacgctcggcgatatcatcgatcgcggctttgaaaatttcgatgcgatcctcagcgtttatgacgcgcttcgccacccctcggtgctgctgccgggcaatcacgatttcgccgtcgcccccgagcatctttccgccatccacgcccgcctcggcatgaaggccccctggcatgattttgccatgagcggcatccgcttcgtcgtgcttgacggcaacgatgtcagcctcttcgccccgccacctgatgatccgcgccgcctggtcgcgcaggagcggttgaagcgcctctgggatgtcgatgcgatcaatgcgcaggactggaacgcctcactcagtgacaagcaattcgaatggttgcgcaccattctgcaacaggcggatgcggccggcgaaagagtaatcgtgctgtgccactatcccgtctatccggaaaacgcccacaacatgtgggatgcgccgcgcatccttgatcttctcggttctcactcctccgttgccgcatggttcaacggccataatcacgagggtaattacgggacgctcggcaccacccacttcgtcaatttcaagggcatggtggatacgcccgaccagaacacctttgccatcgccgatgtcttcgccgatcggatcgcgattcgcggttttggacgcgaggaggatcgggtgttgcagtacttacggtaaatttaaat

SEQ ID NO: 123 - DNA, 934 bp, Agrobacterium tumefaciens
ttaattaagaagcatgcatgtgatgattttcggcgcgggatattcagggaaagccattgccaacgcgttgaaaaccaaggctgcaagtgtctgcggcaccacacgcagcgcggataagttcgcaaacctcgccgccgccggcatgacgccgctgctcttcgacggcgtccatctcgatgacgatctcatcgctgcgatgcgcaatgttacccatctcgtgcaatccatcgctccaggcaaggacggcgaccctctgtttgcgcttctgggcggcgatctgaaaaagctcctgcccaatctgaaatggttagcctatctttccaccgtcggcgtctatggcgaccatcacggcgcctgggtgaacgagacgacaccctgtcgcccggtctccgcacgctccgtggagcgggtagccgccgaggccgcgtggactgaggcagcccaaagcgcagatgtgccgctttccatcctgcgcctgtccggaatttatggcccgggacgcaataccttcatgaatttcgagaagggaacggcgcgacggctggtgaagaaggatcaggtattcaatcgcatccgtgtcgaggatatcggcgcggcaatcgcctttctggcactgaagaacgaacgcggcatcttcaacgtgaccgacgacgaaccctgcccaccgcaggatgtggtgagcttcgcggccgacctaatgggtgttgtcccccctgctgaacaggatttcggaaccgccgatctgacgccgatggcgcgctctttttatggcgaaaacaagcgcgtttccaatgctaaaataagggaactcggctttgatttccgctttccggagtatcggcagtcgctgaagcaattatgggaaagcagcctctggcgtggctgaaaacaaccccgtcaaaaacgacgaaaaatccatccaacgcatttaaat

SEQ ID NO: 124 - DNA, 804 bp, Saccharomyces cerevisiae
tataaattcacctcattgggaaggtaaaatgcatcttgcgtctgactcaatatccataaaatctattttcacgcattttgcctgcttcaaagaaatctatcgcaaatattcctactaatcatgtctatagcaagttatgcccaagagttgaagttggctttacatcaatatccaaacttccctagtgaaggcattctcttcgaagatttcttacccattttcaggaacccaggtcttttccagaagttgatcgatgctttcaaactgcatttagaagaagcttttccagaagttaaaattgattatatcgtcgggttggaatcccgtgggttcttgttcggaccaactttagctttggccctaggtgttggtttcgttccagtcaggaaggcaggtaagctacctggcgaatgttttaaggctacgtacgaaaaggagtacggttctgatctttttgagatacagaaaaacgctattccagcaggttccaacgttatcattgttgatgacattattgccactggtggttctgctgctgcagccggcgaattagttgaacaactcgaagccaaccttttggaatataactttgttatggagttggatttcttgaaaggcaggagtaagttgaatgctccagtgttcactttactgaacgctcaaaaggaagcgttgaaaaaatgatatgtttcacgtcctgacccatattcaagcttcctttctgccggtttcaagcaatttatttttcttacttctccttactctctcaatttggttgtataatatttactttttagattgaaa

SEQ ID NO: 125 - DNA, 1398 bp, Saccharomyces cerevisiae
tctctgtagtcctcctcgaggagtggccaagaatgttctgttccgcagtctttatataatcgcactggttgaagacgaaagctcatataattctttttccatagcctaaatacaccaacgatgactaaatctgtagatacgctgctgatcccaggccccattatcctaagcggagcagtccagaaggccctggacgttccctctttgggccacacctctcctgagttcgtctctatttttcaaagggtgctaaagaacacaagagctgtcttcaaatccgctgctgcctcgaagtctcagccttttgtgcttgccggctctggtacgttggggtgggacatatttgcctcgaactttattctttcgaaggcccccaacaagaacgtgctggtcgtatccactgggacattttctgacaggtttgctgactgtctgcgtagctacggtgcgcaagtagatgttgttaggcccctcaagataggcgaatcagttcccttagaactgattactgaaaagttgtcgcaaaatagctatggggctgtcacggttacgcacgttgacacttcaacggcagtgctgtccgatctgaaagccatttcgcaagcgattaagcagacttcgccggaaacgttcttcgtagtcgatgctgtatgctcgattggatgcgaagagtttgaatttgatgaatggggggtggatttcgccttgactgcttcgcaaaaggctattggcgctccagcgggtctttctatctcgctatgcagtagcagattcatggattatgcactcaacgacagcaaaaatggtcatgtacatgggtatttttcctcgttgagaagatggacaccaataatggaaaattatgaggctggtaaaggagcttattttgcaaccccacccgtacaactaattaatagccttgatgtagccttgaaagaaattctcgaagaggggttgcataagagatgggatttgcaccgtgaaatgagtgattggtttaaagacagtttggttaatggcttgcaattgacatccgtcagtaggtatccttctaacatgtctgcgcacgggttgacagccgtatacgtagcagatcctcctgatgtcattgcttttttaaagtcacacggtgtagtcattgccggaggtattcacaaggacatcggacccaagtatatccgtattggacatatgggtgtgaccgcttgcaacaagaatttaccgtacatgaagaactgcttcgacttaataaaactagctcttcagaggaaaaagtgattaccctcgtacttttcatttcatatatatatatatatatatatatgtacctatatattcttcttattatggcttttctaattcttgcaagattctttgacagctccatctttcgtttgg

SEQ ID NO: 126 - DNA, 2050 bp, Saccharomyces cerevisiae
ttaattaatgctattgccatcactgctacaagactaaatacgtactaatatatgttttcggtaacgagaagaagagctgccggtgcagctgctgccatggccacagccacggggacgctgtactggatgactagccaaggtgataggccgttagtgcacaatgacccgagctacatggtgcaattccccaccgccgctccaccgcaggtctctagacgagacctgctggaccgtctggccaagacgcatcaattcgacgtgttgatcatcggtggcggggccacggggacaggatgtgccctagatgctgcgaccaggggactcaatgtggcccttgttgaaaagggggattttgcctcgggaacgtcgtccaaatctaccaagatgattcacggtggggtgcggtacttagagaaggccttctgggagttctccaaggcacaactggatctggtcatcgaggcactcaacgagcgtaaacatcttatcaacactgcccctcacctgtgcacggtgctaccaattctgatccccatctacagcacctggcaggtcccgtacatctatatgggctgtaaattctacgatttctttgccggttcccaaaacttgaaaaaatcatacctactgtccaaatccgccaccgtggagaaggctcccatgcttaccacagacaatttaaaggcctcgcttgtgtaccatgatgggtcctttaacgactcgcgtttgaacgccactttagccatcacggctgtggagaacggcgctaccgtcttgaactatgtcgaggtacaaaaattgatcaaagacccaacttctggtaaggttatcggtgccgaggcccgggacgttgagactaatgagcttgtcagaatcaacgctaaatgtgtggtcaatgccacgggcccatacagtgacgccattttgcaaatggaccgcaacccatccggtctgccggactccccgctaaacgacaactccaagatcaagtcgactttcaatcaaatcgccgtcatggacccgaaaatggtcatcccatctattggcgttcacatcgtattgccctctttttactgcccgaaggatatgggtttgttggacgtcagaacctctgatggcagagtgatgttctttttaccttggcagggcaaagtccttgccggcaccacagacatcccactaaagcaagtcccagaaaaccctatgcctacagaggctgatattcaagatatcttgaaagaactacagcactatatcgaattccccgtgaaaagagaagacgtgctaagtgcatgggctggtgtcagacctttggtcagagatccacgtacaatccccgcagacgggaagaagggctctgccactcagggcgtggtaagatcccacttcttgttcacttcggataatggcctaattactattgcaggtggtaaatggactacttacagacaaatggctgaggaaacagtcgacaaagttgtcgaagttggcggattccacaacctgaaaccttgtcacacaagagatattaagcttgctggtgcagaagaatggacgcaaaactatgtggctttattggctcaaaactaccatttatcatcaaaaatgtccaactacttggttcaaaactacggaacccgttcctctatcatttgcgaatttttcaaagaatccatggaaaataaactgcctttgtccttagccgacaaggaaaataacgtaatctactctagcgaggagaacaacttggtcaattttgatactttcagatatccattcacaatcggtgagttaaagtattccatgcagtacgaatattgtagaactcccttggacttccttttaagaagaacaagattcgccttcttggacgccaaggaagctttgaatgccgtgcatgccaccgtcaaagttatgggtgatgagttcaattggtcggagaaaaagaggcagtgggaacttgaaaaaactgtgaacttcatcaagacgtttggtgtctaaatcgatcatgatagttaagggtgacaaagataacattcacaatttaaat

SEQ ID NO: 127 - DNA, 849 bp, Xanthomonas
aaatggccgaattgccgccagaagtacgcaatgtcaccgacccgctggatgcagtgggcaacaccaccaaggcggtgaccaaaggctatgcgatcggctcggcggcactgggccgcgctggtgctgtttgccgactacacccacaacctgcacgccggcaatccgaacgaggtattcgcgttcgatctgtctgaccacacggtcatcaccgggctgttgattggcggactgattccctacctgttcggcgcaatggcgatggaagccgtggggcgcgctgccggtgcggtggtcgaagaagtgcgccgccagttccgcgacatccccggcatcatggccggcaccgccaagccgcaatacgaccgcgcggtggacatgctcacgcgctcggcaatccgcgaaatgatcgtgccctcgttgttgccggtggtggtcccggtgatcgtcgggctgttgcttgggccgcgtgcgctgggcggattgttgatcggcaccatcgtgaccgggctcttcgttgcgatttcgatgacgaccgggggaggtgcctgggacaacgccaagaagtacatcgaagatggtcatttcggcggcaagggcagcgaagcacataaggccgcgatcaccggcgacaccgtgggcgacccctacaaggacaccgcagggcctgccatcaacccgctgatcaagatcatcaatatcgtcgcgttgctgttggtgccgctgctttaagcgctgtgcttgaggcgatctgcggacctcgtgggcccggagtgatgcgtgactccgggcccgggcctttgtcggctggcgacggcgcctggcctctaaggctcctgaggctgcaagcat

SEQ ID NO: 128 - DNA, 844 bp, Xanthomonas campestris
ttaattaaatgccgtctttcaagtcgtttttgttacaccgcgtcagcccggtctgcctatgcgttgccactggttggggcacggtggcgatggcgcagaccgtgttgcccgacgccacgccagtgcacgcgcacgaaaccacccagcatgacgggcacgagtggggctacaccggcccggagggcgccgagcactgggccgaactggccaaggaaaatgcgctgtgcggcaatgggcagcagaacagtcccatcgatctgaaggacgcgatcgacgccacgctgggcaagctgcaactggactacggcgcagtgccgctggtggtgcgcaacaccggccactccatccagctggatctacacgccggcggcacgatgcgggtcggcggcaagcagtacgacgcactgcagctgcatttccatcatcccagcgagcacctgttgaatggccggcgcttcccgatggaggcgcacatcgtgcaccagggcccggacggaacgctcggcgtgctggcgatcttcttcgagaccggcaaggccaatccggccttccagcgcgtgctcgacgccatgccgagcgacaagaaccagacccggcaggtggccgatgcggtcgtgcgcgctagcgattttctgccgcccgccaatcaacgcagcttctaccgctacgaaggctcgctgactaccccgccctgcagcgaaacggtggattgggtggtcctgagtcagccggtgcaggtgtccagggaacagatcaacgcgttcgagcgcgtttacccgttcaacgcgcgcccgctgcagccgctggatcgtcgcttcctgctcaagagccactgaatttaaat

SEQ ID NO: 129 - DNA, 2013 bp, Arabidopsis thaliana
ttaactacaattagacgactatttacatttcgatccataactattttattatcatattttagacactcaagtttttaaattgccaattattcgctctttcggattttttgtggatttgagatgatccctgcttcaatggaggaagctcaccagctggagtcgagatccgatgacctaagtcaacggagaagctactggagatggaggaagcaggattttttcccggaattctcttttcagagcttctctacctacaaatcagctctctccgccacttgtccacgcctcgccgatcgtcttctctctcgctcttccgatgcgtacgagctcgatgcagcccgccgcgaaagcgagaaccctatgcgtcgttgtctcacttggtgggacttgctctggcttagctttggttctgttgttggttcgggtgtgttcgtgatcacgggtcaggaggctcgagttggagctggtcctgctgttgttctctcctacgctatctctggtgtctctgcattgctctcagttctctgttatgctgagtttggagttgagattcctgtcgctggaggttctttctcttatcttagggttgaattgggggattttattgcctttattgctgctgggaatattcttcttgaggctatggttggtgctgctggattagggaggtcatggtcttcgtatctagctagtttggtcaagaatgattctgattattttcggattaaagtcgattcctttgctaaagggtttgatcttttggatccggttgctgttgcagtgcttttagttgctaatggtattgccatgactggaacaaagaggacttcttggttgaatttgattacttccatggtcactgtttgtattattgtgtttatcgtcgttgtggggtttactcattcaaaaacctcaaatttggttccttttttcccttatggagcgaaaggtgtggtgcaatctgctgcagttgtctactggtcatacactggttttgatatggtggctaacatggctgaagaaaccgagaaaccttccagagatattccaattggtttggttggttcgatgtctatgatcactgtggtttactgtttgatggctctggccttgactatgatggtgaaatacactgaaattgatgcgaatgcagcttattctgttgcttttgctcagattgggatgaaatgggcgaagtacttggttggtatatgcgctttaaagggaatgaccacaagcctgcttgttggctctctaggccaagctcggtacaccactcagattgctcggtctcatatgattcctccatggtttgctttggttcatccaaaaacaggaacccctatttatgctactctccttgtaaccatactcagttcaataatatccttcttcaccagcttagaggttttatcaagcgttttctcctttgctaccctcttcattttcatgctcgtggcagtagcattgcttgtgagacgttactacgtgaaggatgtcactcctgaggccggtttgttgaagtttcttggttttctgtttttgataattgcttcctccattggagtatcagcgctttggaactcaggcgttaaaggttggatcgcttacacagtgactggagttatttggtttataggcactttagggttggcattgcttccgaaatatcgtgttcctaaggtatggggagtcccactagttccgtggttgccatcgttttcaatcgccatgaatctattccttatcggatcactcggttatgtagcattcttgagattcattatctgcaccatggtgatgcttttgtactacctattcgttggtcttcatgcaacctatgatgtagctcatcagcctttggaggaagcaaagtttgagggagagagataaaagaatcgatcgtaacacttcactacgtttggtaaattgtataaattcccttgttttctgatgtgatttcaatattcttctattaaaatgtacaataatactatcgatcttgttttcgtg

SEQ ID NO: 130 - DNA, 379 bp, Arabidopsis thaliana
atttatttgtcagctttcaaactctttgtttcttgtttgttgattaacccttaattaaatggaaagaaaaaagttttcttcaaaatttattcatttgctcattgtgtttttgcttctttgtacgtttctttctcgtaccgaatctgctcttccttatcaccatgaactgttcttggggaggaagcggatgaattattataagcccaacagtgccataggaacaccatcatcaactagtgaccacgctccaggcagtaatgggaggaagttgatgagtatatatagacccaatggagacatatttacaggaccatcaggcagtgggcatggtgggggtcgcactccagccccctagggcgcgccaaaaattggagctctg

SEQ ID NO: 131 - DNA, 723 bp, Arabidopsis thaliana
atgttgtgcttcaaaggctcggttaagcggaagaagcaatccggttctgttccggtttatctgaatgtctacgatctaactcctatgaatgcttatggttattggcttggacttggtgtttttcattctggtgttgaagttcatggagttgaatatgcatttggagcacatgaatcatcaagcacaggtatttttgaagtggaaccaaagaagtgtcctggtttcacgtttaggaaatcgattcttgtggggaaaaccgacttggttgcgaaagaagttcgtgtttttatggagaaattagctgaagagtatcaaggaaacaagtaccatctcatcacaaggaactgcaaccatttttgcaatgaagtttgtcttaaacttgctcagaaatcaatccctagatgggtgaatcgacttgctcgcttaggggttctctgcaactgtgtgttaccacctcgtttgaacgaggcaaaagtgagacgagtaggaaaaggagagctttcggaaagtgagaagaagaaactaagaaaccgatcacgatcagatcctttactgtcttcttctccgtcttcatcgacacctgataatcatcgttcacacattcgagcaaaatcaagtggtaatcatccttcttcttcttcttcttcgtcttcgggttctaagaaaaatcgaagacctaaagctcaagaccagaagtcgccaagcgtaagcatcaagacttga

SEQ ID NO: 132 - DNA, 705 bp, Arabidopsis thaliana
atgggagagaaagaggaagtgaaactattaggagtatggtacagtccatacgccataagacctaagatcgctcttcgtctcaaatcagtggattatgattacgttgaggaaaatctgtttggatccaagagtgagcttcttctcaaatcaaacccggttcacaagaaagtccctgttctcctccacaacaacaaaccgattgtcgagtctctcaacatcgttgaatacattgatgagacgtggaactcatctgcaccgtccattcttccttcacatccttatgatcgtgctcttgctcgcttttggtctgacttcgttgataacaagtggtttccggcgttgagaatggcggcgatcactaaatcggaagacgcaaaagcgaaagccatggaagaagtggaagaagggttgttgcaactcgaggatgcgtttgtttctataagcaaagggaaaccctttttcggcggtgaagcaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggagatcgaaaaagtagctgagtttctacaagaacttgaggttagagctcaatccgcagcttcaagatcttga

SEQ ID NO: 133 - DNA, 909 bp, Arabidopsis thaliana
atggagaaccaagacaagatacaaaatgtcttggacatcatgagacttgctctcgtcatcatcgctgctgtgatgcttttccttgcgtttatcggatttcttctctctatttttggactgcaatgccttgtatatacgttggtgatccttggttggattctcgtcacggttaccttcgtcttatgtggtggatttttacttctacacaacgttgtaggggatacgtgtgttgcgatggaccaatgggtccaaaacccaacagctcacacggctctagacgatattctaccgtgtgttgataatgcaaccgcgagagaaacattgactcggactaagcttgtaacataccagttggtcaatcttcttgacaatgccattagcaacatgaccaacaggaatttcccgcctcaattccggcctctttattacaaccagtcaggtccactaatgcctctactctgtaaccccttcaacgctgatctctctgaccgccaatgccagcctggtcaggtccatctgaacaatgcaaccgaggtgtggaagaacttcacttgccaaattgtaacaccgggaacatgtagtacaccgggacggttgacaccaaagctttacagccagatggctgcagcggttaatgtaagctatggtttgtacaagtacggaccgttcttggcagacctacaagggtgtgacttcgtgaggtctacattcactgatatagagagggatcattgtccgggacttaagagatacacacaatggatctatgtgggtcttgtggtggtgtctgcttctgtaatgtcatctttggtgttttgggttatatatgcgagagagaggaggcaccgggtttacacaaaagactacaacgctatgcactctgaagatccacgaagcaagggccactga

SEQ ID NO: 134 - DNA, 783 bp, Arabidopsis thaliana
atggctgaacgagtctatcccgccgattcaccaccacaaagcggacaattctccggcaacttcagctccggcgaattccccaaaaaaccagcaccaccaccatcaacatacgtaatccaagtcccaaaagatcaaatctaccgtataccaccgccggaaaacgcacaccgctttgaacaactctctcgtaaaaaaaccaaccgcagtaactgtagatgctgcttctgctcattcctcgccgcggttttcatcttaatcgtcctcgccggaatatccttcgcggttctctacctaatctaccgtcccgaagctcctaaatactccatcgaaggattctctgtttccggtatcaatctgaattcaacatctccgatttcgccgagttttaacgttaccgttagatcacgtaacggtaacggtaaaatcggggtttactacgagaaagaaagctctgttgatgtgtattacaacgacgttgatataagtaacggtgttatgccggtgttttatcagccggcgaagaatgtaacggtcgttaagttggttttaagtggttctaaaatacagttgactagtggtatgaggaaggagatgcgtaatgaggtgagtaagaaaacggtgccgtttaagttgaagattaaagctccggtgaagattaagtttggttctgttaagacgtggactatgattgttaatgttgactgtgatgtaacggtggataaattgacggcgccgtcgaggattgtgtcgagaaaatgcagtcatgacgtggatctttggtga

SEQ ID NO: 135 - DNA, 651 bp, Arabidopsis thaliana
atggaacctcgaatcaatgaccttcaggtggaatctcgggttcatgagttgctcgattttccggttcatacaaaccagatatcctctgcaatctacgagtgtcccaacgaccacatcgaaaaccctaagaagaaaccgtacaattgtccacactcaggagccaagtgtgatgtcacaggagatattcaaaggctactactgcatctaaggaatgatcacaatgttgaaatgagtgatgggcgtagtttcagtcacagatatgttcatcatgatcctaaacatcttcatcatgctacttggatgttaacacttctcgattgttgtggtcgaaaattctgcttgtacttcgaagcgtttcacctgaggaaaacaccaatgtacatggccttcatgcagtttatgggagatgaagaagaggcaatgagcttcagctatagtttgcaggtcggagggaatggcagaaagctgacatggcaaggcgtgccgaggagcattcgtgacagtcacaagacggttcgtgatagtcaagatggcttaatcatcactcgcaaattggctttgttcttctctaccgacaacaacaccaccgacaaggagctgaagttgaaggtttcaggtcgtgtatggagagaacagcctgtttcgatatga

SEQ ID NO: 136 - DNA, 1503 bp, Arabidopsis thaliana
ttcatttatttgtcagctttcaaactctttgtttcttgtttgttgattaacccttaattaagaatagacgaaaatgcccctgtcggcgacggcggatacaagcaagacggtgaagctggagaggtacaatagctacctccggaagattcacagcaccaaagttctcaacgcttcttctaaagttcttttccgagcaacgcttctcgtagctcttgtcctcgtcctcatcttcgccatcaactaccctccactctccgatagccgcgccgccgcagcacaccacctccaccgtcgtagcttcttatccaccggactcttctcctcctcctcttcttcctcctctatcggtggagccgcgtgggaaaagcgcgttagacaatcctcaacagccaaacgaccacacggtctctccgtcctagtcaccggagctgccggattcgtcggatcccactgctcacttgcgctgcgaaaacgtggcgatggagtcttaggattcgacaacttcaacgattactatgacccatcactcaaaagagcaagacaagagctcttggagaaacaacaagtgttcatcgtcgaaggtgatctcaacgatggaccactcttacgtaaactcttcgacgttgtccctttcactcacatccttcacttagccgctcaagccggagtacgttacgctatgaaaaaccctcaatcttacatcgcctccaacatcgccggattcgttaaccttcttgaagtggctaaagcagctaatccacaacctgcgattgtttgggcttcctctagctctgtttacggtctcaacactgagaatccattctctgaagaacaccgaacagaccaaccagcgagtctttacgcagcaaccaagaaagctggtgaagagatcgcacatacttacaaccacatctacggtctctccttaaccggactccggttctttacggtttacggtccatggggaagaccagacatggcttacttcttcttcactaaagacatcctccacggtaaatcaatcgacatttacagaactcaggacaatcaagaagtggcgcgtgacttcacctacatcgatgacatcgttaaaggttgtgtcggtgcgttagacacggctgagaaaagcaccggaagcggcggaaagaagcgaggacaagctcagctacgtgtttacaatctaggaaacacgtccccggttccggttgggagattggtctcgatcttggaaggattgttagggacaaaagctaagaagcatcttatcaaaatgccaagaaacggtgacgtgccttacacgcatgctaatgtgagtttagcgtataaagatttcgggtacaaaccgacgacggatctcgcggcggggctgaggaagttcgtcaagtggtacgttggttattatgggattcagccgagggtaaaaaaggaaacttctcacgccgaagattccgcttaataattttctaaatacccagcaaattggagctctgcagagctttcgtt

SEQ ID NO: 137 - DNA, 531 bp, Arabidopsis thaliana
ttcaaactctttgtttcttgtttgttgattaacccttaattaatattttcctcctcttcttcttcgctctagtttcccccaacaatcgccatggcagcttcgtctctcaatctcctcctcattctctctcttctcactttcatttctctccagagatctgaatctctttccgataatccatctctcactcttctacccgacggattcgactggccgatctctcactccgatgaattcgatatcatcgacggtgaagaaagcttcgaagttacggaggaagacgacggcgtaacagatcgacggtcattgtactggcggaggacgaagtattacatatcgtacggtgcattgtcggcgaatagagtgccatgtcctcccagatctggaagatcgtactacactcataactgcttcagagctagaggtcccgttcatccgtatagccgaggctgctcgtcgatcactcgatgccggagatagggcgcgccaaaaattggagctctgcagagctttcgttcgtatcatcggttt

SEQ ID NO: 138 - DNA, 718 bp, Agrobacterium tumefaciens
ttaattaaatgagcgttccttcgaggctatccgcccggtctgggcgcggatcgagggaatgtcgccggtggaatgagtgccgttgcctttttagttggtccacagccgtcaaattgatagggtggcccgaacttcctgatccatttcccattttaactggaaataccatgaccgttatcgcttcggagctttccgctgccatccgttccattcccgactatccgaagccgggcatcatcttccgggacatcacgacgctgctcggcaacccgcgcgcatttcgccgcgccgtcgatgaactcgtgcagccctatgcgggaacgaagatcgacaagatcgccggcatggaagcgcgcggcttcattctgggcggggcggtggcgcatcagctttcggccggtttcgtgccgatccgcaagaagggcaagctgccgcacaccaccgtgcgggtcgcctacagcctggaatatggtgtcgacgaaatggagatgcatgtggatgccgtacagccgggcgagaaggtcattcttgtcgacgacctgatcgccaccggcggcaccgccgaaggtgccgtgaagctcttgcgacagatgggtgcggaaatcgtatccgcctgcttcgtcatcgacctgcctgatctcggcggccgcaagaagctggaagatcttggcgtcgacgtgcgcacgctggtagaattttctggccattgaatttaaat

SEQ ID NO: 139 - DNA, 1101 bp, Agrobacterium tumefaciens
ttaattaagatgcgcgcgctttattacgaacgattcggcgagacccctgtagtcgcgtccctgcctgatccggcaccgagcgatggcggcgtggtgattgcggtgaaggcaaccggcctctgccgcagcgactggcatggctggatgggacatgacacggatatccgtctgccgcatgtgcccggccacgagttcgccggcgtcatctccgcagtcggcagaaacgtcacccgcttcaagacgggtgatcgcgttaccgtgcctttcgtctccggctgcggccattgccatgagtgccgctccggcaatcagcaggtctgcgaaacgcagttccagcccggcttcacccattggggttccttcgccgaatatgtcgccatcgactatgccgatcagaacctcgtgcacctgccggaatcgatgagttacgccaccgccgccggcctcggttgccgtttcgccacctccttccgggcggtgacggatcagggacgcctgaagggcggcgaatggctggctgtccatggctgcggcggtgtcggtctctccgccatcatgatcggcgccggcctcggcgcacaggtcgtcgccatcgatattgccgaagacaagctcgaactcgcccggcaactgggtgcaaccgcaaccatcaacagccgctccgttgccgatgtcgccgaagcggtgcgcgacatcaccggtggcggcgcgcatgtgtcggtggatgcgcttggccatccgcagacctgctgcaattccatcagcaacctgcgccggcgcggacgccatgtgcaggtggggctgatgctggcagaccatgccatgccggccattcccatggcccgggtgatcgctcatgagctggagatctatggcagccacggcatgcaggcatggcgttacgaggacatgctggccatgatcgaaagcggcaggcttgcgccggaaaagctgattggccgccatatctcgctgaccgaagcggccgtcgccctgcccggaatggataggttccaggagagcggcatcagcatcatcgaccggttcgaatagtaccggtcgcagccattcggtttcgcttcacttggtcctgatttaaat

SEQ ID NO: 140 - DNA, 985 bp, Agrobacterium tumefaciens
ttaattaactgcatttcagtccctttcgaaagttctccatgcgcgcctttgttatcggcaatatcgcacttgatgaaacctattccattgccgcactgcctcaggcaggcgcttcaatcttcggcgagcaggcctcgcgcagtctcggtggcaaaggctgcaaccaggccattgttcttgcacggtgcggcgtcgaaaccaccttggtcgccgccgtcggcacggatgaccgcgccattgcgatcggtaaatcgctcacccgcgagcatctgacaccaaagctcattcccgttgatagcgccaccagcgatatttccatcattctgacgacccctgacggtgaaaactcgatcatcaccacccggtccgcagccgcagcgcttgatagagacgcagccctggacgcacttggcgacactgtctccggcgacctcgtcatcctgcagggcaatctctcggaagagacaaccctcgtcatcctcaatgcggcgagatcgaaggggctgacgacggccttcaatccttcaccgctgcagccgtggtttgcaagcattctgccgctcatcgacatcgccgtcctcaatcgcatcgaggcagaggcgctgaccggtgagagcggcgccggggcgggcgcttttctgctgcgtgccggcgtcggcctcgtcatcatcacactcggcggacagggctgcgtgctcgtgtctgccaatggtgcaatcgaggtcgcggcagcgcccgctacaatcgtcgataccacgggtgccggcgattgctttacgggtgttgcgcttgcctccgccatacgtcgcggcgtcgctatcgatgcgcgcgcgctggaggatgcttcgagagcggcagccatcaccgtcggccgccgtggcacgcaggatgcctttcccagccatgaggagatgatggccattctgcgggcctgagcctgtcgatcacggcttttccgtcagccagccgagaatgttatttaaat

SEQ ID NO: 141 - DNA, 763 bp, Saccharomyces cerevisiae
ttaattaaatggctagaactttctttgtcggtggtaactttaaattaaacggttccaaacaatccattaaggaaattgttgaaagattgaacactgcttctatcccagaaaatgtcgaagttgttatctgtcctccagctacctacttagactactctgtctctttggttaagaagccacaagtcactgtcggtgctcaaaacgcctacttgaaggcttctggtgctttcaccggtgaaaactccgttgaccaaatcaaggatgttggtgctaagtgggttattttgggtcactccgaaagaagatcttacttccacgaagatgacaagttcattgctgacaagaccaagttcgctttaggtcaaggtgtcggtgtcatcttgtgtatcggtgaaactttggaagaaaagaaggccggtaagactttggatgttgttgaaagacaattgaacgctgtcttggaagaagttaaggactggactaacgtcgttgtcgcttacgaaccagtctgggccattggtaccggtttggctgctactccagaagatgctcaagatattcacgcttccatcagaaagttcttggcttccaagttgggtgacaaggctgccagcgaattgagaatcttatacggtggttccgctaacggtagcaacgccgttaccttcaaggacaaggctgatgtcgatggtttcttggtcggtggtgcttctttgaagccagaatttgttgatatcatcaactctagaaactaaatttaaat

SEQ ID NO: 142 - DNA, 691 bp, Saccharomyces cerevisiae
ttaattaatttttgctcaagaatatattagccttacaagaacgtaaaaaaccaatcatggtagcagaagttcaaaaacaagccccaccatttaagaaaaccgccgtagtcgacggtatcttcgaggaaatttcactggaaaagtataaaggtaagtacgttgttctagcttttgtcccattggctttttcatttgtctgtccaactgagattgttgcgttttccgatgccgccaagaaattcgaagatcagggcgcccaagttttatttgcctccaccgactctgaatattccttactggcatggaccaaccttcccagaaaagacggtggattaggtccagttaaagttcctttgcttgctgataagaatcattccttatccagagactatggcgttttgattgaaaaagaaggtatagctttaagaggtttgttcataatcgacccgaagggaatcattagacatatcactatcaatgatttatctgttggcagaaacgtcaatgaagctttgagattagtcgaaggtttccagtggactgacaaaaatggtacagttttgccatgcaactggaccccaggagccgccaccatcaaacctgacgttaaagattccaaggagtatttcaaaaatgccaataattaatcttcgcacgataacgctaggccctattaaataattatttaaat

SEQ ID NO: 143 - DNA, 436 bp, Arabidopsis thaliana
ttaattaaatggcggcttctccgttggtggttcagaaaacagaggaggagtggcgtgcggttctttctccggagcagtttcgtattcttcgtcaaaaaggcactgaaaagccaggaactggagaatatgacaagtttttcgaggaaggaatcttcgattgcgtaggatgcaagactcctctttataaatcaaccacgaagttcgattccggatgtggctggccagctttctttgaaggactccctggtgccataaaccgaacccctgatccagatgggagaagaactgagatcacttgtgctgcgtgcgatggacatttaggccatgttttcaaaggagaaggttacggtaatccaaccgatgaacgtcattgcgttaacagtgtttcgatcagttttaacccggcaaaatcttcctctataatctgaggcgcgcc

SEQ ID NO: 144 - DNA, 264 bp, Arabidopsis thaliana
atggattcatactcttcgccgccgatgggaggttcaggtagttcggtttcgcccgaagtaatgatggagtcggtcaagactcagctcgctcaagcttacgccgaagagttaatcgagactttgaggacaaaatgttttgacaagtgcgtaacgaagccaggatcaagcctcggtggaagtgagagtagctgtatttcgagatgtgttgaacgttacatggaagctactgcaatcataagtcgttctcttttcactcaacgttga

SEQ ID NO: 145 - DNA, 604 bp, Arabidopsis thaliana
ttaattaagatgaatcacggccaacaatctggtgaggcaaagcatgaagatgatgctgctcttacagagttccttgcttctctgatggattatactcctactattcctgatgatttagtggagcactacttggctaagagtggatttcagtgccccgacgtacgattgataaggctagttgctgtggctacacaaaagtttgttgcagatgttgccagtgacgcccttcagcattgcaaggctagaccagcaccagttgtgaaagacaaaaaacagcaaaaggataagcgtttggtattgacaatggaagatctttcaaaagctttgcgtgagtatggtgtgaacgtgaagcatccagaatattttgctgatagcccttcgactggaatggaccctgcaacaagggacgaatagaaaccaggaattcctcaaaatctttgcctagtaaggacggtcatgtgtctcagatccctgattctctgttgtgtttcagttaaaaacaaaactcacttgtcttgctagtcctcaattactacattacatgtatattcgtttgttgtttgttctctggtgatttttggggttctacatcacttatccacca

SEQ ID NO: 146 - DNA, 1293 bp, Arabidopsis thaliana
atgcagaatcaaaggcttattaagcaacaacaacaacaacaacaacagcaacatcaacaagctatgattcaacaagctatgatgcaacaacatccttctctttatcatcctggtgttatggctcctcctcagatggagcctttaccaagtggaaaccttcctcctggttttgatccaactacttgccgtagtgtgtatgctggaaacattcatacgcaggtcacagagattcttcttcaagagatttttgcaagtactggtcctattgaaagctgtaaactcatcagaaaggataagtcatcatatggatttgttcactactttgatcgaagatgtgctagtatggctataatgactcttaacggaaggcatatatttggacagcctatgaaagttaattgggcgtatgcaactggtcaaagggaagatacatcaagtcatttcaacatttttgttggagatcttagtccagaggttactgatgcagcattgtttgatagcttttctgcttttaacagctgctcttcttattatagggacgcaagagtaatgtgggaccagaaaactggacgctcaagaggctttggttttgtttccttccgtaatcagcaggatgctcaaactgccataaatgagatgaatggtaaatgggtaagtagcagacagatcagatgcaactgggcgacaaaaggtgctacttttggcgaggacaaacatagctctgatggaaaaagtgttgtagaacttactaacggatcttcagaggatggtagagagctgtcaaatgaagatgcccctgaaaacaatcctcaatttacaactgtctatgtaggaaatctctctccagaagtaactcagcttgatctacaccgtctattctatacccttggtgctggagtgatcgaagaggtccgtgtccagcgagacaaagggtttggttttgtgagatataacactcatgacgaggctgctcttgctattcagatgggcaacgctcagcctttcctctttagcagacagataaggtgttcctggggaaacaaaccaactccatcaggcacagcctcaaacccacttcccccaccagccccggcatcagtcccttctctgtctgcaatggacctcttagcctacgagaggcaactggctctagccaagatgcatcctcaggctcaacattctctgaggcaagcaggtcttggagtcaatgttgctggaggaactgcagctatgtatgatggtggctatcagaatgtagctgcggcccatcagcagctcatgtactatcagtaa

SEQ ID NO: 147 - DNA, 906 bp, Arabidopsis thaliana
atgaagaacaaagcgtttggtcagattatggatgatgcagagaatcccgggttcttcaagatccttcgaagtgcagatttatcgtctgaaatcatgagagggatccctctaaacttcatcaaaagcatctcggaagaagagttatcggctaagatgttgttaaaagtgtcatggggaagttcttggcctatcaaaatttgtagaaacccaagcttctactttatggagaaaaagggatgggatcagtttttgagcgacaatggattaggtaatgatgagtttcttaccttcacacaccaaggaaatatgtgctttaccgtggacatctaccaaatagacggtaaagagctacttacaccacgcagatctgcaaccattgcttctagttccggtcggaacaagagagaacaaaggaataacatctacaaagatgtgaaggaggaagaagacatagagtcttggtctgaatcgagctatcctggtcacaaaacagctgaatctacaggaagaagacaaaggcttagcttgagtaataagaaagccaaggaaactgagaaatcaaagaagaagaagatgaaggtggaaagtattagttacgattctcaagatgacagtttgtctcttgttccagaatttaccctcaccataaagaaatcatacctcattttcttggggattccaaagatgtttgaggagctgcatatgccaacggaggcaactatgttcaagatccatgatccggaagggaaaaggtcatgggatgttatgtataagttcagtaataaccagacaagattctgtgctggttggattcgtttggctaaagaacttggtttggagatcggagatgtttgcactttcacgctcatcaaacctaccgagatgcttgttagagtctctaaataa

SEQ ID NO: 148 - DNA, 1383 bp, Arabidopsis thaliana
atggcacagcaggaagctagtccttcccctggtgctgaggttgttggtcgtgcctttgtggagcaatactatcatattcttcaccaatctcccggtttagttcatcggttttatcaagattcgagctttttaacccgacctgatgttaccggtgctgtgactactgtcacaactatgcaagcgatcaacgacaagattctgtcgttgaaatatgaagactacacggctgagatagaaactgctgatgctcaggagtctcatgagagaggtgttattgtgctggttacaggacgcttaaccgggaacgataatgttaggaagaagtttagtcaatcttttttcttggctccacaagacaaaggatactttgtcttaaacgacgtgtttcgattccttgaggagaaagaggtgactgcacaagcccgctctgtccccatcaatggaaccactagggatgttcaggctcctattgaaccagaacgtgttgttgttagtcacgagcccgaggtagaacccgagccagttgcttctatcgaggaagaagatcttgacaatgtggcggaagtgtatgatccttctgataaagatgaaggagttgttgttgacgttgagcctattgaacctcccactcaaataagtcataatgaaatcttatcagtgcctcaaggagatgctcctaagcattcttatgcttcaatcctcaagcagatgaaaagcagtccagcaccaacaacacacgttgctagaaacaagccaagaccagctccagtcaaccagaagctgaccgcgcctcctgctgagcctgcagcaagacccgaggcttcagctcatgagaatgttccgaatagtagccatgttgatgtggaagatgatggtcattcgatttatgttcgaaatttgccgtttgactccacaccaacacaacttgaagaggtgttcaagaactttggtgcaatcaagcatgaggggattcaagtcagaagcaacaagcagcaaggtttctgttttggttttgtggaatttgaaacatctagcggaaagcaaagtgccctcgaggcctcaccagttacaattggagatcgtcaagctgttgtagaggagaagaaaacaaatagtcgaggaggaggcaacaatggaggtagcaggggaaggtacttttccggaagaggaagtttccgaaatgaaagcttcaaaggaggacgcggtggtgggggaagaggaggctatggaagaggaggaggtgagttttctggtagaccaaagagctcaaacccacgaaatggaggagaaggttaccaaagggttcctcaaaacggaggaggtggaagaggaggccgcggagaaggaggtcgtggtggagctcgaggtggtggttcatcttga

SEQ ID NO: 149 - DNA, 1065 bp, Arabidopsis thaliana
atgggtgattgggctcaacttgctcagtctgtgatcctaggtttgattttctcttaccttctcgctaagctgatctcgatcgtcgtcacgtttaaagaagacaatctctctcttactcgtcacccagaggagtctcaattggaaattaaaccggaaggagttgactcgcgacgtctcgattcctcttgcggtggtttcggtggtgaggcggattcgcttgtggcggagcagggtagctcccgaagtgatagcgttgccggtgacgacagtgaggaagatgatgattgggaaggcgtcgagagcacggaactcgatgaggcttttagcgccgccactctttttgtgactaccgccgccgcagatcggctttcgcagaaggtaccgagtgatgtgcagcagcagctttacggattgtataagattgctacggaagggccgtgtactgctcctcagccatcagctctcaaaatgactgctcgtgccaagtggcaagcatggcagaaactgggagctatgccacctgaagaggcgatggagaagtatattgagattgtcactcagctttacccaacttggttagacggtggcgtgaaagccggaagtcggggtggggatgatgcagcctccaactcaagaggaaccatgggaccagtttttagctctttggtttatgatgaggagtccgaaaatgagttgaagattgatgccatacacggatttgctagagaaggagaagtcgagaatttactgaaaagcattgaaagcggcattcctgtaaatgcaagggacagtgaaggtcgcacaccattgcactgggctatagaccgtggccacctcaacatcgccaaagttctggtcgataagaacgccgatgtgaatgctaaggacaacgaaggccaaacccctttgcattatgctgttgtatgcgacagagaagctatcgccgagtttctggttaaacagaacgcaaacacagccgctaaagatgaggatggaaactctccccttgatctctgtgaatcagactggccctggatccgagattctgcaaagcaggcagactaa

SEQ ID NO: 150 - DNA, 1327 bp, Arabidopsis thaliana
aactctttgtttcttgtttgttgattaacccttaattaaatggcgaggaagaagcatcgaaagctcttccctaccttagcatcagagacaaacaaaacgttagactgctcgaacggagtctgcgacccgatttgcccttacaattgctatccagaacccgattactacaccatatcaccacagctacctccatggtcatcgtcaccacaaccatctccatgtccatctccatctatctcagccgtttatctaccatctcaagactcttcatcttccttagacgccatatccatcatcaccataaccggtgcggtcttagccatccttttaaccggattctttcttgtagcgaaattcttttcagacagcgtaaaccgtgtcaaccaaggaacatatcaatccgataacgaagacaacgacacggtaatggaggaagagtttcaagatagggaacaagtggatcacccaatatggttaataagaacaacaggtctacaacaatcgatcattaactcgattacaatctgtaattacaagagaggagatggtttaatcgagagaacagattgtccagtttgtttaaacgagtttgaagaagatgagagtcttaggttattgcctaaatgtaaccacgcttttcacatctcttgtattgatacttggcttagttctcacaccaattgtcctctgtgtcgtgctggtattgcgatgattagtgtcaccactccacggtattctggtccggttgaagtaactcccggaggatcaggttcacatttggagaacgatggagttgatgaagaagatcatggagagattgaaaacagagttgattctgattttaaagagagtgatgattcagacataagaattgagatttatagatttgattcagacggtgatggatctgaaacagagacgaaagagagagttagggttttgaaggagtgtatggatccaaatggaggagattcagtaaactctctctcgcatacgaaaacccatgtagaaagtgtagattttccggggaaatcatgcgagaatcagagtgaggaattcactagacataacggagaagatgaagcaagctgctctgaggaaaacggtggtggcagcaaccaattacggagaagttgtgattctggtgaattgaacggcgaaacaaccggagatgaagggaaaagtcagtcagacatttcgtcgagtacgttgaagacaaatggaagctcctcctctgtttcatgtttcaacaaaaacaagagttcggtttttccgctgtagggcgcgccaaaaattggagctctgcagagctttcgttcgtatcatc

SEQ ID NO: 151 - DNA, 954 bp, Arabidopsis thaliana
atggcaccttcgtcatcaagcggtttaaccttcaagctacatcctttggtaatcgtcaacatatcggatcactacactagggtcaaaactcagctcaatcctcctgcttcaatctgcgcaagcggccatggctcaaacaacggcgaagcaatgttccagcaaaaccctagggtttacggatgtgtgattggtgtccagagaggtcgtactgttgagatattcaacagtttcgagcttttatatgatccttctactcaaacccttgatagatctttcctcgagaagaagcaagagctctataagaaggtgttccctgatttctatattctgggatggtactctacgggaagtgatgctgaggaatctgatatgcatatccataaagctttgatggatatcaatgaatctcctgtttatgtgcttttaaaccctgctatcaatcacacacagaaggatcttccagtgactatttatgaaagtgaattgcatgtcattgatggaatcccgcagctaattttcgctcatacaagctacacaatcgagacagttgaagctgaacggatatcagttgatcatgttgcacatcttaaaccatctgacggaggctcagcagcaacccagttggctgctcatcttactggtatacatagtgccatcaagatgcttaatagcagaatcagagtgctttaccaaaatcttgctgcaatgcagaaaggtgataaatcttgtgacaactcagttctgagacaagtatctagcctgctaagaagattgcctgccatggaatcagagagatttcaagataatttcttgatggagtacaacgacaaattactaataacttacctagcgatgattacaaattgttccagcaacatgaacgagatggtcgacaaattcaacaccgcatatgacagaaacactcgaagaggtggaagaactgcattcatgtaa

SEQ ID NO: 152 - DNA, 1503 bp, Arabidopsis thaliana
atggctttcccgcgatttctttctctcctcgccgtcgtcactctctctcttttcctcaccaccactgatgcttcctctcgctctctatccactccacctaaaacgaacgtactcgacgtcgtttcatctctccagcaaacacaaactatcctctcactcgacccgactcgttcctcactcaccaccaccaaacccgaatccctatccgacccggttttcttcaattcatcttcaccactatctctagagcttcactctcgagacactttcgtcgcgtcacagcacaaagactacaaaagcttaacactcagtcgactcgagcgcgactcatcccgagtcgccggaatcgtcgcgaagatccgtttcgccgtcgaaggagtcgatagatccgatctcaaacccgtttacaacgaagatacacgataccaaaccgaggatctaacgacacctgtcgtctccggagcctctcaaggaagcggcgagtatttctcaagaatcggtgtcggaactccggcgaaagagatgtacttggttctcgacaccggaagcgacgtaaattggatccagtgtgaaccttgcgccgactgttaccaacagtccgacccggtttttaacccgacttcgtcttccacatacaaatctctcacttgctctgctccacagtgctctcttctcgaaacctccgcttgtcggtcaaacaaatgtctctaccaagttagttacggagacggatctttcaccgtcggtgaactcgctaccgatacggtgacgtttggtaactctggtaaaataaacaacgtcgctttgggttgtggtcacgacaacgaaggtctctttaccggagcagccggtttactcggtttaggcggtggtgttttatcgataaccaatcaaatgaaagcgacgtcgttttcttactgcctcgttgaccgtgactcgggaaagtcctcaagtcttgatttcaactcggtccaactcggtggcggagacgcgacggcgccgcttctacgtaacaaaaagatcgacactttctactacgtcggactcagtggattcagcgtcggtggtgaaaaagtcgtgctgcctgatgcgatcttcgatgtcgatgcttcgggaagcggaggagtgatcttggattgtggaaccgccgtgactcgtcttcagacgcaggcttataactcgctgcgtgacgcgtttcttaaactcaccgtgaatctcaaaaaaggatcttcgagcatctctctgttcgacacgtgttacgatttctcgtctctctccactgtgaaagtaccgacggttgcgtttcatttcacgggagggaagtcgcttgatttgccggcgaagaattatctgatccctgtggatgatagtggaacgttttgcttcgcttttgctccgacgtcgtcgtcgttgtcgatcatcgggaatgtgcagcagcaagggacacgtatcacttacgatctatccaaaaatgttatcggattgtcagggaataaatgctaa

SEQ ID NO: 153 - DNA, 1875 bp, Arabidopsis thaliana
atggaagctgtgattcaaaccagagggcttctctctttacccaccaaacccatcggagtgagaagccaacttcagccttcccatggcttaaagcagagacttttcgccgcgaagccaagaaatctacatgggttgtctctatcctttaacgggcacaagaaatttcaaacctttgagccaaccctgcatgggatttcgatttcccacaaagagagaagcaccgagttcatatgcaaggcggaggccgcggctgctggcgacggagctgtcttcggcgaaggcgattccgcagctgttgtagcctcgccgaagattttcggtgtggaggttgcaaccttgaaaaagattatccctttaggattgatgttcttttgtattcttttcaattacacaattctgagggatacaaaggatgtcttggtggtgacggcgaaaggaagttctgctgagattatacctttcttgaagacttgggtgaatcttcctatggccattgggtttatgctcctctacactaaactctccaatgttctctccaagaaggctctgttttacactgttattgtccctttcatcatctactttggggcctttggtttcgtcatgtaccctctcagcaactatattcacccggaagctctcgcagataagctccttacaaccctcggcccaagattcatgggtcctattgcaatattgcggatttggagtttctgtttgttttatgttatggctgagctttggggtagtgtggtggtctcagttctcttctggggctttgctaatcagatcacaactgtggatgaagccaagaaattctatcctttgttcggacttggagccaatgttgcactgattttctcaggaagaaccgtgaaatacttctctaacttgagaaagaatcttggtcctggagttgacggctgggcagtttcgttgaaagccatgatgagcattgtggtgggaatgggactcgccatttgtctcctctattggtgggtcaatagatatgttcctcttccaacccgtagcaagaacaagaaggagaaaccgaagatgggaacgatggaaagcttgaagttcttggtatcatcaccatacattagagatcttgctactttagtggtggcatacggtattagtatcaatcttgtggaagtcacatggaaatcaaagcttaaagctcagttccctagcccgaatgagtactcagcatttatgggagacttctcaacctgcacgggtgttgcaacattcacaatgatgcttctcagccaatacgtattcaataagtatggttggggagtagctgcaaagatcaccccaactgttctgctattgactggtgttgcgttcttctctctaatattgtttggcggcccattcgcaccacttgttgccaagcttggtatgacaccgctacttgcagctgtgtatgtcggtgcccttcagaatatcttcagcaagagtgccaagtacagcttgttcgacccttgcaaagaaatggcctatatcccattggatgaggacaccaaggttaaaggcaaagctgcgattgacgtggtctgcaacccattagggaaatcagggggagctttaatacagcagttcatgatcttatcctttggatcactagcgaattcaacgccgtatctaggaatgatcttgttggttattgtcactgcgtggttagctgcagctaagtcgctggagggacagttcaacagcttgcggtctgaagaagagcttgagaaggaaatggagagagcttcatcggtgaagatccctgtcgtgtctcaggacgaaagcggaaacggttcccttggagaatctcctagcagttcaccggagaaatctgctcccaccaacttataa

SEQ ID NO: 154 - DNA, 1155 bp, Arabidopsis thaliana
atgcctgtgtccgtacattccgttatcgccacgaacctagccactacactatcatcgaattaccggaatgtttctcgccgtagaactatctccacctctgtgaattgttcggtggagattacggaggctgatcggtcggtgaaactgaagaacgggaacgattcactggagatatgcagagttctcaacgggatgtggcaaacgagcggaggatgggggaagattgatcgaaacgacgccgttgattcaatgcttcgttacgccgatgctggtctctctactttcgatatggctgatcactatggtcctgctgaagatctttacggtatttttatcaatagagttcgtcgagagcgtccaccggagtacttggagaagattaaaggtttgacaaaatgggtgcctcctccaataaagatgacaagtagctatgttcgtcagaacatcgatatatcgaggaagagaatggatgtggctgctcttgatatgcttcagtttcactggtgggattatgcgaatgacggctatcttgatgcactgaaacatctcacagacttgaaggaagaagggaaaatcaagactgttgctttgactaattttgatacagagagacttcagaaaatcttagagaatggaatccctgtcgttagcaatcaggtgcaacactccatcgtagacatgcgtcctcaacagagaatggctcagctttgcgagcttacaggggtcaaacttataacatatgggacagttatgggtggtctcttgtcagagaagtttcttgataccaatctaacaatcccttttgctggccctcgcttgaatactccatctctccaaaaatacaaaaggatggttgatgcatggggagggtggaatctatttcaaggtttacttcgaacaatgaagaccatatccacaaaacatggagtctctataccaacagtggctgtgagatatgtactagatcagcaaggagttggtggatcaatgattggagtgagactcgggttagcggaacacatacaagacgcaaatgctatattctcattggtattggatgaagaagatgttaatagcatacaagaggttaccaagaaaggtaaagatcttctccaagtgattggtgactgcggagacgaataccgacgtatatga

SEQ ID NO: 155 - DNA, 738 bp, Arabidopsis thaliana
atggcagctaatatgatgagaccggcgtttgcttacactgttgtgtacgtgaaggacgtagctaaatctgtagaattctactctagagcttttggtcacaacgtccgtcgtcttgacgaatcccacaggtttgtattatgaattgttactattctctacgttggattgtcttaggtgttgttggatacgatcataggaatgtaaacgacagaatcgtattaggtcatgaaacaaaactctcgggtttgagattctattggtgcgatgtcctataatcaggtccgatccgctggctaacatgctaagcaaacacaccaaatatatatgtttgatgaatgaaagaaactgatacatacaggtggggggagctagagagcgggcaaaccacgatagcgttcacaccgcttcaccagcatgagaccgacgacctaaccgggaaggttcaggctacgcagtcagcacgtgaaagagcacccatcgaagtctgcttctgttaccctgatgttgatgccgctttcaaggtagaaatcaattattatatacttatgtctatatttgcctgttactcttcaattcgtacgtgttgataaaccagtgagatgctgcgttgtgcagagagcggtggagaacggtgcggaggcagtgagcaagccggaagataaagaatgggggcagaaggttggatacgtgcgagacattgacggcattgttgtacgcatcggaagccacgttaagtga

SEQ ID NO: 156 - DNA, 525 bp, Arabidopsis thaliana
atggcttcagcatcagcgacagctactcttctcaaacccaatcttccgccgcataaaccgaccatcatcgcctcctccgtatctccgcctcttcctcctccacgtcgcaaccacctcctccgccgcgatttcctctccctggcggcaacatccacgcttctaacacaatcgattcagtttctagctccggcgccggtctccgccgctgaagatgaagagtatatcaaagatacgtcggcagtgatcagtaaagtaaggagtacgctttcgatgcagaagacagatccgaatgtggctgatgcggtggcggagctgagagaagcgtcgaattcttgggttgccaagtaccggaaagagaaagctcttctcggaaaagcttctttccgggatatatactcggcgttgaatgctgtttcaggtcattatgtgagttttggtccgacggctccgattccggcgaagaggaaggcgaggattcttgaagagatggaaactgctgagaaagctctcacaagaggaagatga

SEQ ID NO: 157 - DNA, 1363 bp, Arabidopsis thaliana
ttaattaaatggtcaattccgaagaaattgcagatgggtttgagccaaaacctgtttctcgatcttattctggtgattcatctcatgatcgttctctttccgatctcaatcacgcagcggaggacttgagtgataagcttaagaatgtgggtttgaatgaagttacgaaagagcagagtgagaagatgatgagtgtctctgagagtaatggaggtttagattcgaatgcagtagtcaccatcaatcaggaagaagaagaagaagaagaagacagagatggttatggttatggtgatggttggagcgagaacgagagtgagaatgtgtatccagtgaggccaggagcagaggattgttctttttatatgagaacagggagctgcaaattcggatccagttgcaaattcaatcatcctcttgccagaaaattccaaattgctagggataataaagtaagagaaaaggaagatgatggtggtaaattggggctgatagattgcaagtattactttaggactggagggtgtaagtatggagaaacttgtagattcaaccataccataccaaagtctggtctggcctcagcacccgagcttaacttcctcggccttcctctcagaccgggagaagtagaatgcccttactacatgcgcaatggctcctgcaaatatggagctgagtgcaaattcaatcatcctgatcctacaaccatcggaggaactgactccccatcatttcgtggtaataatggtgtatccattggtacattttctccaaaggctacattccaagcaagttcaacttcctggtcttcaccaaggcatgtgaatggtacatctccttttattccagtcatgctgtcacaaactcatggggttacatctcaaaatccagagtggaatggctatcaggcttctgtgtattcatctgaaaggggtgtgttttctccttccaccacatacctaatgaacaattcatcagctgaaacaagtatgttgctgtcacaataccgacatcaaatgcctgctgaagaatttccagaacgtccagaccaacctgagtgcagttattatatgaaaactggggactgcaagttcaaattcaattgcaaataccaccatcctaagaatcgtctgccgaagctgcctccttatgctctcaatgacaagggtttaccccttagacctgatcaaaacatttgcacatattacagtcgatacggcatctgcaaattcggtccagcttgtagatttgaccattccgtccagcctccatattcgacagaaagctcccaggccattgtagaacctcctcaggtcagtgcaaatgggaatgaaagtgacggttggaattgaggcgcgcc

SEQ ID NO: 158 - DNA, 933 bp, Arabidopsis thaliana
atgggtctcttcgaatcggtgaaatcaatcgattgggaacaagaatcgttcccaacttatcaagatttagggtttttgcctctctttgcagtgttcttccctacaattcgatttctacttgacagattcgtcttcgagaaattggcaagtcttgtgatctatggaaggatgagtacgaataagagtgacaacataaaagacaggaagaaaaatagtccaaaagttcgaaaatttaaagaatcagcttggaagtgtatttactatctatcagctgagctacttgctttatctgtcacatataatgaaccttggttttcaaatactctctacttttggattggtcctggagatcagatttggcctgatcaaccaatgaagatgaagttgaagtttttatatatgtttgctgctggattctacacgtactctatattcgcgttggtgttttgggaaacaagacggtctgatttcggagtttccatgggtcatcatatcacaacgcttgttctcattgtcctctcctatatctgcagattaactcgtgctggttctgttattcttgcacttcatgatgcgagcgatgtgttccttgaaattgggaaaatgtctaaatattgcggagcggaaagtctcgcgagcatttcgtttgttcttttcgcgttgtcttgggtcgttctacgtctcatttactatcctttttggatcctgtggagcacgagctatcaaatcattatgactgtggacaaagaaaagcatcctaatggaccaatcttgtactatatgttcaacacacttttgtatttcttgcttgttcttcacatattctggtgggttttgatttaccggatgcttgtgaaacaagtgcaagatcgaggcaagcttagcgaagatgttagatccgattctgaaagcgatgatgaacacgaggattaa

SEQ ID NO: 159 - DNA, 3214 bp, Arabidopsis thaliana
ttaattaaatggaatccgaaggagaaaccgcgggaaagccgatgaagaacattgttccgcagacttgccagatctgtagtgacaatgttggcaagactgttgatggagatcgttttgtggcttgtgatatttgttcattcccagtttgtcggccttgctacgagtatgagaggaaagatgggaatcaatcttgtcctcagtgcaaaaccagatacaagaggctcaaaggtagtcctgctattcctggtgataaagacgaggatggcttagctgatgaaggtactgttgagttcaactaccctcagaaggagaaaatttcagagcggatgcttggttggcatcttactcgtgggaagggagaggaaatgggggaaccccagtatgataaagaggtctctcacaatcatcttcctcgtctcacgagcagacaagatacttcaggagagttttctgctgcctcacctgaacgcctctctgtatcttctactatcgctgggggaaagcgccttccctattcatcagatgtcaatcaatcaccaaatagaaggattgtggatcctgttggactcgggaatgtagcttggaaggagagagttgatggctggaaaatgaagcaagagaagaatactggtcctgtcagcacgcaggctgcttctgaaagaggtggagtagatattgatgccagcacagatatcctagcagatgaggctctgctgaatgacgaagcgaggcagcctctgtcaaggaaagtttcaattccttcatcacggatcaatccttacagaatggttattatgctgcggcttgttatcctttgtctcttcttgcattaccgtataacaaacccagtgccaaatgcctttgctctatggctggtctctgtgatatgtgagatctggtttgccttatcctggattttggatcagtttcccaagtggtttcctgtgaaccgtgaaacctacctcgacaggcttgctttaagatatgatcgtgaaggtgagccatcacagttagctgctgttgacattttcgtgagtactgttgaccccttgaaggagccaccccttgtgacagccaacacagtgctctctattctggctgttgactacccagttgacaaggtgtcctgttatgtttctgatgatggtgctgctatgttatcatttgaatcacttgcagaaacatcagagtttgctcgtaaatgggtgccattttgcaagaaatatagcatagagcctcgtgcaccagaatggtactttgctgcgaaaatagattacttgaaggataaagttcagacatcatttgtcaaagatcgtagagctatgaagagggaatatgaggaatttaaaatccgaatcaatgcacttgtttccaaagccctaaaatgtcctgaagaagggtgggttatgcaagatggcacaccgtggcctggaaataatacaagggaccatccaggaatgatccaggtcttcttagggcaaaatggtggacttgatgcagagggcaatgagctcccgcgtttggtatatgtttctcgagaaaagcgaccaggattccagcaccacaaaaaggctggtgctatgaatgcactggtgagagtttcagcagttcttaccaatggacctttcatcttgaatcttgattgtgatcattacataaataacagcaaagccttaagagaagcaatgtgcttcctgatggacccaaacctcgggaagcaagtttgttatgttcagttcccacaaagatttgatggtatcgataagaacgatagatatgctaatcgtaataccgtgttctttgatattaacttgagaggtttagatgggattcaaggacctgtatatgtcggaactggatgtgttttcaacagaacagcattatacggttatgaacctccaataaaagtaaaacacaagaagccaagtcttttatctaagctctgtggtggatcaagaaagaagaattccaaagctaagaaagagtcggacaaaaagaaatcaggcaggcatactgactcaactgttcctgtattcaacctcgatgacatagaagagggagttgaaggtgctggttttgatgatgaaaaggcgctcttaatgtcgcaaatgagcctggagaagcgatttggacagtctgctgtttttgttgcttctaccctaatggagaatggtggtgttcctccttcagcaactccagaaaaccttctcaaagaggctatccatgtcattagttgtggttatgaggataagtcagattggggaatggagattggatggatctatggttctgtgacagaagatattctgactgggttcaaaatgcatgcccgtggatggcgatccatttactgcatgcctaagcttccagctttcaagggttctgctcctatcaatctttcagatcgtctgaaccaagtgctgaggtgggctttaggttcagttgagattctcttcagtcggcattgtcctatatggtatggttacaatgggaggctaaaatttcttgagaggtttgcgtatgtgaacaccaccatctaccctatcacctccattcctcttctcatgtattgtacattgccagccgtttgtctcttcaccaaccagtttattattcctcagattagtaacattgcaagtatatggtttctgtctctctttctctccattttcgccacgggtatactagaaatgaggtggagtggcgtaggcatagacgaatggtggagaaacgagcagttttgggtcattggtggagtatccgctcatttattcgctgtgtttcaaggtatcctcaaagtccttgccggtattgacacaaacttcacagttacctcaaaagcttcagatgaagacggagactttgctgagctctacttgttcaaatggacaacacttctgattccgccaacgacgctgctcattgtaaacttagtgggagttgttgcaggagtctcttatgctatcaacagtggataccaatcatggggaccactctttggtaagttgttctttgccttctgggtgattgttcacttgtaccctttcctcaagggtttgatgggtcgacagaaccggactcctaccattgttgtggtctggtctgttctcttggcttctatcttctcgttgttgtgggttaggattgatcccttcactagccgagtcactggcccggacattctggaatgtggaatcaactgttgaatttaaat

SEQ ID NO: 160 - DNA, 1128 bp, Arabidopsis thaliana
atggatctatcaaaccgtcgcaatcctctccgggatctgagctttcctcctcctccgccgccacctattttccaccgtgcgagctctacggggacgagttttccgatcttagccgtcgcggtgatcggaatcttagccacagcatttttacttgtaagctattatgtttttgttatcaaatgttgtctcaactggcaccgaatcgacattcttggtcgattctcgttatctcgaaggcgacgcaacgaccaagatcctttaatggtttactctccagagcttagaagccgcggtcttgatgaatccgtcattagagcaatcccaatctttaagttcaagaagagatacgaccaaaacgacggcgtttttacaggagaaggagaagaagaagaagagaagagatctcaagaatgctctgtttgtttgagtgagtttcaagatgaggagaagctgaggattatcccaaattgttctcatttgtttcatatcgactgtatcgatgtgtggcttcagaacaacgccaattgtcctttgtgtagaactagggtttcttgtgacacaagttttcctccggatcgggtttctgcgccgagcacttctcccgagaatctggtcatgttaagaggtgagaacgagtatgtggtcattgagctgggcagtagcatcggtagtgacagagatagtccaagacacggaaggttacttacgggacaagaaaggtcaaattcaggttatctactgaacgaaaacacccaaaattcgatcagtccatctccgaagaagcttgaccgcggagggcttccaagaaaattccgaaagcttcacaagatgacgagtatgggagacgaatgcatcgacataagaagaggtaaagacgaacagttcggtagtattcagcccattagaagatcaatctcaatggattcatcggcggatagacagctttacttggcggttcaagaggcgattcggaaaaaccgcgaagttctggtggttggagacggaggaggatgtagcagtagtagtggcaatgttagtaattccaaagtgaagagatctttcttctcttttgggagcagtagacgttctagaagttcctctaaattgccactttattttgaaccctaa

SEQ ID NO: 161 - DNA, 1736 bp, Arabidopsis thaliana
ttaattaaatggactctcactcttcccacctcaacgccgccaatcgttcccgcagttctcagactccttctccttctcattccgcctccgcctccgtcacttcttctctccacaaacgcaaactcgccgccaccacggcagcgaatgcagccgcttctgaagatcacgcccctccttcttcctctttccctccttcctccttctctgccgatactcgcgacggcgctttaacctccaacgatgaactcgagagcatctccgctcgcggcgccgatacagattcagatcctgatgaatcagaggatatagtcgtggatgatgacgaggacgaatttgctcctgaacaggaccaggactcttctatccgcacattcaccgccgctcgactcgattccagctctggagtcaacggttcgagtcgcaacactaaacttaagacggaaagctccacggtgaagcttgagagctctgatggtggaaaagatggtggatcatctgtggttgggactggtgtgagtggcactgttggaggaagctcaatctcagggctcgtgccaaaggatgagtctgttaaggtattggctgagaatttccagactagcggagcttacattgccagagaagaggctttgaaaagagaggagcaagcaggacgactcaaatttgtttgttactcaaatgattccattgatgagcatatgatgtgcttgattgggttgaagaacatttttgcaagacagttacctaatatgcccaaggagtacattgttcgtcttctgatggataggaaacataagtctgttatggtactaagagggaatctagttgtaggtggtatcacgtatcgtccatatcacagtcagaagtttggggaaatagcattttgtgcaatcacagcagatgaacaagtaaaaggttacggtaccagattgatgaaccacttgaaacaacatgcacgtgatgttgatggattgacgcattttcttacttatgctgacaacaatgctgttggttacttcgtcaagcagggttttactaaagagatttacttggagaaagatgtatggcatgggttcattaaagactatgatggtggtctccttatggaatgcaaaattgatccaaagctgccatatacggatttgtcaagcatgatacgccagcaaagaaaggcaattgatgaaaggataagagagttatcaaactgtcagaatgtgtatccaaaaattgagtttctaaagaatgaagctggaattcctagaaagattatcaaagttgaggaaatacgtggcttaagggaagctggttggaccccagatcagtgggggcacactcgtttcaaattattcaatggttctgctgatatggtgacaaatcaaaaacagttgaatgcactcatgcgtgcgcttttaaagacaatgcaagaccatgctgatgcttggcctttcaaagaaccagtggattctcgcgatgtccctgattactatgacatcattaaggatcccattgatctgaaggtaattgcaaagagggtagagtcggaacagtattacgtgacattggatatgtttgttgcggatgcgagacggatgtttaacaattgtagaacttacaactcccccgataccatttattacaaatgtgcaaccaggttggaaacacacttccatagcaaagtacaagcaggtctccaatctggtgctaaatctcaatagaagaagatggtagggcgcgcc

SEQ ID NO: 162 - DNA, 1975 bp, Arabidopsis thaliana
ttaattaaatggctacaacagcagtaaacctaccaattcatgagcaccctctttatccttcagctcgatgtattataggtgaatgtgatggctgccatgtaaatggttacatgtacaacggctacttttgcaatgaacctttctgctttatttggttccataaagagtgtgctgaggccccagcggagatcagccatagttcccaccatcaacatcctctcctgctcaccaatgactcgattgatggtccttgtgatctgtgtggacagaagctattgcctccttgttacagttgttccacatgtgagttcaaggtggatttgacttgtgcgatgaaaccatcaccgcctgctatcgaacatccgctgtgtcatcaccattcacttgtcttcttgaagaaacgagaggagaaggtgtcatgtgaattgtgcaaggattctattgccggaccatcctattcgtgtcttgaatgcgatgtgtacttccacgtgaattgcatccagctctccaaagaggtaaatcatccttgtcattctgctcatcctctcaagttaatcccatttgagtcacttacggatgatgccgagacaacttgtcttttatgtggaaagaagccagctgaaaatatgctttatcattgttcggtttgcaatttcacatcgtgtcttggttgtaccaaaaacccaccactcctcgttattgagcatatcaagacccacaaacacccacttattctctttcctagaagaatcccgtgtatctgtgacatttgtgggaagaaatgcgagtttgcggtgtatgtatgtcctcagtgtgattttgttactgcaagagggtgtatcgacttagctcgtgtcatcaatatcaatcgccatgatcatcgcatttatttaactcatcatctcggtactgggtattcgaaatgcggagtttgtcacgaaaatgtaaatcagtacaagggggcttattcttgctctgtttgccctcactatgctgtccattctacatgtgccgtgagaactgacgtatgggacggggtagaattggaagggaccactgagatcacagaagacaattcaccattcaaggtggtgggtgataacttgatatgccattttagtcatgaagagcatcctttaaggttccagaaggacgacgtcttcattcatgatgagcacaaacgatgtgcagcatgtatccatcctcttggatttggctccatctactgctgtgaaacgtgtccattcattctccatgaaaaatgtgctaatcttcctatgaagaaaagacttgtcttcggcaccagaccatacacattaatgaaagaaactacccaacttacagactgcacgttgtgtggaatattttctgatggtttcgcgtacagctcccgctggttggatgtagatgtgcattgtggttccctaaatgagccgctcgttcatgatggccatatacatcccttaaattttgataaaatggagggtcacttttgcgatggatgcaaaaagaatatagatgattatatgcttcgttgtaaagcttgtgactttgatttgtgtttgtattgtgctactttgccaaaaaagatatggcacaggaatgatgggcaccctctcactttatgttgtgaggaaaaggaagaggcgagcgataaatattggtgcgacatttgtgagaaggaattagatccaagtatatggttctatacatgttttgattgtggagtcaccttgcatgctcagtgtgtattaggagatttctcacgtctcgtgctaggacaaaactattggtttggggaaaaagtcaagtttggggcggttcctaacaatcgcaacactcggccattatgcatccagtgtcaatctcgatgcaaggtctccgtcatcctaaaggaacgtaatgaatacaatcggtatatatgttcccgttcatgtttattgagttatttgggtgaaaaaatttgaggcgcgcc

SEQ ID NO: 163 - DNA, 606 bp, Arabidopsis thaliana
atgggaggcaaaaaaacaaagattgagattaagaagatcataaacaaacccgcaaaaacggttgctttcacaaaacgcagggaaggtctcttccgcaaagcttcacagctttgtctcctctctccagccactcaaatcgcaatcttagcggctcctatgacttccaaatctcacgcttctttctactctttcggtcattcctctgtcgataacgttgtctcctctctgctttatgaccatcctcctcttacggcaaaccaagacaacaggtcagggttagggttttggtgggaagacaaacgttttgacgtatcggagaacgttgaggagttaaaagaggcggtcgatgctgtttcgaggatgttgaacaatgtgagatgccgattaaatgatgccgtgaagagtactcaaagagatggaggtttagagattcttcatcatcaggaggaggaagttcttcagactcgcaacgacgagacaaagacgaatcaaactcacgaatttgaaggcggcgaaacttctggttctgcaagttggttagagaacgaggatgatattcttcactttgatgatgatttttatactggtattgatcctttgttttga

SEQ ID NO: 164 - DNA, 1484 bp, Arabidopsis thaliana
ttaattaagtcaaatttccgaaccctaactttagccccaaattagagagagatgcagaaacgggagcttgggaaatccggcggtaattccggtggatcttcgggtccaccagcgaagagaggccgtcccttcggtagtacaagtgctaactcagctgctgctgctgcagcggcggcagcagcggacgcgatgtcaccgtcagctttacttggtccttctcttctagttcacaattccttcgtcgagcagaacaatagaagaatagttcttgcgttgcagagtggtttgaagagtgaggtgacatgggcattgaacacacttacgttgctttccttcaaggaaaaagaagatattcgaagagatgtcatgcctcttgctaagatagctggcttgcttgatgcccttctcttaattatagatgattggcgtgacatagctctcccaaaggacctgacaagaggaactagagttagaactttaggtacaaatgcttcagttacgggatttggcaatgagtatgatgctctagcctctattcaaccccctggatccgggattggttcttctgctgctgaggcattaggaaaaaagagcactggtaaacatcagtcatctcagtggtggatggaagaggatggtttgtttaatctagacgatgaagggagatcagagaaacaaatgtgtgctattgctgcatcgaacgttatccgcaacttctccttcatgcctgataatgaagttgtaatggctcagcatcgccattgcttagaaactgttttccagtgcatacacgatcatatgaccgaggatgaagagctggtcacaaactcgctagagacaattgtaaacctagcgcatttgatggatcttcgaattttcagctcgcttaagcagtcatacatcaacataaatgaaaagaaagctgttcaagctgtggtcggaatcctcaattcttctgtcaaagcttggaattgtgctgctgctgagttgctagggcgtttgataatcaatccggacaatgaacctttcattagtcctttaattccgcagatacacaagcgactaatcgatcttttgagcatacaagccgttgatgcacaagctgcagctgttggagcactctacaatctcgtggaagttaacatggattgcagattaaagctagcaagtgagagatgggcggttgataggttgctgaaagtgataaagactccgcatccggttccagaagtatgtaggaaagctgcaatgatccttgagaaccttgtctcggagcctcaaaacagaggattgctactcgcgtatgagaatgctttcgctgagctgctttttcaagagggtaagtattctgattcatttgctaggattttgtatgaactcactgctagatctaatagcagagttgcttcagctagaggaatctggggcatgtaaaagtcttctctagattagtgggtttgattaattgattgtgttggcgcgcc

SEQ ID NO: 165 - DNA, 1158 bp, Arabidopsis thaliana
atgaaagaaggaaaggatgggtttgttcgagcagatcagattgatctaaaaagcttagacgagcaactagagagacacttaagcagagctttgactttagagaagaacaagaagaaagatgaagaagacacaaccgccgtcgccatcggtggctctgcttcttcttcccctgtcactctaaacggcggcggatttgttggcaagaggaaacagagacttgagtgggagatcgatccttctaaacttatcatcaagactgttcttgctcgtggcacttttggtaccgttcatcgtggtatctacgacggtcaagatgttgccgtgaagttgcttgattggggtgaagaaggtcatagatcagaagctgagattgtgtctttgagagctgattttgctcaggaggttgctgtttggcataaattggatcatcctaatgtcaccaagtttataggagcaacaatgggtgcatcagggttacagttgcaaacagagagtggtccattagctatgccaaacaatatatgttgtgttgttgttgaatatcttccaggtggtgctttaaaatcttacctgatcaagaacagaagaagaaaactaacatttaaaattgttgttcagctcgctcttgatctcgctagagggttgagttaccttcattcgcagaagattgttcaccgagatgtaaagacagagaatatgttgttagacaaaacccggactgttaaaatcgcagattttggagttgcgagagttgaagcatctaaccctaatgacatgacaggagagactggcacacttggctacatggcgcctgaggttctcaatggaaacccgtataatcgaaaatgcgatgtatacagtttcgggatctgcttatgggagatatattgctgtgacatgccataccctgaccttactttctctgaggtcacttcagccgtcgtccgccagaacctgagacccgatataccgaggtgttgcccgagcgcacttgcagctgtgatgaagcgatgttgggatgcaaatccggacaagagaccggagatggatgaggttgtaccaatgttggagagtattgacacaaccaagggaggagggatgattcctaacgaccagcaacagggttgcctatgcttccgaaggaaacgtggtccttaa

SEQ ID NO: 166 - DNA, 1197 bp, Arabidopsis thaliana
atgggaggttcgtcggagacaaagatcttacaagaactcatactttacgcggcgagcgctgctttcagctgcttggttctctttgcgggtcttcgtcatctcgatcctaatcgtgaggcttctaaaaaagctctcgagcataagaaggaaatctctaaacgtttgggtcgtcctcttgttcagaccaatccatacgaggatgtaattgcatgtgatgtgataaatccagaccacattgatgtggagtttggttctattggagggttggagaccatcaagcaggctttgtatgagcttgtgattttaccactgaaaagacctgagctttttgcttacgggaagcttcttggacctcaaaaaggtgtcttgctctatggacctcctggtactggaaagactatgcttgctaaggctattgccaaagagtcaggagctgttttcattaatgttagggtttcaaacctgatgagcaagtggtttggagatgctcagaagcttgtttctgctgtgtttagcttggcctacaaactccaacctgctatcatttttattgatgaggttgagagctttcttggtcagcgccgttcaacagatcatgaagctatggccaacatgaagactgagtttatggctttatgggatggattctctactgatccgcatgcaagggttatggttcttgctgcaactaacagaccgtcagagcttgatgaagcaatattaaggcgtcttcctcaggcctttgagattggaatacctgatcgccgggagagagctgagatattgaaagtgactctgaaaggagagagggtggaacctgatattgactttgatcacatagctcgcttatgcgaaggctataccggatcagacatttttgagctatgcaagaaagcagcttacttccctatcagagaaatcctagatgcagagagaaaggggaaaccatgtttggaccctaggccattatcacagttagatttggagaaggttcttgcaacgtcaaagaagacacaagttgcagcaggcgagtactcattgagctcgcagtcctcggcttggagaggctcaagggaaccagatgaggtccaggcagcgataagtgggatctcgaagcttctagtttctcagatcattaacctacagtcagaatctcaggattcatggcagcgggatcccgaagaagattcccgatga

SEQ ID NO: 167 - DNA, 1605 bp, Arabidopsis thaliana
atggccaccaagctcgacaccagtagcttacttttggccctcttgtccaaatgtagcctccttactcaaaccaatcttgctctctctctcctcgtagcctccctagcttctctcgctctttctctcttcttctggtctcatcccggaggacccgcatggggaaagtacttcctccaccgccgccgtcaaaccaccgtgatacccgggccaagaggcttaccttttgtcggaagcatgtctctcatgtcaaacactctggctcaccgttgcatagccgcaaccgcagagaaatttagagccgaacggttaatggcgtttagtttgggagaaactcgcgtgatcgtcacgtgcaatcctgatgtagctaaagagattctaaacagtccggttttcgctgaccgcccggttaaggaatcagcttattccctcatgtttaaccgtgctatcggtttcgctccttacggcgtttactggcgaaccttgagaaaaatcgcgtctaatcatcttttcagcccgaaacagattaaacgttccgaaacgcagagaagcgtgatcgcgaatcaaatcgtgaagtgtctcacaaaacagagtaacaccaaaggtctctgtttcgcacgtgacttgatcaaaacggcatcgcttaataacatgatgtgctctgttttcggaaaagaatacgagcttgaggaagagcatgaagaagtgagtgagctacgtgaattggtggaagaaggttatgatttactcggtacactgaattggaccgatcatctcccatggctctctgaatttgatcctcaaagaatccggtctagatgctctaatctcgtcccaaaagtaaaccggtttgtgaaccggattatctctgaccaccgtgaacaaactcgtgactcaccgagtgacttcgttgacgtattgctctctctcgatggtcctgataaattatccgaccctgatatcatcgccgttctatgggaaatgatattcagaggaactgacacggtggctgttttgatcgagtggattcttgctaggatggtccttcatccagatattcaatcgacggttcacaatgagcttgatcaaatcgtgggacgatcaagggctgtcgaagagtctgacgtggtgtctctagtatatctaacggctgtggtgaaagaagtcttgaggcttcacccgccaggcccactactctcatgggcccgtttagcaatcacagacacgatcatcgacggtcgtcgtgttccggcggggaccaccgcaatggtgaacatgtgggctattgcacacgatccacacgtgtgggagaatccgttggagtttaaacccgaacgttttgtagccaaggaaggtgaggttgagttctcggttcttgggtctgatttgaggcttgcaccgttcgggtccggtcgtcgggtttgccccgggaagaatcttggtttgaccaccgtgacgttttggactgcgacgcttttgcatgagtttgaatggctgacgccgtccgatgagaagaccgttgacttgtccgagaaactgaggctctcgtgtgagatggctaatcctcttgctgctaaattacgccccaggcgcagttttagtgtatga

SEQ ID NO: 168 - DNA, 465 bp, Arabidopsis thaliana
atggctggaggtctcgggaaatgcagcaagatccgtcacattgtgaggctaaggcaaatgcttcgacggtggcgcgatcaagcgaggatgtcttcttctttcagccgttgtgtaccgtcggatgtaccgtcaggacacgtggcggtctacgtaggaagcagttgtaggagatttgtggtgcgcgcgacgtatctgaaccatcctgtcctaaggaaccttcttgttcaagctgaggaagagtttggtttcgttaaccaaggtccgttggttatcccttgtgaagaatcggttttcgaggaatcgattcggtttatatcccggtctgattcgacccggtcaagacggtttacttgtcccgatgattttcagaagaattgccacgtggtgggaatcagaagcaagcttgatctatggatcgaatctcgaccgttacttcacggcgttactgaaaaagccgtttggtga

SEQ ID NO: 169 - DNA, 762 bp, Arabidopsis thaliana
atggctgccaatttctggaattcatctcactataaacagcttttggatccagaagaagtcgacgtagttcatgatctcgataaagaacgtggaatctcaattgatgattttaagctcatcaagttccatatgtctaatcatattatgaaattggctcagcacattaaagtgaggcaaagggttgtagctactgcaattacgtatatgagacgggtttatatcagaaagagtatggtagagtttgagcctcgacttgttgctcttacgtgcttgtacctggcatctaaagctgaagaaagcatagtgcaggccaggaatcttgttttttacatcaaaagattgtatcctgatgagtacaacaaatatgaactaaaggatatattaggaatggagatgaaggtgttagaagcactagattattatctggttgtgtttcacccttaccggtcattatcggagtttttgcaagatgctgcattaaacgatgtaaatatgaaccagattacatggggaattgttaatgatacttataagatggacctcattcttgtacaccctccctaccgcatagcgctagcatgcatatacatagcaagtgtccacagagagaaagatatcactgcatggtttgaagatcttcatgaggacatgaacttggtaaagaatattgccatggagatactggacttctatgagaactacagaacaatcacagaggaaaaagtgaattctgccttcagcaaattggctttgaagctgtag

SEQ ID NO: 170 - DNA, 1423 bp, Arabidopsis thaliana
ttaattaaatggttcgtggattgatgaaattcccaggaatctcaacgaagttattaaacataagcgttaattctctctgcaaatttcgaaacttggagagagcagaaacattactcatagacggaatcagattaggtgttcttcctgatgtgatcacttacaacactctaatcaaagggtacactcgtttcattggaatcgacgaagcttatgctgtaacacgtcgtatgagagaagctgggatcgaaccagatgttactacttacaattcattgatctcaggagctgctaaaaacttgatgttgaatcgtgtactccaactgttcgacgaaatgcttcactcaggtttgtctcctgatatgtggagttataatactttaatgtcttgttacttcaaattagggagacatggagaagcgtttaagattcttcatgaggatattcatttagctgggttggttcctgggattgatacttataacattctgcttgatgcgctttgtaaaagcggtcatacggataatgcgattgagttgtttaagcatctgaagagtcgggttaaacccgagcttatgacgtataatattctcatcaatggtctttgtaaatcgagaagggttggttctgtggattggatgatgagagagcttaagaaatcgggctatactccgaatgcggttacgtatacaacgatgcttaaaatgtattttaagactaagaggattgagaaaggtcttcagttgtttttgaagatgaagaaagaagggtatacgtttgacgggtttgcgaattgtgcggttgttagtgcgttgattaaaaccggaagagcagaggaggcgtatgagtgtatgcacgagcttgtgagaagtggtacaaggagtcaagacattgtttcgtacaatacattgttgaatttgtattttaaagatgggaacttggatgcagtagatgatctattggaggagattgagatgaaggggttgaaacctgatgactatactcatacgattatagtcaatggtttgttaaatataggcaatacgggaggagccgagaagcatttggcatgtatcggagagatggggatgcagccgagtgttgtcacttgtaactgtttgattgatgggttgtgcaaagcaggtcatgtagatcgtgcaatgaggttgtttgcgtcaatggaagttagagatgagttcacttacacttctgttgtgcataatctatgcaaagacggacggcttgtttgtgcttcgaagctgctcttgtcgtgttacaataaaggaatgaagattccgtcatcggctagacgagcagtgttgtccggcatacgggagacggtatcttaccaagcagcaaggaagacacatatcaaaatcaaagcagctattgagtgtaatacactaatgtacccttaaggcgcgcc

SEQ ID NO: 171 - DNA, 1571 bp, Arabidopsis thaliana
tttcttgtttgttgattaacccttaattaaatgtctatctttctttgtttcctcttacttcttccactctctttaatcttcttgaaaaagctcttaccgtcgaaagggaagcttcctccgggacctaagggtcttccgatcatcggtaacttgcaccagtttggaagatttcttcacaaatctcttcacaaaatctcccaagaatatggaccggtgatgcttctccatttcggggtggtccctgtgataattgtctcttccaaagaaggagctgaggaagtgctcaagactcacgatcttgagacttgtagccgacctaagacggtggggagcgggttgtttacttacaactttaaagatattggttttgctccgtatggtgagaattggcgagagatgaggaaaattgcggtttccgagctctttagccagaagaagctcaaatctttcaggtatattagagaggacgagagccaattgttggtccggaaggtatcaaaatctgctcttgagacaccaacttcatcagttaatttgaggaaggtcatttttaccttcgcggcaagtatcatttgtagactttcttttggacaaaatttttgcgattttgtcgatatggagacagtggaagagttggtgcttgaatcggagaccaacctcggctccctggcgtttgctgacttcttacctgcagggtggatcatagatcggatctccggtcagcattccacggtgatgaaagccttttccaaactcaccaatttctttgaacttgtgattgatgatcatttgaagagtgggaaaatcgaagatcactcagacatcatcagtgtcatgttggatatgatcaacaaacccaccgaagttggttcttataaagtcaccgatgatcatctcaaaggacttatgtcggatgtgtttttggctggagtgaacgcgggttccatcacaatgatatggacgatgacagagttaagtagacatccgagagtgatgagaaaacttcaagaagagattcgagcagcgctcggacccaacaaagagaaaatcacagaagaagacctcgagaaagttgagtacttgaagatggtgatcgaggaagcattcagattacacccaccggctcctctcttactcccaagactaacaatgtccgacatcaatattcaaggctacagcattccaaagaacaccatgatccaaatcaacacgtacacaattggacgtgaccccaaaaactggacaaaacccgacgagttcatccccgagaggtttgtcgataaccctatcgaatacaagggtcaacattttgagctattgccgtttggagccggacgtagggtctgtcccgggatggccacggggatcaccatcgtcgagcttgggcttcttagccttctttacttcttcgattggagtttgcccaatggaatgaccactaaagatattgacatggaagaagacggagcttttgtcatcgccaagaaagtctctcttgagctcgtaccaactcttcatcgctggtgaggcgcgccaaaaattggagctctgcagagctttcgttcgtatca

SEQ ID NO: 172 - DNA, 1235 bp, Arabidopsis thaliana
ttaattaattggagaactctgaagtaagagagacagagaaagacaaagagagagacatggtgggctcaggagttggaggaggagatagaagcaaagatgctgtaggaatgatggcacttcatgaagcacttagaagcgtctgttttaactccgactggatttactctgtcttctggaccattcgtccccgaccgagggtccgtggtggtaatggctgcaagattggtgatgaaagtggcagcttgatgttgatgtgggaagatgggttttgtggtggaggaagaagtgaagatctttgtctggaaacagacattgaaggtcatgaagaagatcttgtcagaaaagctttcagcaagatgtccattcagttatataattatggagaaggattgatgggtaaagttgcttctgataaatgtcacaagtgggttttcaaagaaccatctgaatctgaaccaaatcttgctaattactggcaaagttcttttgatgctcttcctccagaatggaccgaccaattcgaatcaggcattcagacaattgctgtgattcaagctggacatggtctgttacagctaggttcttgcaagattattccagaagatcttcattttgtgctaaggatgaggcaaatgtttgaatcaattggttacagatcaggtttttacctctcacagctcttctcttcaaaccgaaccgcgactccatcttcttccacggttccaaaccagatacctcagtctcaaggttttaactggggatcacactcacctttgttaccttcccctagctttcagaaccaactacctgcttcagctagattcggtttccttcaagataacaatgttcctcctcagatgcttcctccaatggaagagcatgaagacgacatcaaatggcctaatggtttgtcgttgttcaatgcgttgactggacgtgcagatgaagctagtaggcttttgtttaaccaggagcagaacccgatgaatgtcgaaaaccagaacgagttcttgaaccttgaaggtcatcatcctaacaagtttagaagaagctatacattgccagctcgaatggattcttcgtcatcatcaacctcgcttgatcagcaacaaccactggagtttaggaacaataactctggaagcaactcgggtttgttccctgacgttatggagacgtttttgaggtgattgacatgttcaagattcaggtttaaggacagattaaggcgcgcc

SEQ ID NO: 173 - DNA, 870 bp, Arabidopsis thaliana
atgacttcttcagtactaaccccaagcttaaagcttttagctatgacgaattcttcctcttcgacccttttttgtattccttctatcttcaacatctcgtcctctgaatctcaccgcttcaatttttccttatcctcacgacccgttaatctcacactctctctcaaatccaaaactcttcgtaactcatctcctgttgttactttcgtttcccaaacttcgaattgggctgaggaagaagaaggtgaggatggaagcatcggaggtacttcagtcactgtagatgagagtttcgagtctgaagacggtgttggattcccggagccaccggaagaggctaaattattcgtcggaaacttgccgtacgatgttgatagtcaagctttagctatgctctttgaacaagctggtactgttgagatttcagaggttatatacaatagggacactgatcaaagtcgtggatttgggtttgtaacaatgagtacagttgaagaagcagagaaagctgttgagaagttcaatagttttgaagtgaatgggaggcgtttgacagtaaacagagcagctccaagaggatcaagacctgaacgacaacctcgtgtatatgatgctgcgtttaggatctatgttgggaacctgccatgggatgtggatagtggtcgtttggaacgattatttagcgagcatgggaaagtagttgatgcccgagtggtttctgatagagagacaggtcgttcacgtgggtttgggtttgttcaaatgtcgaatgagaatgaagttaacgttgccattgctgctcttgatggacagaatttggaaggcagagcaattaaagtgaacgtggctgaggaacgaacaaggcgttga

SEQ ID NO: 174 - DNA, 1951 bp, Arabidopsis thaliana
ttaattaaatggttgagcgtgggaagaggactcacaatcgtttcagagacaacaacaatgacaacaaccggaatcaaaggagaagactttcttacgaatccgaagaaaaaaagatcgataacaaagacgatctcgttgttgtttacagaatcttatgcccaagtggtgtcatgggaagtgttataggcaaaagtggcaaagttattaacttgattaggcaagaaactagagctaggatcaaagttgttgatccttttccaggttgtagcgaaagagtcataacgatcttttgctcggtttcggagaagaaagacattgttgacattgagtatagtgaattggattactctgttcctttgtgttctgctcaagctgctcttcttaaagtccatgatgctattgtggcttctttagctactgctgctgagaacactaagattgatagagatgactttagagaatgtcgtcttttagttccgtctagtcagtgttctattgtcattggtaaatctggttcgattattaagaacattagaggtagaactagagctaacgttaaggttgtctctaaagatgtttctgatccttctcacacttgtgccatggattttgacaacattgttatgatatctggtgagactgaatccgtgaagaaggcacttttcgctgtttctgcaatcatgtacaaagtcagtcctcgagaacagattcctctggatacaactgtccaagaagttcccgctagtattataattccctctgatctgtctatctatccacaagccggtttatacccaagtcaggattctattttccaacatggggctaatgtttcatcgtttatcggtacactacctcagggttatggagaaaatgctgcaaatcctgtgccggttttttctgcttctgctcttcctgttgttcatggttttggtgggtcttccagatcagaaaagttggctataaaagttatttgctcttcttccaaaattggtcgtgttatcgggaaaggaggattaaccattaagggaataagacaagcaagcgggtctcatatcgaagttaatgactcgaggacaaatcatgatgatgactgtgttatcactgtcactgctacagagtctcctgatgatttgaagtctatggcggttgaagctgttcttctacttcaagagaaaattaatgatgaagacgaggacaaagttaaaatgcaactccttgtatcttctaaggtaataggatgcattatagggaaaagtggctcaatcataagtgaaatcaggaaaaggacaaaggccgatattcatatctcgaaaggaaataatacgcctaagtgtgctgatcccaatgatgagctcgttgagatatctggtgaagtaagcaatgtgagagatgctcttattcagatagttctgaggcttcgagatgatgttttaagggatagagagactggttccaggaatcaacctcctgcaagatctgagaataacaatttcttctcttcaagtagtagtaatactggtcttgcacttcctcaatctttcatgtcttctgttccgcaagttgcttctgtagatttcaataggagaccagaaaccgggagcagcatgagcatgcttccttcgagtggtggaatctatggttatggaagttttccggtgggcaatacaagttatggatccaactcctcttactcatccaatctatatggaggattgcctcagtctactactatggaggttcgaatcccagcaaatgcagtgggtaaagttatgggcagaggaggaggcaacttggacaacataagaaggatatcaggagccatgatagaaatttctgattccaaaaattcccatggcggtcgcgttgctctcatttccgggacatctgaacagaagcgtaccgcagagaacttgttccaagcttttatcatgtccacttgaggcgcgcc

SEQ ID NO: 175 - DNA, 930 bp, Arabidopsis thaliana
atggccagttccggtgattatgatgaaattataaagtctatatctgatgccccaccaacacattacatggtcaagatagagtctttctcactccttacaaagcatgctattgagagatatgaaactgagagctttgaagctggtggctacaaatggaaactggttctgtacccaaatggaaacaagagcaagaatacgaaagaccatgtttctgtttacttgtctcttgcggactctagttcattaagtccagggtgggaggtttatgcagttttccgtctgtatttactggatcaaaacaaagataactatttgattctacaaggaaacgagagacggtttcattcggtgaagcgcgaatggggatttgataaattcatcccaaccggtaccttctctgatgcgtcaaacggttaccttatggaagacacatgtatgtttggagctgatgtgtttgtttctaaggagagaagaagtgggagaggagaatgtttatcaatgattaaagatgctactagctctaaacacgtctggaaaattgagaatttctccaagttagacaaagagagctatgactctaatgctttcttcgctggagatagaaaatggaagatagagttttatcctacgggaacaaagcaaggaacaggaacccatctttctatctatctgacccttgttgatcctgaaaccatttcagatggtacaaagatatttgtagagtttacaattcgaatatttgatcagttacaaggcagacacattgccgggaaggttactaaatggtttagtcgatcaagctcggagcatggatgggtgaaatatgtatccatggtttatttcacgcagccaaacagtggtctgttgctcaaagatgtatgtcttgttgaagctgatgtatgcgttcatggaatcaccagtgcaatctaa

SEQ ID NO: 176 - DNA, 1116 bp, Arabidopsis thaliana
atgaacaagaacaagattgatgttaagatcgagacgaagaaaggatcgatggatgagtggcctgagccaatcgtccgagtccagtccttagccgagagcaacctctcctctctccccgaccgttacatcaaaccagcgtctctacgccccaccacgaccgaagacgctcctaccgcgaccaacatcccaatcatagaccttgaaggactcttctcggaagaagggttgtctgatgacgtcatcatggctcggatatcggaggcttgccgtgggtgggggttcttccaggtggtgaaccacggggtcaaaccggagctgatggacgcggctagggagaattggagagagtttttccatatgccggttaatgccaaagagacttactcaaactcaccaagaacctacgaaggctatggaagtagactaggtgttgagaaaggagcaagtcttgattggagtgattattactttctccatcttcttcctcatcatttgaaagacttcaacaagtggccttcttttcctcccaccataagagaagtgatcgatgaatacggcgaagagctagtgaagctaagtgggagaattatgagggtattatcgacaaacttgggactaaaagaggataagtttcaagaagcatttggaggtgaaaacattggggcgtgtttgagggttaattattacccaaaatgccctcgaccggagctggctcttggtctctctccacactccgatcctggcggtatgaccattctcttaccggacgatcaagtcttcggtctccaggttcgtaaagatgacacgtggatcaccgtcaagcctcatccccatgctttcatcgtcaatattggtgatcaaatacagatactaagcaactcaacatacaagagtgtggagcatagagtgatagtgaactcggacaaggagagagtttcacttgccttcttctacaatcctaaaagcgatattccgatccaaccattacaagaacttgtatcaactcataatcctcctttataccctcccatgacctttgatcagtatagactctttatcagaactcaaggtccacaaggcaaatcccatgttgaatctcatatttctcctcgttga

SEQ ID NO: 177 - DNA, 1392 bp, Arabidopsis thaliana
atggggaaagttccgtcgtcgtttcgtagtatgccggcgaacttattggtcagaaaaacaacaccatctcctccagcgccgccgcgagattttcgcaacagaaccgccgtgggaggagattcagccaaacttccccagaatactcaagcccctcgcgagccctccttgaggaatccattcaagtcaccaaatctctcagacgctaaaagcctcttcaattcaatcgccgccacttcacgaatcccactcgatctcaagttccacaactctgttcttcaatcatacggttcaatcgccgtcgtcaacgatacggtgaaactctttcagcatattttgaaatcgcagcctaatttcaggccgggacgttcaacgttccttatcttgctttcacatgcttgtagagctcctgattcgtcgatttcgaatgttcatagagttcttaatctcatggttaataatggtttagagcctgatcaagtaactaccgatatcgcggtgaggtctctttgcgaaacgggtcgggttgatgaagctaaggatttgatgaaggagctcactgagaaacactctcctccggatacatatacttataactttctactgaagcatttgtgcaaatgcaaagatcttcatgttgtttatgagtttgttgatgagatgagagatgatttcgatgttaagccggatcttgttagcttcactatcttgattgataatgtttgtaactctaagaacttgagggaggcaatgtatctagttagtaagttaggtaatgctgggtttaagccggattgtttcctctataacacgattatgaaaggtttttgcacactgagtaaagggagtgaggcggttggtgtgtataagaaaatgaaggaagaaggtgttgagccagatcagattacctacaatactttgatatttggactgtcgaaagctggtagagttgaggaagctaggatgtatttgaaaactatggttgatgcggggtatgagccggatactgctacttacacatcactgatgaatggaatgtgtagaaaaggtgagtctttaggtgcgttgagtttgttagaagaaatggaagcaagagggtgtgctccaaatgattgtacttataatactttgcttcatggattgtgtaaagcaaggttgatggataaagggatggagttatatgaaatgatgaaatcaagtggtgtaaagcttgagagtaatggttatgctacacttgtgaggtctctggttaaaagtggcaaggtcgcagaggcttatgaagtgtttgattatgcagttgatagcaagagtttgtcagatgcttctgcgtactctacacttgaaactaccttgaaatggttgaaaaaagctaaagaacaaggcttggttccataa

SEQ ID NO: 178 - DNA, 369 bp, Arabidopsis thaliana
atggcttcaaagaacactacagctttcttcctcaccatcaacctcatcttatttggcttcaccgtggcccaacctccgacatgtccaagggacatcgaagcttgtagcaacgtgtttggcctgggcaggattctcaactatcaaacagtgaggccatgttgcactctcgtggatgggcttgacgcctatgtggcatctgtctgcatctgcgattccattaaaatatatggcatcagttatccattcactgtgggacttgttcaagttcttagcctttgcggagcggactatcccccacctggtttcagatgcagagagaacgaaatttccgtattatcatataataatggtgcaagtatggctctctaa

SEQ ID NO: 179 - DNA, 723 bp, Arabidopsis thaliana
atgtgtacgttagagaaacgcggcgatctcttcctcctaaccctaaccggagacggcgaacacagattccaccccgacacaattgccaccattctctcccttctcgaacaagccaaatctcaatccacccgtggatccatcctcatcaccaccgccaacggcaaattcttctccaacggattcgatcttgcatgggctcaaaccgccggatccaaaaccggagccgcaaaccggcttcaccaaatggttgaatcattcaaaccggtggtagcagcgcttctcgatctccctatgccgacgatcgccgccttgaacggccacgccgccgccgcgggattgattttggctttgagccatgattacgtgttcatgaggaaagatcgtggggttctgtatatgagtgaagttgacatcgggctttcgatgccggattatttctcggcgttggttagggctaagatcgggacgagtgcggcgaggagagagctgttgttgagtgggaagaagattagaggagaagaagcggtgggtttggggattgttgactcggccgcgtatgatagtgaggaaggtgttgttgtggctagtgtgcgccttggtgagaaattggcggcgaagaaatggagcggtgaggtttatgcgtcgataaggaagagtttgtatccggagctttgtgggattcttggtttagagactagagtgtttgcaacacctaagctctaa

SEQ ID NO: 180 - DNA, 423 bp, Arabidopsis thaliana
atggcgtcgctttgctctgcgaggttccttccttctccatcgctcgatattttatctacgaagacgaagatatcctccgactcgcgctcgcttggttgctcttcgtcgcgtgtctttgctttctcttccgttcaccgttcttcttcgcgtcgcaatcggaatcagctgcaagttgtgtctatggctcctgaggaagaaaagctcactcgtcgtaatcctctcgatttcccaattgagtgggaaagacctaaacctgggaggaggcctgacattttccccaagtttagccctatgaagacaccattgccaccaccgatgccttatgatcctccggaagaggatgaagaagaggaagagaagaaagaagaggaagaagaaaacccagaccaagaagaagaggaacaacccgagaagcagcaatag

SEQ ID NO: 181 - DNA, 807 bp, Arabidopsis thaliana
atggaaatggtgacaagttttgtatatccaccacctccatcaatattgctcaattgtatgagcgtcgttggtgtagctgctctggccaatatcggttggtctgaaatcagaggaaatcatctcaaatactccaaattcggcgtatcatcatcatcaccacaaccacagaaggagcgattcggcagcatctcaagccgaaatggaatgcttttgctatacacacctgcgtttctagcagctgcgtcttctttcttcgtcgtaccttctgatgatctcaggtttcttcttctcaaatccgcacttgccctccatttcttcaagagggtattcgaggttctgttcatacataaatacagtggagggatggctatagactcagctctcaccataagtagcagctatttctcatccacagcattgatgttatacagtcaaaatctcaccttgggacttaccgagccgagtttcgatatgaaactcgccggagttgtgatgtttgtggtgggaattgttgggaatctgtatcaccatgttttgctggctaagctaaggaaagaagatgggaagaaagagtacaagataccaaaaggaggtctctttgatataatcatatgccctcactatctatttgagatccttgtgttttggagcttctttctcatctctcagaccatttattcattttctttcgctatgggaacaatgctctatctcattggtcggagttatgctacaagaacttggtatctttccaagtttgatgacttccccaagcatatcaaggctctcattccctttgtattctag

SEQ ID NO: 182 - DNA, 790 bp, Arabidopsis thaliana
ttaattaaatgagttcaatgagcagaagcagaagtcgaagtagaagtcgtagtcgggatcggtttcgtagtcggagtccgagagacaggagaatgagatctgaacgagtttcttaccatgatgctccttctagaagggagagggagccacgtcgtgccttcagccaaggaaatctctgcaacaactgcaagcgacctggtcactttgcaagagactgttctaatgtttccgtctgtaacaactgtggtcttccagggcacattgcagcagaatgcactgcggaatcacgttgttggaactgtagagaaccgggccacgtagcctcaaactgttcaaacgaaggaatctgccactcctgtggtaaatctggacatcgagccagagactgctctaattcggattctcgtgcaggagacttaaggctctgcaacaactgcttcaaacagggacatcttgccgctgactgcacaaatgacaaggcgtgcaagaactgcaggacttcaggtcacatagctcgcgattgcaggaacgatccagtttgtaacatctgcagtatctcggggcatgttgctagacactgcccaaagggtgacagcaattactctgacagaggaagcagggttcgagatggtggtatgcaaagaggtggtttgagcagaatgagcagagacagagaaggcgttagtgctatgataatatgtcacaattgtggtggccgaggacacagggcgtacgagtgtccgtctgctcgagtcgctgaccgtggattccgccggtactgaggcgcgcc

SEQ ID NO: 183 - DNA, 1359 bp, Arabidopsis thaliana
ttaattaattcagagagttttatcgatcagatcattttttctcaatgacgaaaaaggcggtgcttattgggatcaattacccaggaaccaaggcggagttacggggatgcgtcaacgatgttcgtcgtatgtacaaatgtctcgttgaacggtacggcttctccgaggagaacatcaccgttctcatcgacaccgatgaatcctctactcagcctactggcaagaacatccgccgcgcgcttgctgatctcgtcgaatctgccgattccggcgacgttcttgtcgttcattacagtggacacggtacgaggttgccggctgagactggtgaagacgatgacactggtttcgacgagtgtattgttccttgcgacatgaatctgattactgatgatgattttagagatcttgtggacaaggttcctccaggttgcagaatgacaatcatttcagactcttgtcacagtggtggcctaatcgacgaagccaaggagcagattggagagagcactaagaaagaagccgaggacgaagatgaatctgaagaatcttcttcaagattcgggtttaggaagttcttgcgcagcaaagtggaaggcgccatcgagtctcgagggtttcacattggagggaacaagaaggatgaagatgaggcggaagaaatcgagactaaggagattgagcttgaagacggagaaacgatccatgccaaagacaaatctcttcctctgcagaccttgattgatattctcaagcagcaaacagggaatgataatatcgaagttgggaaaatcaggccaagcctttttgatgcgtttggtgatgattcgagcccgaaagtgaagaagtttatgaaagtgatcttaggtaagcttcaggctggaaatggagaagaaggtggattaatgggaatgcttggcaaattggcttcagggtttcttgagggtaaactaaacgatgaagactatgtgaaacccgctatgcagacacacgttgggagtaaagaagaggtttatgctggtggatcaagaggttcggttccgcttccagacagcgggatactgatcagcggttgccaaaccgatcagacctctgctgatgcgactccagcggggaaaccaactgaggcttatggagcgatgagcaattcgatacagacgatattggaggagacagacggtgagatatcaaacagagaaatggttacaagggctaggaaggcattgaagaagcaagggtttactcagcagccaggtttgtattgccatgatggttatgccaacgctcctttcatctgttgaaaacagaggttttattgaatgttttttactacgtacgacacgttgattgaggcgcgcc

SEQ ID NO: 184 - DNA, 630 bp, Arabidopsis thaliana
atgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaa

SEQ ID NO: 185 - DNA, 1287 bp, Arabidopsis thaliana
ttaattaacaatagatttgtgggggtgaagtaaggaacatggaggaaacaatggcagctaggtattggtgtcacatgtgttcacaaatggtgaatccagtaatggaatctgagatcaaatgtcccttttgccaaagcggattcatcgaagaaatgagcggtaatggcggtggaggtggtggcagaggcataagagatgttcaagattcagaaaccgattttggaacagaccgtgcattgtctctatgggcaccaatcttgcttggaatgatgagtagtcctcgaagacgaagaaggtttagaagatcagagtttggtgaagagaatgatgataatggtgatgacttgactactaatgctgatgggaatgggaatgatagtaacaacagtaataataacgtgtatcgtcatcatcgagctaggagacatggtggagagattgatttagatagagagtttgaatctatcttgaggagaagacgaagaagctcagggaatatattgcagttgcttcaagggattcgtgcagggattgcttctgagtatgaaagctctgataacaattgggataattctcgagagagggatagagttataatgattaatccgtataaccaatcgctagttgttccttcggatcagaatcagaatcatccttcattgacttcacttggagattacttcattggacctggtttagatcttttgcttcagcatttggctgagaatgatcctaataggcaagggactccacctgctcgtaaagaagctgttgaagctttaccaacggttaagataatggaacctttgcaatgttctgtttgtttggatgattttgagaaaggtacggaagctaaagagatgccttgtaagcataagtttcatgttcggtgtattgttccctggcttgagcttcatagttcttgtcctgtgtgtcgttttgagcttccttctagtgctgatgatgatgatgagactaagactgattccgagagagtgctgagaacaagaaatgttcgggaaacgagtaacggaaacgttgttgagaatgtgggaaatgcggatagaggaagagaggatgaggtgaggagtggaaatgggagacggttttcgtttccatggccgtttagtggattgttctcgtcttcttcttcttcgtcttcttcaacctctggatctcaatctggtgagaacaatttcttctcaagatcttctggttcttctcgctgagagcaaaacaatcaaaaactaaaacatcttggattttgttattgttcttcggcgcgcc

SEQ ID NO: 186 - DNA, 774 bp, Arabidopsis thaliana
atggatgcttcaaatcccaattcttctagaaaatctaatgtctcttccttcgctcagtccagtcgaagcggtggtagaggaggaggatatgagagagataacgatcgacggagacctcagggtcgtggcgacggtggaggcggaaaggatagaatcgatgcacttggacgactcttgacgagaatattgcgacatatggctactgagctgagattgaacatgagaggtgatggttttgttaaagttgaagatttacttaacctgaatttgaaaacttctgcaaatattcagttaaagtcacacacgattgatgaaattagagaggctgtgagaagggacaataagcaacggtttagtctcatcgatgagaatggagagctcttgattcgcgctaaccaaggccattcgatcacgacggttgagtcagagaagttacttaaaccaatactgtcaccagaagaagctccagtgtgtgtacatggaacttataggaagaatttggaatccatcttagcatcgggcttaaagcgtatgaatagaatgcatgttcacttctcttgtggattaccaacagatggtgaagtgattagtggcatgagaagaaatgtaaatgttatcatcttcctcgacatcaagaaagctcttgaagatgggattgcgttctacatatcagacaacaaagtgattttgactgaaggcattgatggtgtattgcctgtcgattacttccagaagatcgagtcttggcctgatcggcaatccatacctttctga

SEQ ID NO: 187 - DNA, 1053 bp, Arabidopsis thaliana
atggataagtatcaacgagtggtgaagccgaaagcggatacgccgattgatgcgaatgagattcgtatcactagtcaaggcagggcacgaaactacatcacctatgcgatgactcttcttcaggataaagggtcaactgaagttgtattcaaggcaatgggaagagctatcaacaagactgtgaccattgtagagctgattaagagaaggatccctgatcttcatcagaacacatctattggatccacagacatcacagacacatgggaaccaacagaggaaggccttctacctttggagactacaaggcatgtgtcaatgataaccattaccctatccaagattgagcttaatacctcctctgttgggtaccagtgcccaattcctattgagttggtgaagccaatgggcgatattgattatgaaggacgagagggttcacctggtggcagagggaggggaagaggaagaggaaggggaagaggaagggggcgaggtggcagaggaaatgcttatgtgaacgttgagcatgaagatggaggttgggaacgtgagcagtcctatggtagaggaagaggacgtggcagaggacgcagcagtcgtggtcgtggaagaggaggatacaatggtcctccgaatgagtatgatgcaccacaagatggaggttacggttacgatgctcctcatgaacaccgtggatatgatgaccgtggtggttatgatgcccctcctcagggccgtggtggttacgatggtcctcagggtcgcggtggttacgatggtcctcagggtcgccgtggttatgatggtcctcctcagggccgtggtggttatgatggtccttctcaaggccgtggtggttatgatggtccttctcagggccgtggtggttatgatggtccttctcagggccgtggtggttatgatggtcctcagggtcgtgggcgtggacgtggacgtggaaggggaggacgtggaagaggaggaggacgtggtggtgatggtggtttcaacaacagatcagatggaccaccagtccaggcagctgcttga

SEQ ID NO: 188 - DNA, 1014 bp, Arabidopsis thaliana
atggcaaccatggctaggtcgtttctgcaggcgatatcgaaggatgaggcggtggctcctccgcttagagttgttcagatcgaaggactggctgtactaaagataatcaaacactgcaaggagttttcaccgacccttgtcactggacagcttcttggacttgatgttggtagcgtcctcgaagttaccaattgttttcctttcccggtcagggatgatgatgaagaaattgaagctgatggtgctaattatcagcttgagatgatgagatgtctgagggaggttaatgttgacaacaacactgttggctggtatcaatctacagttcttggttcgtatcagactgtggaactgattgagaccttcatgaattaccaggagaatatcaagaggtgtgtgtgcatcatatatgatccctctaaagctgatctaggcgtcttagctttgaaggctttgaagctttcagattcctttatggagttgtaccgaggtggaaactttactggcgagaagttgagagagaaaaatttctcctggatggatatttttgaggaaatacctatcaaggtttcaaattctgcccttgtcagtgcctttatgaccgaactggagactgatacacctgtctcacagggcgattatgatcgtctacactcatcaaccactcctttccttgagaacaatatggagtttttgattaaatgcatggatgatttatctatggaacagcaaaagttccagtattactaccggaacctgtctcgtcagcaagcacaacagcaagcctggctccagaagagaagaacggagaacatggctcgtaaatcagctggagaggagcctttaccagaagaggatccttcaaacccaatctttaaggcgatccctgaaccatctaggctagagagtttcctcatcacaaaccaagtctcaaacttctgtggccaaatcaatggagtggctggccagaacttcagcaggctttacctgaccaaagcattgcacgacaactga

SEQ ID NO: 189 - DNA, 978 bp, Arabidopsis thaliana
atggcgatcaagaacattctcgcccttgtggttcttcttagcgtggttggagtttctgtcgccattccacagttgcttgacctcgactactaccggtctaagtgtcccaaggcagaggaaattgttcgtggtgtcacagtacaatatgtttctcgccagaaaacccttgccgctaaacttctaaggatgcatttccatgattgtttcgtcagaggatgtgatggttccgttcttctgaaatctgcaaagaatgatgcggaaagagacgctgtccccaacctgaccctgaaaggttatgaagtggtggatgcggccaagacagcgctggagaggaagtgtcctaatctcatttcttgcgctgatgttcttgccttggtcgccagagatgccgtggcagtgatcgggggaccatggtggccggttccattgggccgcagggatggacgcatctcgaaattgaacgatgcattgctaaatttaccatctcctttcgccgacataaagacgctgaagaagaactttgccaacaagggtcttaacgctaaagaccttgtggttctctcagggggtcacaccattggaatctctagttgcgctctcgtcaacagtcgtctctacaacttcacaggaaagggcgattctgacccatccatgaaccctagctacgtgagggaattgaagagaaagtgcccgcctacagatttcagaacctcactgaacatggacccaggcagtgcgttgacattcgacactcactacttcaaggtcgtggctcagaagaaagggctcttcacatctgactctacgcttctcgatgacattgagaccaaaaactacgttcagactcaggccattctccctcctgtgttttcttctttcaataaagatttctccgattccatggtcaaacttggtttcgtccaaattcttaccggcaaaaatggtgagatcaggaagagatgcgccttccctaactaa

SEQ ID NO: 190 - DNA, 1104 bp, Arabidopsis thaliana
atgggacacctaattcctcaaaccggagatgaagagaccgagcttggtttagctgcggttaggctagctaactgtgcagccttcccaatggttttcaaagctgccatcgagctcggtgtcatcgacactctctacttagctgctcgtgatgacgtcaccggatccagttccttcctcacaccttctgagatagctattaggctccccacaaaacctagtaaccctgaagcaccagctctgttggatcgtattcttcgtttacttgctagctactccatggtcaagtgccaaattatcgatggtaacagagtctacaaagcagagccgatttgtcgatatttcttgaaagataatgttgatgaagaattaggaacacttgcttctcaacttattgtcactctcgataccgtcttcctcaatacatggggagaattaaaaaatgtggtactagaaggaggagttgcatttggccgtgccaatggtggtttgaaactctttgactatattagcaaagatgagagattaagcaaactctttaaccggaccggattctctgtcgcggttttgaaaaagatcctacaagtttatagtggtttcgaaggagttaatgtgttggttgatgtagggggtggagttggtgacacacttggttttgttacttcaaagtatccaaacattaagggtatcaattttgatctaacttgtgctttaacacaagctccttcttatcctaatgtggaacatgtagctggagacatgtttgttgatgtcccaaaaggtgatgctatcctcttgaaacgtatacttcatgactggactgatgaagactgtgaaaagattctcaagaattgttggaaagcattacctgagaatgggaaagtgattgtcatggaagtagttactccagatgaagcagataatcgtgatgtgatatccaacattgcttttgatatggatctgttgatgctcactcaattatctggaggtaaagagaggtcgcgggccgagtatgtagctatggctgctaactcgggttttccgcgttgcaactttgtatgcagtgcatatcatttgtgggtcattgagttaacgaaacaggcttag

SEQ ID NO: 191 - DNA, 771 bp, Arabidopsis thaliana
atgagagctattcaaactcatgtgataaccttctgcatgttagtcatcatcgtaacatcatcaacaagagcccaaaagagtcctcatgtgcctaacaaccatgaactttctatcgccatcgaagaaatggagaaagcaaattacttctcttttgtgatgctcatcaacatgttaccatccgtaaatcctcgattcttagccaatgtcacattcttgatgccaaaggacaaaaccctttctacatcaaacattattaatcaacaagattcggttaccgagttcttgcttcgccactcaatcccttcttctcttcttttcgagcaccttaatctcatccccaatggctccattgttccttcctctttaccacattacaccctcgagatctccaatggtggaagatcaaactactttctcaataacgtcaagattataagccgcaacatatgtagcttaggctctatcaaatgtcatggaatcgacggtatactacaatctccaagtactgtcgacgacgattctcctcgaaataatcacacattacccttcatttcttgccctagcagtcacaacaatagtgaccaaaatagtcataacaatagtgatcaaaatagttctcgtcctgctgatcatactcttaccgctcctcctccagtcagcagtccgattagccagccaaaatcagattctcctagcatccatgacgtgaaaatgctgacttcgatcgttattcctttgtttggattattagcgagtttgatcggcatgtga

SEQ ID NO: 192 - DNA, 1593 bp, Arabidopsis thaliana
atggaggaagagcttcgtgttcggctgaatgaccatcaagtgtcaaaggttttccctgtgaagcccaaatcaacggcgaaacctgtttccgaatcggagactccggaatcgaggtactggtcctccttcaaaaatcattccacacctaatctcgtctcctccgtagccgctttggctttctctccggtccaccctcactccttggccgtcgctcactccgccaccgtctccctcttttcctcgcagtcgctttcctcctcccgccgtttctccttccgcgatgttgtctcctccgtctgtttccgttccgacggagctcttttcgcggcatgcgatctctccggtgtggtccaggtcttcgacatcaaggaacgaatggctctccgtactctccgctcccacagcgcccccgctcgattcgtcaagtatccagttcaggacaagctccacttggtctccggaggcgacgatggagtcgtcaagtactgggatgtcgccggagcaacagtcatctcagatctgctaggccacaaggattatgtccgctgcggtgattgctcgcccgtcaacgattcaatgttggtaacaggctcttacgatcacacggtgaaggtgtgggacgccagagtccacacgtccaattggattgccgagatcaaccacggactcccagtggaggacgtcgtatacctgccttccggtggattgatcgcaaccgctggtggcaacagcgtcaaggtatgggatttgatcggaggcgggaagatggtttgctccatggagagtcacaacaagaccgtcacgtctctccgcgttgcgagaatggaatcggctgagagtcgacttgtgagcgttgctttggacggatacatgaaagtcttcgattacgggagagcaaaggtgacttactctatgaggtttcctgctcctctcatgtctcttggcctttcccccgatggttccactcgggtaatcggagggtctaatggcatggtgtttgccggtaagaagaaggtgagagatgttgttggaggacagaagaaaagtttgaatctctggagtctgataagcgatgtggatgagagtaggagaagggcactgaggcctacgtatttcaggtacttccagagagggcagagcgagaagccatccaaagatgattacttggtcaaggagaagaaaggattgaagctgacgagacacgataagctcttgaagaagttcaggcataaggaagctctggtctcggtgttggaggagaagaaaccggccaatgttgtggcagtgatggaagaattagtggcgaggaggaagctgatgaagtgcgtgtcgaatatggaggaaggcgagttgggaatgctgctaggcttcttacaaaggtactgcactgtgcagaggtattcaggattgttgatgggattgacgaagaaggttttggagacgagagctgaagacatcaagggtaaaaacgagtttaaagggcttctcaggaacttgaagagggaggttaatcaggagattaggatacaacagtctcttctagagattcagggtgttattgctcctttgatgagaattgcgggtagaagttga

SEQ ID NO: 193 - DNA, 2175 bp, Arabidopsis thaliana
ttaattaaaaatggaatcactaattgaagaagaagaagagtctcgatttttcgatgctcacgaagaaatcgcatcttgttcaagtccttgtaaaatcgaatctccatcgtcgatttctggagaatttcgttacgatgtttggatcaaaagccctggtaacactgaggagcgtcgtgagaagtttttgaagtggatgggtttaagtagtactgtaaacgaatcgaaatcaggtaatgtgtatcggttatcgagctcggttaacgaatcagcggttttgatgagtttgaaatctgatgacgatgagtttagctcttctcgttgtgattcttttagtccaagtgagagtgtagatagagttgtgaatgagagtttgtgtaaagaggaaggagaagtagatagtggtatggttttgaggaatttgggttttgttgatgatggtgatattagctctagtctttgttctttatcatcatctcctgtatcggataagattgtgaaggaacatggtgaacctaagttgttaccagacccgatggttgctgaggaggaacgggaagtaagtgggattatgaagagggttaaggagaaatggttgagtcggttgtacaaagtgcggaacaagcgaagtgcgggaggagatgataatggcggtgaagttgcggtttgcgggagtaggattgagagagtgaaggtgaaagagtataaaaaagaggctaaggagctttctgctctttttaaaggtcaagagatacaagctcatgaaggagcgattctcgctatgaagtttagtcctgatgggaggtatcttgcgagtgctggtgaagatggggttttgcgggtttggagtgttgttgaagacgaaagatgtgaagaacatgatgttcctaagattgatccttcttgtatatactttgaagtgagtaaactctctgagttgagaccggtggctgtagaaaaggatgggattactggttcgttgatgagtccaaggaagacaacagagtctgcttgtgttattattcccccaaagatttttcgggttcttgataaaccgcttcacgagtttctcggtcacagtggtgatatccttgatatctcttggtccaagaacaataaaactagaccgagttgctcattctgtgatattggtggcagcgtctgttgtcagcttcagtagacaatagtgttcggctttggcagatcggctgtgaggactgtcttggaatcttctctcacaataactacgttacatccgttcagtttaacccggttgatgatgatcacttcatcagtggttccatagatggaaaagttcgtatctggtcagcttcacagtgccaagttgtagattgggccgatgctagaggcattgtaaccgcagtttgttatcaacctgatgggcaggcagtgattatcggaactttgacaagcgattgtcgcttctacaatgtatcaggccactgccttcaacttgatggtcatatatgtctgcacaacaaaaagaagtcgtcgaataaacgaataatcggctttcagtttgattctactgacccaagcagagtcatggtggcatcagcagattcacaagtgaggatcattagtggtcgcaacgttgtccacaaatacaaaggatctcgaaatgctggaaaccagatatcggcatcttttacagcagacgggaagcatatagtctctgcgtgtgacgattcatcggtctacgtctggaactgcgttggacacgaccctgaacagtcgtctcctggttttttctctcacaccaaacgacttaaaatccgatcattcgaaaaattctctgcggatgtttcagtagctatcccgtggtgcggatttacgcctgtactctccggcggatccgagctatcgccatcgctcttctcattagggcgcgagtacgttctcgattctcccaagggatctgccacttggccggaagagaagctagcgagctcgttttctccggtgaaagcgatccgtagatcgcattacaaattcctccggtcttcgtgccggagaacgtcggagtcatctcatctctggggattggttatagtcaccggtggttgggatggacggatcaaattgtttcacaactatggtttgcctgttcccgtttgaaatccaacgaggctacgaaacgctccttctcggcgcgcc

SEQ ID NO: 194 - DNA, 1080 bp, Arabidopsis thaliana
atggacatggagtcgaagaaaccatatctgatggttactataatacaagtcatatatacaatcatgttcttgatctccaaagccgtcttcaacggtggaatgaacactttcgtctttgttttctatcgtcaagctttcgctaccatcttcttggctcctctggctttcttctttgagcggaaaagtgctccacctctttcatttgtgaccttcatcaagatcttcatgctctctttatttggtgtgacattgagcttggacttaaacggtatcgcattatcatacacgtcggcaactttagccgccgccacaacagcttcccttccggccatcacattcttcttggctcttttatttggaatggagaggcttaaggttaagagcatacaaggaacagcaaagcttgtggggattactgtgtgcatgggaggggtaattatcttagctatttacaaaggtccattactgaaattacctttatgccctcatttttaccacggccaagaacatcctcaccggaataatcccggccacgtctccggcggttccacctcgtggctcaaaggatgtgtcctcatgataacctccaacattctatggggtctctggctcgttttacagggtcgtgtgttgaaggtttatccttcgaagctatatttcacaactcttcattgtctattgagttccattcaatcattcgtcatcgcgattgctttagagagagatatttcagcatggaagcttggttggaacctaagactcgttgcagtcatttactgcggattcattgtaacaggcgtagcatattatttgcaatcatgggttatagaaaagagaggacctgtcttcttatcaatgtttactcctttgtctctcctcttcactctcctctcttcagcgattctcttgtgcgagatcatcagtcttggaagtattgtaggtggattattattgatcataggactttactgtgtgctgtgggggaaaagcagagaggagaaaaacagtggtgatgataagattgatttacagaaggaaaacgatgtcgtgtgcaatgaagtgaaggttgtcattagttga

SEQ ID NO: 195 - DNA, 918 bp, Arabidopsis thaliana
atggagcggagccgagtgaccagagaagcaccgaccggaaccaggatcctgcttgcttcactctctgcgatggttgcagagtcagttacgtttccgattgatctcacaaagactagaatgcagctccatggttcgggatccgcttctggtgcgcatcggattggcgctttcggagtcgtatcggagattgcgagaaaggaaggagtgattggtctctacaaaggtctatctccggcgattatcagacacctgttctacacgcctatcagaatcattggatacgagaatttgaaaggactcatcgtcagatctgaaactaacaatagcgagtctcttcctctcgccacaaaggctctcgtcggaggattttctggtgttatagctcaggtagtggctagtccagctgatttggtcaaagtgagaatgcaagcagatggtagattggtgagccaaggcctgaaaccgaggtactcgggaccaatcgaggcttttaccaaaatcctacaatcagaaggagtaaaagggttatggaaaggtgttcttccaaacatccagagagcatttctagtgaatatgggagaactagcttgctatgatcacgccaaacactttgtcatcgataagaagattgctgaggataacatttttgcgcacactcttgcttctataatgtcgggtcttgcttcgacaagtttgagttgtccagctgatgtggtgaagacgaggatgatgaaccagggtgaaaatgctgtgtacagaaattcttacgactgtttggtgaagacggttaagtttgaaggaataagagctttgtggaaaggtttcttcccgacatgggcaaggcttggaccgtggcagttcgtgttttgggtctcctatgagaagtttagactgctggcaggaatctcttccttctag

SEQ ID NO: 196 - DNA, 1494 bp, Arabidopsis thaliana
atgcctcaggcaccgatgccagagttctctagctcggtgaagctcaagtacgtgaaacttggttaccaatatttggttaaccatttcttgagttttcttttgatcccgatcatggctattgtcgccgttgagcttcttcggatgggtcctgaagagatccttaatgtttggaattcactccagtttgacctagttcaggttctatgttcttccttctttgtcatcttcatctccactgtttacttcatgtccaagccacgcaccatctacctcgttgactattcttgttacaagccacctgtcacgtgtcgtgtccccttcgcaactttcatggaacactctcgtttgatcctcaaggacaagcctaagagcgtcgagttccaaatgagaatccttgaacgttctggcctcggtgaggagacttgtctccctccggctattcattatattcctcccacaccaaccatggacgcggctagaagcgaggctcagatggttatcttcgaggccatggacgatcttttcaagaaaaccggtcttaaacctaaagacgtcgacatccttatcgtcaactgctctcttttctctcccacaccatcgctctcagctatggtcatcaacaaatataagcttaggagtaatatcaagagcttcaatctttcggggatgggctgcagcgcgggcctgatctcagttgatctagcccgcgacttgctccaagttcatcccaattcaaatgcaatcatcgtcagcacggagatcataacgcctaattactatcaaggcaacgagagagccatgttgttacccaattgtctcttccgcatgggtgcggcagccatacacatgtcaaaccgccggtctgaccggtggcgagccaaatacaagctttcccacctcgtccggacacaccgtggcgctgacgacaagtctttctactgtgtctacgaacaggaagacaaagaaggacacgttggcatcaacttgtccaaagatctcatggccatcgccggtgaagccctcaaggcaaacatcaccacaataggtcctttggtcctaccggcgtcagaacaacttctcttcctcacgtccctaatcggacgtaaaatcttcaacccgaaatggaaaccatacataccggatttcaagctggccttcgaacacttttgcattcacgcaggaggcagagcggtgatcgacgagctccaaaagaatctacaactatcaggagaacacgttgaggcctcaagaatgacactacatcgttttggtaacacgtcatcttcatcgttatggtacgagcttagctacatcgagtctaaagggagaatgaggagaggcgatcgcgtttggcaaatcgcgtttgggagtggtttcaagtgtaactctgccgtgtggaaatgtaaccgtacgattaagacacctaaggacggaccatggtccgattgtatcgaccgttaccctgtctttattcccgaagttgtcaaactctaa

SEQ ID NO: 197 - DNA, 2685 bp, Arabidopsis thaliana
tcttcgcaaaagccctagttttgatcatcgcacttcactctcctccgcatgagaaatcgagaaatccgctcgacgtagtagatagataaaaccacaaagttagggttttttcaattgggtatggaacctcgtgttgggaacaagtttcgccttggccgcaaaattgggagcggctctttcggagagatttacctcggttcgttcctcccctctctatacatataaaatctcttcaatagtcgtttgatgagactgttttgattgcaggaactgatgttcagactaacgaagaagttgctattaagcttgtgagtgtttcatctcttcaaagtcccaacttggatcatcaaaacttagttttttttgtgtgtgtgcaggaaagtgtgaagactgcgcatccgcaattgtcatatgagtcgaggatatatagagttcttcagggtggaagtatgcaatgaaatgtttatctctattgttattgaattctcatttggttattcatttcttgtgtatgttcgttaatgtagctgggattccaaatatgaaatggtatggtgttgagggggactacaatgtcttagtcatggatttgcttggtccaagtcttgaagatttgtttagttattgcaagaggcagtttagcttgaagactgttcttatgcttgctgatcaaatggtaattatgctttggattggtgtcttgtcattcttaatgtaactctctcactgttgggtttatcttgtgtcagataaatcgtctcgagttcattcattctaagtcgtatcttcatcgtgatataaagccggataattttctcatgggcttagggaggcgggcaaatcaggttttcttacttttgcaaattctctcagttggatttgtttttggggtctcgctattgtatgactgattttggtctctttctctaggtctacatcatagactatggtttggctaagaaatatagagacagctcaactcatagacatatcccatacaggtaacaagattttggatgtcacagattcagcattttcagcatattgtatgtcagcttcagatttcctgacaacgggttctttattgtttggattttacgtgtaaatgattcagggagaataaaagtctaattgggactccgaggtatgccagcttgaacactcacctagggattggtatactccatcactttctataaaccctcatgataatcgcggatctttttctcctctttcactgattactttttgacatttttcacttggtagagcaaagtcggagagatgatatagaatcgcttggttacatcctcatgtatttcctcaagggaaggtgagagtcattaagtaacttttctttctgttctgattcttgtctcccaatccatctctaatatcttattctcttgtagtctcccttggcaagggctgaaagctggaaacaagaaacagaagtatgataagatcagcgaaaagaaggtttcaacttccatcgaagtaagttcttcttatatggtttacatttagaaacttatacgaatccatgtttcaaaggattatgatcaggtagagacggttgatcatagatagtactgtaactttgcagacgttatgcagaggtcatccaacagagtttgcatcttacttccattactgccgctcacttaggtttgatgataagccagactatgcatatttgaagagactattccgcaacctttttatccgggaaggtcattcattttctctatctctcttcttcctctcaggctattaagttcatacagaagcatctgttgactcaaaatgagtattttgtttgtcccaggttttcagtttgattttgtgtttgactggacagtatacaagtatcagcaatcacaatctggaaaccctcaacctcgtccccatgtacactcttgatactttaaagtttctatcccgttcatgatacatatacatacacagatgaataatgcaagatctttctatgtttcttttttcaggatggtggtgttggaactagttctggattaaaccctgcggttggcaattctgagaagcgtccaggtatatttttgaatgcttattatccttctttatgaaaatgcagccgcatagttgtccattgatttatatactaagggcgtgtttgtctgccatagatgtcccaaatcagaggacaaatccggattttaccctgaagcagaaagacaagaatggaaatgattctgcaattgcaaaggacaagctggtaagtttcttgtcatgctgtttttttttcttctcgggtaccttcttttgagtcgggatgttcattgtgatccattgatttctcagctacctggatctttgaacttgggccgatcagagggatcatcgtcaagacgagttgtggacacgagcagtcgtgaaccatttagtggcgggagtgacaatgcaaactatgaaaccgcactcaaaggcattgatggtttacggatcaataacaatgcaggcgatgagacagcagcaacgccacaatcaaatggagacgatgtagaaccccaaagcaaagctctctgactgattcatacaaagcagctataaaacaaaacctgtactcactcagtgacgttgtctatgattcttctgaagaaaggctattttcacagctagagaactgatgatatataagagagagat

SEQ ID NO: 198 - DNA, 1560 bp, Arabidopsis thaliana
ttaattaagtgttaattatttttattctgcgtacgttacgtaagagagatattgaggaatggctgcgaagaaggtttttggatcggcggaagcgagtaatttggtgacggagcttcgtcggagttttgatgatggtgtgacacgtggttatgaatggagagtgactcagcttaagaaactgatgattatttgtgataatcatgagcctgagatcgtcgcggctcttcgcgatgatcttggtaagcctgagcttgaatcttctgtttatgaggtatctctactgagaaactctatcaagttggctcttaagcagctaaagaactggatggctccggagaaggcaaagacttctctaacaacgtttcctgcatccgcggagattgtgtctgagcctcttggtgttgtgctagtgatctcggcttggaactatccttttctgttgtctattgatcctgttattggtgcaatttctgctgggaatgctgttgttttaaagccatcagaattggctccagcttcgtcagctctgctcactaagttactggaacagtatcttgatccttctgcggtgcgagttgtcgaaggagctgttaccgaaacaagtgctctgctagagcagaagtgggacaagatattctacacaggtagttcaaaaatcggacgtgtcataatggcggcagctgcgaagcatctcacaccggttgttctagagcttggaggaaaatctcctgtcgttgtagactcggataccgatttgaaagttaccgtcaggcggataatcgtaggcaaatggggttgtaacaacggacaggcgtgcgtttcgccggactatatcttgacgacaaaagaatatgctcctaaattgattgatgccatgaagcttgaattggagaaattttatgggaagaaccctatagagtcgaaagatatgtcacgtatcgtaaactcgaatcactttgatcgcttgtctaagttgttagacgagaaggaagtttctgacaaaattgtctatggtggtgaaaaggacagagaaaacttgaaaattgctccgacaatcttgctcgatgtaccattagattctctgatcatgagtgaagaaatatttggccctctccttccaatcctcacgcttaacaacttggaagagagctttgacgtgattcgttctcgacctaagccacttgcggcatacttgtttacacataacaagaagttgaaagagagattcgcagcgacagtctccgctggaggcatagtagtcaatgacatagctgttcatcttgcacttcacacattgccattcggaggagttggtgaaagtggaatgggtgcttaccatggtaaattctcatttgatgcttttagtcacaagaaggcggttctctacagaagccttttcggtgattcagccgtcaggtatccgccatactcgagaggaaagcttagattgttaaaagcccttgtcgacagcaatatattcgatttattcaaagtccttctcggtttagcttaaacggtaaaaagaccgaggacacttccctttgtacctattggcgcgcc

SEQ ID NO: 199 - DNA, 801 bp, Arabidopsis thaliana
atggcttccttcgtggaatctggttggcagtaccttgtgacacattttagcgactttcaactggcatgtattgggagttttctcctccatgaaagcgtgtttttcttatctggactccctttcatttttcttgaaaggcaaggctttctcagcaagtacaaaattcagacaaaaaataacacacctgcagcccaaggaaaatgtattactcgcctgttgctttatcatttctccgtaaacttgcccctgatgttggcctcctaccctgtcttccgagccatgggaatgcgaagcagttttcctctgccgtcctggaaagaagtgtctgcccagatattattctactttatcattgaggattttgtcttctattggggtcatcggatcttgcattcaaaatggctgtacaagaacgtgcatagtgtgcatcatgaatatgccacaccatttggtttgacatcagaatatgctcaccccgctgagattctatttctgggttttgctaccatagtcggtccagctcttactggccctcacctaattactctctggttatggatggtgttgagagtgctggagacagttgaggcacattgtggttatcatttcccatggagcctctcaaattttcttcctctgtatggaggtgctgacttccatgactaccatcaccgactgctatacacaaagtccggaaactactcttcaacttttgtgtatatggactggatctttggtactgacaaggggtacagaagactgaagacccttaaagaaaacggtgacatgaaacaaacgtga

SEQ ID NO: 200 - DNA, 984 bp, Arabidopsis thaliana
atggcgacttcgtcaccgtctctgagtaacaatggtctttcctccgtcgtcacgcctcccaaaactctccgtggtctcaataagcctaagtgtattcaatgcggcaatgtagctcgctccaggtgcccttttcaatcttgtaagggttgttgttcaagagcagagaatccctgcccgattcacgttcttaaagtagcttcaacgtctggtgagaagacgcaggcgccaagtactccatcttcagagcagaaagcaaccgagggcactcccgggagtaccactagagtttcgtcaatccggcaactttctagcaactttgctcagtttaataacctgaatgcttcttcccgccagagaaaacctttgacgataaaggatgctcaagctttaaacgagtggcggtttacaaagctaaaagagtacagagacagaaacattgaagtagaaaatgaagcttttgatcggtacatgagtaatgtgaatttactcgaagaagcattttcatttacatctgttcctgatgaagagagtcatggaacagcagctcctgagcaaaacaaagaggaaaatattgtttcagagcttaaactgaggctgagatcgaactctgcaagaacagagagctttaagaagcggatcgcggagacagtcaaagccggtttggtgaagcttaagagactggatttaggcagttcttcagatgatcaagatgatatcaaaaggcgggtcaaaagaaagaaatgggaagagaaaggttcagctttgaatgaaataatcgataaactgaacaaagcaagaaccgaagaggatctcaaatcttgcttagagatgaaatcaaagctctgtggtcaagtttctcccactgctgcttccgagaagaacaagatctttccgggtgtagtccgaaaagttgagatgagtgaagaagcacttcaaaaaatcgctgagaatctccaatcttttgacaaagttggaatgttgtga

SEQ ID NO: 201 - DNA, 894 bp, Arabidopsis thaliana
atgaggaccaaatctccatcttctcttaatctcaaggtcatattcataggttcctcaatcttgatcttgatcatcatctacttagcaagatcaaacatctcttcttcctcttcaaagccaatctccaaaacaaatctctcccaagaagaagaagaaactcagcataaacaagaaggatgtccaacaacacaacaatgcacaaagatgccactttctttatccgatgcattggttcattacgtcactagtaacgtcactccacaacaaacatttgatgaagtctctgtctcaaagagagtcttggacaagaagtctccttgtaacttccttgtctttggcttaggtcacgacagtttaatgtgggcatctcttaaccatggtggtcgtaccttgtttattgaagaagaccaagcttggattgcgatagtaactaagaagttcccaaacttagaatcttaccacgtagtttacgacacaaaagtcaaagattcagacaagctgatggaactaggaagatcagaagagtgtagatctgtgtctgatccgagaaactccaaatgtgatcttgcgttgaaagatttcccggcggacttttacgagacgaaatgggatctgatcatggttgatgcaccaactggttaccatgaagaagctccggggaggatgagtgctatttacacggcggggcttttggctcgtaaccgtgaagatggtgaaactgacgtttttgttcacgacgttaaccgtccggtggaagatgagttctcggcgactttcttgtgtaaaggttatatgagggagcaaaatgggagacttagacattttactattcctagtcatcgggctcgtgctggacgacctttttgtccggtggaagttgatcgccgccgttaa

SEQ ID NO: 202 - DNA, 375 bp, Arabidopsis thaliana
atggatcaacgcatcgccgcaatccccgtgttccggtggtctaggagccgtcgaaagattcatatccgtcgccgtaagtcgcaggtggtacgtcttggtgggaagaacagtgcggtgtcacgtggcggattctcgttaaagaagatggtaaggaggatgaagctgagatggttgaagctacactacgtgagagttgtgaagaagataaaagtgttttatcgtaatttggttaaagagttcgtagacgcaggagctgagcttgaagcgattcagcagcgaatggcggttgaagcggctgcgtttgcggttcccggtttaggtctctctttctcttctttttcagtccatgaccgagcacggtattttcttgtatag

SEQ ID NO: 203 - DNA, 744 bp, Arabidopsis thaliana
ttaattaaacattgcaaggtaaagaaaccacaagatcatcactcgaagtaaaaatggtgagcccatttagatctccatgttcttcacccaaaaaatcaagaaaagcaagcaagaacccttattcaaatcgtggacttgataaattctctgagcttctctccgagctagacgagaagaggcaaagcatctactcgaagaagctcgattccggtggcccgcctcttgttcgatttgtgttcacaagctccggtgagtgtgtccccgttgtgatcagatcatcttatcttcacaagaagaacaagaagacgaaagatgttgtagctgataaagtcaaaacagaagtcaaggaagcaaaaacagaggaaatcaagaacacagagcctgaaacagagcaaaaacagagctgtgttataaacgagaatctgaagaagatcgctagaccggatcatttcttgcctgtgactgtgatcttggttcttgtgtttttggctttctttggaagatctgtagcgattatgtttacttgtatcgcttggtacttggttccaacgattcaagaacagagtggaaacagaggatcatcaccgtcttacgcgatgaagaagaaagatttcgctaggaaattgagtattgaaaacagaacatcgtttaatccaagaactgttcgtgatcattctcctcgcaagtagaagaagtttcttattttggctgctcgtaaaaaaaccgcgtgaccgagggcgcgcc

SEQ ID NO: 204 - DNA, 811 bp, Arabidopsis thaliana
ttaattaaatggcggtggatcttttatcggaaaattctaatatgagtccaagaatctcattttcacgtgacttttgtcaatcagacgcaataccaatcgagaaacgtcccttaagatcatcaaactcgaaaccatcaagcctcaattcaagcatagatttcgatttctgcattcccggcggcgtaaattccggcgaaagcttcgatcaaggttcttggtccgccgatgaactcttctctaacggcaaaatcttaccaacggaaatcaagaaaaaaccagaaccgggtaaaaaagaaccagaaccaaaaccggttaaatctaaaccggattcaagaaaacagaggaaacaaccaaacgaagaacaacaagaagacgacgtgataatcacgacggaggagaaaaccaatacgaagtcgttttgggggtttaagagaagcagtagtttaaactgtggaagtacttatggacggagtttatgtccgttaccattactaaaccggagtaattcaaccggttcaacgtcgagtaaacagaaacagagcagctcaaggaaacataacgagcatgttaagttacaacaatcttcatcgttgtcttcttcttcttctgcttcgtcttctttgagtaataatggtttttcgaaaccaccattgaagaaaagctatggaggttatagttatggtagccatggtggtggtgggattagagtgagtccggttataaacgttgttccttctgggaatttgtttggttttggttcaatgttttctggtaatggaagagacaagaacaagaaaagataaggcgcgcc

SEQ ID NO: 205 - DNA, 550 bp, Arabidopsis thaliana
atgatacgaacgaaagctctgcagagctccaatttgctgggtatttaaattcaaccgtggttgggtaattccacgttatgacgacaaagcggacaagtgttccgattactcaaccaattcgagatacactctttatggtaataatgccgacaaggaagctctgagagcctctcattagcagcaagctcctctctacatatagcacaaaccactaaacctctctccatcatttcctcagccgtaaactccaccaccggaagttcctcccctgcgttaagccaccgcgtacaagaggatgaattaccgagaactagaccaaagatttcatcgtaagatccaaacgtgttgactccatgattgctccgtgaatccaagtagtggaggtaacggaggtattcgtcgtcaattaatgtagtgtctgcttcgaaatcttcttcggtcggagtttggtctggttcggtgaggtttagaggaagatgaaactcctcagccatttaattaagggttaatcaacaaacaagaaacaaagagtttgaaagctgacaaataa

SEQ ID NO: 206 - DNA, 1979 bp, Saccharomyces cerevisiae
ttaattaagaactgttaaagacccagtacgaaaatttttccataatggaccctggtattgctaatcataccctccccgaggaatttgaagaggttgtcgttcccgagatgctggaaaaggaagtaggagccaaggtcgatgtcaagccaacgctaaccacatcttctccagcaccttcttacattgaattgatagatccaggtgtgcataacatcgagatttacgcagaaatgtacaaccgcccgatctaccgtgtcgcattattcttctcacttttcctcattgcctatgcttacggattagatggtaatatccgttacactttccaggcgtacgcgacttcgtcgtactcccagcactcgctgctatcgaccgtcaactgtattaagacggttattgcggctgtaggccagatcttctttgccagattatcagatatcttcggcagattttccattatgattgtcagtatcattttttatagcatggggaccatcattgagtcgcaagcggtgaatattacaagatttgcagttggtggttgtttttaccaattgggtcttaccggtattattctaattttggaagttattgcttctgacttttccaacttgaactggaggttgttagccttattcattccagctttaccatttatcatcaacacctggattagcgggaacgtaacaagtgccatagatgctaattggaaatggggtattggtatgtgggcttttatactgccgctagcttgtattccgcttggaatttgtatgttgcacatgaggtatttagcaagaaagcatgctaaagatagattgaagcccgagttcgaagcgctaaacaaattgaagtggaagtccttttgtatagacatcgcattttggaaattggatatcattggaatgttattaattactgtatttttcgggtgtgtattggttccattcaccttagcgggtggtttgaaagaggaatggaaaactgcgcatattattgtccctgaagtcattggttgggttgtagtgttaccactgtacatgctatgggaaataaagtactcgagacatccattgacaccttgggacttgattcaagatagaggtatctttttcgctctactcatcgcattctttatcaattttaactggtatatgcaaggtgattacatgtatactgtactagtcgttgcagttcatgaatccataaagtccgctacaagaattacctccttgtattcatttgtttctgttatcgttggtacaatcctcgggttcatactgattaaagttagaaggactaagccttttattatatttggcatttcttgttggatcgtctcatttggtttgctggtccattaccgtggtgactccggtgctcattccggtatcattggctctttgtgtctattaggtttcggtgcaggttcatttacctatgtgactcaagcttccatccaagcatccgctaaaactcatgcaagaatggcggtagtaacctcattataccttgccacttataatattggttctgcatttggtagttctgttagcggagctgtctggactaatatcctacccaaagaaatttcaaaaagaatttccgatccaaccttagctgcacaagcgtacggttctccatttacattcattacaacttatacctggggaacaccagaaagaatagctttagtcatgtcttaccgctatgttcaaaagattttatgtatcataggtttggtattctgctttcctttgttaggttgcgcattcatgttgagaaatcataaactaacagattctattgctcttgaaggcaatgatcatttggaaagtaaaaacacctttgaaattgaggaaaaggaagaaagttttttgaaaaataaattctttacgcactttacaagcagtaaagataggaaagattaatattatctcacccaaataatttcatacatgcacatatagcatttaaat

SEQ ID NO: 207 - DNA, 2434 bp, Agrobacterium tumefaciens
ttaattaagtaccctggggaagtttgttgtattcagggggccggaattgaaccagatatgacggtggaagacatgacctctcacgataagaacaacacgcccgccaacacggcaaaggccgacatcgaggaacaggcgctctttttccatcgctacccacgccccggcaagctggaaatccaggccaccaagccactcggcaaccagcgggatctggcgcttgcctattcgccgggtgttgccgccccctgcctcgccatccatgagaacccggaaatggcagcggaatataccgcgcgcgccaatctcgtcgccgtcatctcaaacggcacggcggtgctcggcctcggcaatatcggtccgctcgcttccaagcctgttatggaaggcaaggccgtcctcttcaagaaattcgccggtatcgacgtgttcgatatcgagatcgatgcgcccggcatcaacgacatggtctccaccatcgccgcgctggaacccaccttcggcggcatcaaccttgaggatatcaaggcgccggaatgtttcgaggtggaacgccagctgcgcgaaaagatgaacatcccggtcttccacgatgaccagcacggcacggcgatcatcgtcgccgccgccgtcaccaacgcgctggaactggccggaaaatcgctctcgagcgtcaagatcgttgcgtccggtgccggtgcggcagcgcttgcctgcctcaacctgctggtcgccatgggtgcaaacaaggaaaacatctgggtccacgatatcgaaggcctcgtttatgaaggccgcaacacgctgatggacgagtggaaagaagtttacgcccagaagacagacaagcgagtgctggcggattcgatcgacggcgccgatgtcttcctcggcctttccgccgcgggcgtgctgaagccggaactcttggagcgcatggcggaaaatccgctgattctcgcgcttgccaaccccaatcccgaaatcatgccggaggctgcccgtgccgcccgcccggatgcgatgatttgcaccggccgttcggatttcccgaaccaggtcaacaatgttctctgcttcccctacatcttccgcggcgcgctggattgcggcgcaaccacgatcaacgaggaaatgaagatggccgccgtgcaggccattgcagagcttgcccgcgaggaagtctcggaagtcgccgccagagcctatagcggcgaaacgccgatctttggcccgaactatctcattccctcgccgttcgatccgcgcctcatcctgcgcattgcacccgccgttgcccgcgctgcggcggcaagcggcgtggccacccggccgatcaccgatttcgaggcctatttcgaccagctgaaccgtttcgtctggcgctccggcttcatcatgaagccggtcttcaatgccgccaaggcggccgaaaagaagcgcatcatctttgccgaaggcgaagacgagcgcgtgctgcgcgccgcccaggtgcttttggaagaaggcaccggcgtcccgatcctcatcggtcgcccgcagatcatcgaaacgcgcctgaagcgcttcggcctgcgcatccgcccgcatgcggatttcgccgtggtcaacccggaagacgatccgcgctaccgcgaatatgtggatgattatttcgccctcgtcggtcgcgccggcatcaacccggaagccgcccgcaccatcgtgcgtaccaactccaccgtcatcggtgcgctgtcggtgaagcgtggcgaagcggatgcgctgatctgtggtctggaaggccgttatgaccgccatctgcgcgacgtgaaccagatcatcggcaagcaggaaagtgtgcgctcctttgcgggcctcagccttctcattacccagcagggcgccctgttcctgaccgataccttcgtcaacaacgacccgacgtcagaagaagtggccgagatggcgatccttgcggcgaaggaaatccgtcgtttcggcattacgccgaagatcgcgctcgccagccattccaacttcggatcgcgtgactcggaaagcgcccgcaagatgcgccgcgcactgaagatcatccagcaggcagcgccagaactggaagtggatggtgagatgcagggcggctcggcactctccgaagcgctgcgcaagcgtgccatgcccaacagcgtgctgaccggcgaggcgaaccttctggtcttcccgaacctcgatgccgccaatatcacgctcggtgtcactcgcacgctgacggaaggcctgcatgtcggcccgatcctgctcggcacggccctgcccgcccacatcctgtcgcccagcgtcacctcgcgcggcgtcgtcaacatggcggcctttgccgtggtgcaggcctcgcacccttcggtgtgatgaaggcgcattaacgcagttttgaacatgctgttgccatttaaat

SEQ ID NO: 208 - DNA, 1239 bp, Saccharomyces cerevisiae
  misc_feature (1)..(59): n is a, c, g, or t
nnnnnnnnnnnnnnnnnnnnnnnnnnnnnnnnnnnnnnnnnnnnnnnnnnnnnnnnnnntgttaaaaaaaccaagaacttagtttcaaattaaattcatcacacaaacaaacaaaacaaaatggttagagttgctattaacggtttcggtagaatcggtagattggttatgagaattgctttgcaaagaaagaacgtcgaagttgttgctttgaacgatcctttcatctctaacgactactccgcttacatgttcaagtacgactctactcacggtagatacgctggtgaagtttcccacgatgacaagcacatcatcgttgatggtcacaagatcgccactttccaagaaagagacccagctaacttgccatgggcttctctaaacattgacatcgccattgactccactggtgttttcaaggaattggacactgctcaaaagcacattgacgctggtgccaagaaggttgtcatcactgctccatcttccaccgccccaatgttcgtcatgggtgttaacgaagaaaaatacacttctgacttgaagattgtttccaacgcttcttgtaccaccaactgtttggctccattggccaaggttatcaacgatgctttcggtattgaagaaggtttgatgaccactgttcactccatgaccgccacccaaaagactgttgacggtccatcccacaaggactggagaggtggtagaaccgcttccggtaacatcatcccatcctctaccggtgctgctaaggctgtcggtaaggtcttgccagaattgcaaggtaagttgaccggtatggctttcagagtcccaaccgtcgatgtttccgttgttgacttgactgtcaagttgaacaaggaaaccacctacgatgaaatcaagaaggttgtcaaggctgccgctgaaggtaagttgaagggtgtcttgggttacactgaagacgctgttgtctcctctgacttcttgggtgactctaactcttccatcttcgatgctgccgctggtatccaattgtctccaaagttcgtcaagttggtttcctggtacgacaacgaatacggttactctaccagagttgtcgacttggttgaacacgttgccaaggcttaatgaggaatctttaatacattttcaatctatttaagttttataaacgtgtatatgagatgtcatgagcatgaattattaataataaaaactaaatcattaaagtaacttaaggagttaaat

SEQ ID NO: 209 - DNA, 2007 bp, Arabidopsis thaliana
ttaattaatacatcttgttttctgctcattcctctgtttcaacaatggagagtactattgttatgatgatgatgataacaagatctttcttttgcttcttgggatttttatgccttctctgctcttctgttcacggattgctttctcctaaaggtgttaactttgaagtgcaagctttgatggacataaaagcttcattacatgatcctcatggtgttcttgataactgggatagagatgctgttgatccttgtagttggacaatggtcacttgttcttctgaaaactttgtcattggcttaggcacaccaagtcagaatttatctggtacactatctccaagcattaccaacttaacaaatcttcggattgtgctgttgcagaacaacaacataaaaggaaaaattcctgctgagattggtcggcttacgaggcttgagactcttgatctttctgataatttcttccacggtgaaattcctttttcagtaggctatctacaaagcctgcaatatctgaggcttaacaacaattctctctctggagtgtttcctctgtcactatctaatatgactcaacttgcctttcttgatttatcatacaacaatcttagtggtcctgttccaagatttgctgcaaagacgtttagcatcgttgggaacccgctgatatgtccaacgggtaccgaaccagactgcaatggaacaacattgatacctatgtctatgaacttgaatcaaactggagttcctttatacgccggtggatcgaggaatcacaaaatggcaatcgctgttggatccagcgttgggactgtatcattaatcttcattgctgttggtttgtttctctggtggagacaaagacataaccaaaacacattctttgatgttaaagatgggaatcatcatgaggaagtttcacttggaaacctgaggagatttggtttcagggagcttcagattgcgaccaataacttcagcagtaagaacttattggggaaaggtggctatggaaatgtatacaaaggaatacttggagatagtacagtggttgcagtgaaaaggcttaaagatggaggagcattgggaggagagattcagtttcagacagaagttgaaatgatcagtttagctgttcatcgaaatctcttaagactctacggtttctgcatcacacaaactgagaagcttctagtttatccttatatgtctaatggaagcgttgcatctcgaatgaaagcaaaacctgttcttgactggagcataaggaagaggatagccataggagctgcaagagggcttgtgtatctccatgagcaatgtgatccgaagattatccaccgcgatgtcaaagcagcgaatatacttcttgatgactactgtgaagctgtggttggcgattttggtttagctaaactcttggatcatcaagattctcatgtgacaaccgcggttagaggcacggtgggtcacattgctccagagtatctctcaactggtcaatcctctgagaaaacagatgtttttggcttcgggattcttcttcttgagcttgtaaccggacaaagagcttttgagtttggtaaagcggctaaccagaaaggtgtgatgcttgattgggttaaaaagattcatcaagagaagaaacttgagctacttgtggataaagagttgttgaagaagaagagctacgatgagattgagttagacgaaatggtaagagtagctttgttgtgcacacagtacctgccaggacatagaccaaaaatgtctgaagttgttcgaatgctggaaggagatggacttgcagagaaatgggaagcttctcaaagatcagacagtgtttcaaaatgtagcaacaggataaatgaattgatgtcatcttcagacagatactctgatcttaccgatgactctagtttacttgtgcaagcaatggagctctctggtcctagatgaaatctatacatgaatctgaagaagaagaagaacatgcaggcgcgcc

SEQ ID NO: 210 - DNA, 973 bp, Arabidopsis thaliana
ttaattaaatgattttagcgcatcttccaagattccatctctcaatcctcgcgaaaccttctttctctctctcttcttcgcatttcagtttcttaaaccctaagccttcggtaacagtatctcgaacccttttctcattcgcgtctaaatcgaatctcgccactgttgaacccataccattatcggtctcagattcaaccgatttggatgatgcacctgtcgagattgcgctcgacaagctttttattccgccggagaccgatatatccggtgaagactcggcgagtttaacgacgaggatacttaagggttcgaatattgtgctgagcaagtacgcgagggacgcacaggtggttcaggctgattatgtgaagagtagtgtcaagacggaggattgtccggccgatgggttgccggagtttgcgcttgttgggagatccaatgttgggaaatcatcgcttctcaattcgttggtgaggaggaaacgccttgccttgacttctaagaaacctggaaagacgcaatgcattaatcatttccggatcaacgacaagtggtacttggtagatttgcctggttacgggtatgcatcagcaccgcatgaactcaaacaagactggaacaaattcaccaaagactattttctaaatcgatcaacattggtctcggtgtttttactagttgatgccagcattcctgtaaagccaatcgatctcgagtatgcaagctggcttggtcaaaaccaggttccaatgactttgatattcacaaaatgcgacaagagaaagaagaagaaaaatggagggaagaaaccggaggcgaacataaaggagttccaagacttgatccaagggttctttgagacaacaccgccatggattatgaccagcagtgtgacgaatcaaggtcgggacgagatattgttgcatatggctcagctaagaaactactggctcaaacactgaggcgcgcc

SEQ ID NO: 211 - DNA, 1083 bp, Arabidopsis thaliana
ttaattaaggatttttctcgtgcttactgataatccagcttgacgatgtcgttgacggagctagacgacggactggttcgcaggatggccatgggcgcagtcttctctgattttggagggaagatacattcggtgggtttccataggactgatgatctattggtcacatccagcgaagatgattcacttcgcctcttcgatatcgccaacgctaaacagctgaagattacataccataagaaacatggcaccgatcgtgtatgctttacccatcatcctagctctctaatttgctcttctcgatacaatttggagtccactggtgaatccttgagatatctctcaatgtatgataatcggatcctacgctactttaaagggcataaagacagggttgtatcactttgtatgtctcctataaatgatagcttcatgtctggttctctcgaccgaagtgttagactctgggatcttcgtgtaaatgcctgccagggaattctacatctacgtggtagacctgcagttgcgtatgaccaacaaggccttgtgtttgcaattgcaatggaaggaggtgctgttaaattatttgattccaggtgttatgacaagggtccctttgacacatttctggtgggtggggatactgctgaggttaacgatataaaattcagcaacgatgggaaatccatgctcctaacgactacaaataacaatatctacgttcttgatgcatatcgtggagagaagaaatgtggttttagtttggagccttcacagggtacacccatagaggccaccttcacaccagatggcaagtatgttctgtcaggttcaggtgatggaaccttacatgcgtggaacatcgagaacccatctgaggtggcgaggtgggagaacaacataggagtagtgtcgtgtctgaaatgggcaccacgtagagccatgttcgttgctgcttctacggttctcacattctggatcccaaacgacggtgaatcaccagcccccgccgatcctcctaccgatcaacaacagtgacgacatatatgtttccattatgcacttgtgtatcgttggcgcgcc

SEQ ID NO: 212 - DNA, 832 bp, Arabidopsis thaliana
ttaattaaatggctaagacaggggaaagcttgagagacaaacctagatggagtcttgtaggcatgaccgctcttgtcaccggtggctcaaaaggcatcggagaagctgtggttgaggaactagctacgttaggggcaagaatccacacatgtgccagagacgaaactcagcttcaagaaagcttacgtaagtggcaagcaaaagggtttcaggttaccacttctgtctgcgacgtttcttctcgtgataaacgagagaagctcatggaaaccgtttccactatcttcgaaggaaaactcaacatacttgtcaacaatgtgggaacgtgtatagtcaaaccgaccttacaacatacagccgaagatttctcatttacaatggcaacgaatctcgagtcagcttttcatctctcgcagctcgcgcatcctttgttgaaagcttctggttcagggagcatcgtgctcatctcctccgtatctggagttgtacatgtcaatggtgcatccatatatggagtatctaaaggagctatgaatcagctaggaagaaacttagcgtgcgagtgggcaagtgacaacataaggactaactctgtgtgtccatggttcatagaaactcctttagttaccgaaagtcttagtaatgaggagtttagaaaagaagtggagagtagaccaccaatgggacgtgttggagaagtaaatgaagtatcatcgcttgtggcatttctttgtcttcctgcagcttcttatattacaggtcaaaccatttgtgttgatggaggtttcactgttaatggtttctctttcaagcctctgccttaaggcgcgcc

SEQ ID NO: 213 - DNA, 993 bp, Arabidopsis thaliana
ttaattaaaaaaacgcttttctctccttcaatttctccgtctctctctcgttttccatggccgagttacagttagtagaaggtcaccagattaacggcggttttatcccgccggcgataataaactcaatcgaagcaccggaaacatccgccgcagccggagtttcagtcggatcgaaacgattgagaagacctagcgttaggttaggagacatcggcggtgaccagtaccaccaacacgtggttgcggcgtacgattctccgcaagtccgacggccgaaatggagacctagtggtggtggtggtggtggtggtggtaacaggaaggagccgaataatcagagtgggaagacgacgtcgtcttcgaggactcgaactatgacgaatttgagctccggtgggtatgagaatactggaaccctagatgaagatccggtttcgattgggagttggcgggttaagaaatgggtcaaatcatccggtggagagacggcggcgacgacgacgacgaatacagcttcggcgaagcgagttaggtcgaattgggcgacgagaaacgatggtgtagagcaaggagatgagaaattcagtggagaggaagaagaagaggaagaggatgaagaattgggaggagaagaagggtttagggatttcagcagagaagattcggagagtccgatgaaagaacgaagacggtacgagaatagagaggttgaattgttaggagattggcaaagtggaggaagaggaaaagaaggagtgaagatatggttacaagagttagggttagggagatattggccaatgtttgagatgcatgaagttgatgaacaagtgttaccattgttgacattggaggatcttaaagatatggggattaatgctgttgggtctaggaggaagatgtattgtgcaattcagaagcttgggagggagttctcgtgaaaaatggtggaagagttttgttttttgtgaccagccattggggcgcgcc

SEQ ID NO: 214 - DNA, 456 bp, Arabidopsis thaliana
ttaattaactctctctctctccttgaaatcgaaagatcaaaaaagcgacactgaaaatggaaaatcggtcagaaatgggtaaccggaggcagcagaatctcttcgtcatagcttctcccgacgagattgctaagatccatcgagccgaaacttccaaacaagccggagctattgccggagctaaggccgccgccgttgccgccgtcgccagtgcgattcccacagtagctgccgttcgtatgttcccgtgggctaaggcaaacctcaactacactgctcaagcactcattatttcttcagcttctatcgctgcgttcttcataaccgcggataaaacgattctacaaggcgcaagaagaaacaccgaggctcagttaaagaaagttcagcaagactctaaataatttctcttcttattgtaacacaaatcaatcatcatctttctctgggcgcgcc

SEQ ID NO: 215 - DNA, 1641 bp, Arabidopsis thaliana
ttaattaattgatttgtctggtttgaactgcattagggtttctagaaggaattatattctcatggatcctcataaaaaggttgcactggagactgagttctttacagaatacggtgaagctagccgataccaaatccaagaagttatagggaaaggaagttacggtgttgtggcatctgcaatcgacacacattcaggcgaaaaggttgccattaagaaaatcaatgatgtgtttgagcacgtctctgatgcaacgcggattctaagagagatcaagcttctcaggttgctccgccatcctgatatagtggagataaagcatgtaatgcttcctccttcacgccgtgagttcagagacatttatgttgttttcgagttgatggaatcagatcttcaccaagttatcaaggcgaacgatgatcttacacctgagcactaccagtttttcctctaccagcttcttcgtggtctgaagttcatacacacagctaatgtgtttcatcgtgatttgaagcctaaaaatattctagccaactctgattgcaagttgaagatttgcgactttgggcttgctcgagtgtcctttaatgatgcaccttcggctatattctggactgactatgttgctacaagatggtaccgtgcgccagaactttgtggctctttcttctccaaatatactcctgccattgatatatggagcataggatgcatatttgcagaaatgctcactgggaagccattgtttcctgggaagaatgtggtgcaccaattggatattatgactgatttgcttggtactcctcctcccgaagctattgcaaggattcgtaatgaaaaggcgaggagatatctcggcaatatgaggagaaaaccgccagttccattcactcacaaatttcctcatgtagacccattggcccttcgcttactgcaccgtcttcttgcatttgatcccaaagaccgtccctcagctgaagaggcactggcagatccttacttctatggtctggcaaacgttgatcgggaaccatctactcaaccgattccgaaactcgagtttgagtttgaaagaaggaagataacaaaagaagatgtgagagaattgatctacagagagatattagagtatcatcctcagatgctgcaagaatatcttcgaggtggagaacagactagcttcatgtacccaagtggtgttgatcgctttaagagacaatttgctcatcttgaggaaaattacggtaagggtgagaaaggctcacctcttcaacgccaacacgcttccttgcctagagagcgagtccctgctcctaagaaagagaatggatcacataatcacgatatcgagaacagatccatagcgtctttagtcacgaccctcgaaagccctccaacgtcacaacacgaggggtcagactacaggaatgggacgagccagacgggttacagcgctcgcagcttgctgaaaagtgccagcatcagtgcatctaaatgcattggcatgaaaccaagaaacaagtccgagtacggggaatcaaacaatgatacggttgatgctctgtctcaaaaggtcgcggctctccacacttgacttgtttcagagattgaggattgaaacttgttgctaacaggcgcgcc

SEQ ID NO: 216 - DNA, 842 bp, Arabidopsis thaliana
ttaattaattttctcttcttctccggtgatttacttacttaacaatcatggcgtcgtcggagggattagcaagcgttgatccttggtcattccgtcaaaacttcaacatcgattcgtggctactctctgattccttctcacacgacagtgatatactcgctaaagctcttcacagatccatctccacttccaccgaatcatctcctctttctccttcatctttcttcgactcttcaaccgccgccgtcgatttttctcctcctcaaactctctccaacgtctctttcggctcagatccagaaatccccgccgctagtgctcttggtctcgggaaacgaaaacgtggtcctggtgtttccggtggtaaacaaacgaaacgccgatctcgagtttctaataagaaatctcaaaccacgtttataacggcggacgctgctaatttccggcagatggttcaacaagtcaccggagctaagttcctcggttcttccaacagcattttcgcaccgattgtgaagccggagccacaccgtctcgctagtagattaccaccgtcgtgcggaaacttggaccgatcttcagctgttccaacgctagatacgtcgtcgtttttgtctaaccatcaccaagagaacattatcacagatttgggagctccgaccggttcgtttcatcatcaatccagtgcaggtacaacgacggcgaacgttggtggtggtagctccgccgtggaattggatagttacccgagcttcccaacactcgaatcatggaaagttatgtgatcgatctgattttaagattagtgtttatgtagagatgtaatcccttttgggcgcgcc

SEQ ID NO: 217 - DNA, 715 bp, Arabidopsis thaliana
ttaattaaatgccgaagagaacgacacacacgtactcgagcgaggacgccgcgccggatggacccgactctgatctcttcgtatactactgcaaacactgtggttctcatgtccttatcactgatacccagttgcagaagatgccaaaaaggaagaccgacaggtcgaatgtacttgacaagaagacgcaccttgctaggttgaatgtcagcgagggaggaaaagttttattgaaacgtggcgaaggaaaaatggagagacagtttagaatgaactgtatcggttgtgagctttttgtttgttatcgtgctgaagagaatctggaaacagcgtctttcatttacattgttgatggagcacttagtgctgttgctgcagaaaccaacccacaggatgcaccagtacctccctgcatttcacaactcgacggtggacttgttcaggttgcaatagaagtggaagaccgtgcacaacgttcagcaatcacaagggtaaatgctgatgatgttcgtgtgactgttgctgcaccagcagcccgtggggaagctaacaacgagcttctggaattcatgggaagggttcttggtttaaggttgagccagatgactctccaaagaggttggaatagcaaatcaaaactcctcgtggtcgaggatttatcagctagacaagtgtatgagaagcttctcgaggccgttgtaccgtaaggcgcgcc

SEQ ID NO: 218 - DNA, 1822 bp, Arabidopsis thaliana
ttaattaaggtaagggaacgatgactggattgggtgttcgatccagtagctatggttccttggagaagacgggacttaacggcgtcgttttacctatccagatcactaccacgacgcgtaccaaaccatctaagatgcagaaagatagagaaggtattgtacattggatctgcaaattcgctggtcgtaagaaggttggcatgttgcttctcttcttaatctccgccgtcgtcttccttcgcgtcctttacgtcggaaaaggtgaagatagtcaggaaggtcaaggtcctccgagtcttcatttcaatggcagttcaggcgtaaattattcaaatatgttacaaacaaatgaagagctaaacatgaatattggaaatatatcgttcaaggcaaaagaagttattgtgttccctcctcctcctatacattttcttggttattcgcttcctcaaggtcatccttgtaacagtttcactttacctcccccaccagcagacaggaaaagaacaggaccacgcccatgcccggtatgttaccttccagtagaagaagcagttgccttgatgccaaatgccccatcattttcccctgttcttaagaacttaacgtatatatatgaagaaccgttaaacagagagacagagtttggagggtcagattttggtggttatcctactttgaaacataggaatgattcttttgacattaaagaaacaatgagtgtacattgtgggtttgtcaaaggacctcaacctggtcgaaatacaggatttgacattgatgaggcagatcttcttgaaatgaagcagtgtcgtgggatagttgttgcttcagcagtatttgatgcttttgatgatgtaaaagccccacaaaatatcagtaaatatgcggaggaaacagtttgcttctacatgtttgttgatgaagagactgaatcaattttgaagagagaacgaggccttgatggcaataagaaagtagggatatggagagttgttgttgttcataatctcccctattcagatggaaggcgcaatggaaaggtgcccaagcttcttgtccataggatgtttccaaatgctcgctattctttatggattgacggaaaactagaacttgtcgtcgatccatatcaaattcttgaaagattcttgtggaggaaaaatgctacttttgctatttctagacattacaaacgatttgatgtcttagtggaagccgaagcaaataaagctgctggtaaatatgataatgcttctatcgactttcaagtggatttttacaagaacgaagggttaaccccttattctgtcgcaaagctcccaatcacaagcgacgtacccgagggttgtgtcattttaagagagcatgttcccataagcaacctcttcacttgtctttggttcaacgaagttgaccgattcacttctagagatcaaatcagtttctcaacagtaagagataagatcgcagcaaaaacaaactggacagtaagcatgttccttgattgtgaaagacgcaattttgtagttcagagatatcaccgagcagaacaagaaagatttgcaaggcaacgacctccggtgcctaattttcctcctccaccaccttcgccgcctccaccagttttaatcagcagcgatttgcctagaaaaatgtcaagtggaagagcaacgccgcctagaagacgaggaagagacagacggtctggtcaaaggggtcacaggaaagctaacttgccagtaagattaccagattcagcttaagagttggcgtccgtcttcttcttcttcttcaggtcactctcatcaccaggcgcgcc

SEQ ID NO: 219 - DNA, 1456 bp, Arabidopsis thaliana
ttaattaagaatggcttcaaagtcggatgtgaatataatagagacatcctcaaaggttcatttctcaggatttcatcaaatggatggtttagcttcaaatagaccagagcaaatggctgaggaagaagaacatggtcaaccttttgtgatcggagttgctggaggtgcagcatccgggaaaacaactgtctgtgatatgattatgcagcaactgcatgatcagagagctgttgttgtaaatcaggattctttctaccataatgtaaatgaagtggagcttgtaagagttcatgattacaattttgaccatcctgacgctttcgatactgagcaattattgtcttccatggagaagttaagaaaaggacaagcagtagatattcctaattatgacttcaaaagttacaagaacaatgtttttccacctagaagggtgaatccttctgacgttataattctggaaggtatactcattttccatgaccctcgggtgcgagatttgatgaacatgaagatatttgtagacgcagatgccgatgtgcgtctagcgagaaggataaaacgcgatactgttgagaagggcagagatattgccactgttcttgaccagtactcaaagtttgtgaagccagcatttgaggatttcatactcccaacaaagaaatacgcagatataataattccccgaggtggtgataaccatgttgctattgatttgattgtgcaacacatccatacgaagctcggtcaacatgatctctgtaaaatttatccaaatctttatgttattcaatcaacttttcagatacgtggtatgcacactctaatccgcgactctaaaacaacaaagcatgactttatcttctactccgatcgattgatacgtttggtcgttgaacatggcctcggacaccttccctttacagaaaagcaagtggttactccaacaggatctgtgtattcgggtgtggacttctgtaagaaactgtgtggtgtctcagttatcagaagcggtgagagtatggagaacgctcttagagcatgctgcaaaggcatcaaaattgggaagattctgattcatagagaaggcgacaatggtcaacagcttatctacgagaagctaccctcagacatttcagaaaggcatgtgcttttactggatccaatcctcgggacaggaaactcggcggtgcaagcgataagactgctcataagtaaaggcgtgcctgaatccaacatcatatttctcaatttgatatctgcacctgaaggagtaaatgtggtgtgcaaaaagttcccaaggataaagattgtgacttcagagatagaactcggtttaaacgacgagttccgagttgttcctggtatgggcgagtttggagaccgctattttggaaccgatgatgagtgagagagtgcgagcttgccttgcctccctcgaaaattttggcgcgcc

SEQ ID NO: 220 - DNA, 1927 bp, Arabidopsis thaliana
ttaattaaatgggcaagtctagtaagaaatccgtcaccgaagttgaaacacctgcttcaatgacaaagccactcaagaaaggtaagagagatgcggaagaggatttggacatgcaagttacgaagaagcagaagaaagagttgattgatgttgttcagaaggagaaagctgagaaaacggtacctaagaaggtagagagtagcagttctgacgcttctgattctgatgaagaggagaagactaaggaaactccatctaagttgaaggatgagtcttcttctgaagaggaggatgactcttcttcagatgaggaaattgcgcctgcgaagaagcgaccagaacctattaagaaggctaaggtagagagcagctcatctgatgatgattctacttcagacgaggaaactgcccctgtgaagaagcaaccagcagtccttgagaaggctaaggtagagagcagctcatctgatgatgattcttcttcagacgaggaaactgtccctgtgaagaagcaaccagcagtccttgagaaggctaagatagagagcagctcatctgatgatgattcttcttcagacgaggaaactgtccctatgaagaagcaaacagcagtccttgagaaggctaaggcagagagcagttcatccgacgatggatcttcttcggacgaggaacccacccctgcaaagaaagaaccaatcgttgttaagaaagacagctcagatgaatcttcttcagatgaggaaacccccgttgtgaagaagaagccaacaacagttgttaaggatgccaaggcagaaagcagttcatcagaggaggaatcttcttcggacgatgaaccaacacctgccaagaagccaacagttgttaagaatgctaaaccagctgcaaaagattcatcatcctcagaggaagattctgatgaggaggaaagtgatgatgaaaaacctcctacgaagaaggctaaagtttcatcaaaaacttctaaacaagaaagctctagtgatgaatctagtgatgaatctgataaggaggagagtaaagatgagaaagtgacaccaaagaaaaaggattctgatgttgaaatggtggatgcagagcagaaatctaatgcaaagcagccgaagacacctactaatcagactcagggaggatcaaagacgctatttgctggaaatctttcctatcaaattgcgagatctgacatagagaatttcttcaaagaagctggtgaagttgtcgatgttagactttcttcatttgatgatgggagttttaagggatatgggcatattgaatttgcttctccagaagaagctcagaaggcattggaaatgaacggtaaattgttactaggccgcgatgttcgtcttgatcttgctaacgagaggggtactccacgaaacagcaatcctggtcgcaaaggagaaggaagccaaagtcgaacgatttacgttagaggattcagttcttctcttggcgaagatgaaatcaagaaagagttgagaagtcattttagcaagtgtggagaggtgacaagggttcatgttccaacagatcgtgagactggtgcttccaggggctttgcttacatagatttgacgagtggattcgatgaggcgttgcaactgagcggaagtgaaattggaggagggaacatacatgtggaagagtctagaccaagagatagtgatgagggccgttcctcaaacagagcacctgctagaggagcacctcgtggccgtcactcagatagagcacctcgtggaggacgtttctcggatagagcaccacgtggacgtcactcagatagaggagcacctcgtggccgtttcagtacgcgtggaagaggacccagcaaaccaagtgtaatggaatcatccaaagggacgaagacggtctttaatgatgaagagtagggcgcgcc

SEQ ID NO: 221 - DNA, 906 bp, Arabidopsis thaliana
ttaattaaatgaataagggctgtggaagtggaagtgattcttgtttatcgtcaatggaggaggagcttcatgttttagcagtagatgataatctaattgaccgtaaacttgttgagagaatcctcaagatctcttcttgcaaaggtaaactatcattcaaatttttttccttctaaatttcaagaaccaagatttcttctatatggtaacattgcctctgaaatgaagaaattgattttactttctgtacagtgacaactgcagaaaacgggcttagagctttagaatatttaggcttgggagatccacaacagactgattcattgactaatgtaagctcaatcttccccatgaaacattctgattggtttggagaggagacatttgtataacatccaatatgaccttttgagactgttttttcaggtaatgaaggtgaatctcatcatcactgattattgtatgccaggaatgacaggttttgagctgcttaagaaagtgaaggtgtgtaagaaatttctcacaaatgaaaagtcctcttgacaagatcaatatagagttatatagactaacaaaatctctttctttgtctctgtttctatggtgtttttattattggcagcaggaatcatcgaatctaaaggaagtacctgttgtgatattgtcttcagagaacattcctacccgcatcaacaagtaaacttatcattcctcagacacattgcttaattgttctgttctcttgttttgttttcctcaatggtgaattaagattctgtaatctcttgatgatattacagatgtttagcgagtggagcacagatgtttatgcagaagccactgaaactatctgatgtagagaaactgaaatgccatcttttaaattgcagaagctgaaggcgcgcc

SEQ ID NO: 222 - DNA, 1198 bp, Arabidopsis thaliana
ttaattaaggtgacaatggctagctccaagggatcacagagtgttagaaacttgatgtacccgggaaagcatgctttgctcccaccaaaaataccgtttcctagtgtatcagcatcgtattccgagtatattcctactggtttgattggttcaagacatggtcagaagcttagtaatgagaaaacacatcaccagcgaacttcctccgagagccatttggtagaagagcttcccttttggcttgatgatcttctcaatgagcagccggaaagccctgctcgaaaatgtggtcatcggcgttcatcaagtgactcttacgcttatctagatgtggctaatgctacaaacataagtttgactctccaaaatgatttcagttataggaatactgttttatccactcaaagaggagtccaagagcttgaccggaataaaaatgctcaggatgctgccttctactctggtgctagttttctgaaacagaagagtcgtcagcgggattctttggtggcaactggggcttgtccttcttggttacctttcgctcgtgagaacggtggcggaaaaaacttgggagctttatatatgtctcaagatgcaacagtaatatcgtcagaaagaaagaactatgctgaacctttttctcatgacccaaagatgttatcttctgaggaaaacaactccaatccttcgcctgtgacttatgaagctgacaacacaaaacgagccaaacagcaatttgcacaaagatcacgggtccgtaagctccagtacatatctgagctagaaagaaatgtacagacattgcaggcagaaggctccaaagtttcagctgaacttgattttctcaaccagaggaatcttattctgagtatggaaaataaagctctcaagaagcgtctcgaaagtatagctcaggagaagcttatcaaacaattggaacaagaagtgttggaaaaggagattgggagactacgagcgttgtatcagcaacaacaacaaactcaaaaaccatcagccagtcgcggacgtgctactagcaaagatctcgactctcagttctccagtctttcactgaacaccaaagattccaactgtaggcgtgactctgtatctgtgatgggtcaattccacttttagtaaatgtctctctacccacggttcattagagatcttaagggcctggcgacggcgcgcc

SEQ ID NO: 223 - DNA, 1072 bp, Arabidopsis thaliana
ttaattaaatggatgcgtttagaagacaagcgagtaagcttagagaccaagtcgcaaagcagcaactggctgtgataaagcaattcagtgggactggttatgaaagctcagatgtaatggtgattgatgagcttgaaatgcaaaggcatcatcaactcgataaactttaccgctctactcgttctgcaaaggagttccagagagatattgttaaagcagctgaggcatttaccacgatcgggctcagacacattgaagcaggaaccaagttgtctgaagactgttgtaggtatgggaacgaaaatagtcagaacattgatgagaatatactggccaaggctgcagctatatacggtgatgcacggaaacatgtagacaaagaacaagaagacttcaacaagcttttggcttctcaggttttggatcctctaagagctatggttgccggttctcctcttgaagatgctcgtcatcttgctcaacgttacagccgcatgagacaggaagcagagacacatgcaacggaagtctctagacggcaagcacgtgtaagagaagctccgattccagaaaacgtagcaaagcttcaactagcggaagcaaaaatgcaagagctaaaagcaaatatggcagtccttggtaaagaagcaactgctgcattagccgctgttgaatcacagcaacatagactcactttccagaggcttgtggctatggttgaaggggagaagaattatcacttaagaatagcagccatcctcagtgacattgaagccgagatggtaaccgagaaacaacacaaagaatctgctcctcctgcgattccaacagagaacggctcagagaaaacgtcatactttcttgctgaagtgattcatccattttccgctgcttcagagaaagagttagacttggacaaaggagattacatcgttgtccgaaaggtgagccaaaccggttgggctgaaggagaatgcaaaggcaaagctggttggtttcctatggcttacattgagaagcgacagagacttcccactaccaactttgctgctgaagtttactgaggcgcgcc

SEQ ID NO: 224 - DNA, 1951 bp, Saccharomyces cerevisiae
ttaattaaatgtccaaggtctatctgaattcagacatgattaaccatttgaactccacagttcaagcttactttaacttatggttggagaagcaaaacgcaataatgcgttctcaaccccaaattattcaagataaccaaaaactgataggcattacaacgctagttgcctcaattttcactctgtatgttttggtcaagataatctccaccccagcaaagtgttcctcgtcctataagccagtcaaattctcccttcctgcaccagaggccgctcaaaataattggaagggcaagaggtctgtttccactaacatatggaatcctgaagaaccaaactttattcaatgtcattgtcccgccacaggtcaatatctaggttcttttccatcgaaaacggaagctgacatagatgaaatggtttctaaggcaggcaaagctcaatctacttggggcaattctgatttctcaagaagattgagagttttggcttctttgcatgattatattctaaataatcaagatcttattgcgagagtagcgtgcagggattcaggaaagacaatgttagacgcatcgatgggtgaaatcttggttactttagaaaaaattcaatggactataaagcacggccaaagagcgttgcaaccttcgagacgtccgggccccactaattttttcatgaagtggtataaaggtgcagaaatccgttatgaaccactgggtgtgatcagttctatcgtttcctggaactatccattccataacttattgggtccaattattgcagcattgttcacagggaatgccattgtagtaaaatgttcagaacaagttgtctggtcttcggaatttttcgtcgagctgatccgcaaatgtttggaagcttgtgatgaagatccagatttggttcagttgtgctattgtttacctccaactgaaaatgatgattccgcaaattatttcacctctcatcctggtttcaaacatatcacttttattggcagtcagcccgtagcgcactatattctaaaatgcgctgccaaatcattgacacccgtagttgtggagcttggtggtaaggatgcgtttattgtcctagactcagctaagaatttagatgctttatcttctatcatcatgaggggtactttccaatcatccggtcaaaattgtattggtattgagagggttattgtcagtaaggaaaattatgatgatttagtcaagattttgaatgaccgtatgactgcaaatccactacgccaagggtctgatattgatcatttagaaaatgttgatatgggggcaatgatatctgacaacagattcgatgaactagaagctttggttaaagatgctgttgcaaagggagctcgtttacttcaaggtggttcccgcttcaaacatccaaagtatccacaaggtcattatttccaaccaactcttttggtggatgtcactccagaaatgaaaatagcacaaaacgaagtgtttggcccaattttagtcatgatgaaagctaagaatactgaccattgtgtacaactagccaactctgcgccatttggtctaggtggttctgtgtttggtgcggatatcaaggaatgcaattacgtcgcaaatagcctacaaactggtaatgtagccattaatgattttgctacattctatgtttgtcaattaccatttggtggtatcaatggttcaggttacggtaaatttggtggtgaagaaggtcttttgggtttgtgcaatgccaaaagtgtctgttttgatactttgccttttgtctccactcaaattccaaaaccattagactaccctattcgtaacaatgctaaggcttggaattttgtaaagagtttcatcgtaggagcttatacaaattccacatggcaaagaataaagtcactgttctctttagctaaagaagccagctagatttaaat

SEQ ID NO: 225 - DNA, 1242 bp, Glycine max
ttaattaagggttttagcactctctctctctctcgttttcgttcttcctttctgcctctctcagtcacacaccttctcgatgaccaacgacaacatcgccgtgacagatctcacttctgccctcaatgaagataatcgcgccgacctagtcaatgctctcaagagcaagattcagagtctggctggggcgcattctgatgttctagagactctatccccgaatgtcaggaagcgtgttgaatctcttagagaaattcagggtaaacatgatgaactagaggcagacttcttgaaggagagagaagctcttgaagcaaagtaccaaaaactgtatcagccattgtacacaaagcgctatgaaattgtaaatggtgttactgaagtggaaggggcagcaaatgaatcaacagatgaatcagaagagaataaagagaaaggagtgccttctttttggctcaatgcaatgaaaaataatgatgtgttagctgaagagatttcagagcgtgatgaaggtgctctcaagtttcttaaagatatcaagtggagcaggatagaaaatcctaaagggttcaagcttgatttcttctttgataccaatccttacttttcaaataccgtcttgacaaaaacatatcatatgattgatgaggatgaacctatattggagaaagcaattgggacggaaattgaatggtacccgggaaaatgcttgactcagaaggttttgaagaagaagcctaagaagggttcaaagaatgctaaaccaattaccaaaactgaaagctgtgaaagcttcttcaattttttcaaaccaccagaagtccctgaagatgatgctgacattgatgaagatttggctgaagaacttcagaatcagatggaacaagattatgacattgggtcaacattaagagataaaattatccctcatgctgtatcatggtttactggggaggccgctcagggagatgagtttgaagacctggaggatgatgaggacgaagaggaagatgaggacgaagatgaggacgaagaggatgacgaggacgaagacgatgaagaggaggatgacactaagactaaaaagaagaagagtggtaaggcacaggctggtgatggtgatggtgagcgacctccagagtgcaagcagcagtaattgtttgtttcttcggagtatcatgtggctgatgggtgtttttgaggtcctatggtgcctgacgggaaagtgggtttcatttaaat

SEQ ID NO: 226 - DNA, 987 bp, Glycine max
ttaattaatccagaatatacacccaaattcctctttcctagggttttagtccaaagggttttggaggcatcaccatcaccatgagagccaaattgtttgtgttcccaatacgaggcaggaactggtgcttctccagaaccatcgatcactctctctccgcttcccatgcttcctctcaatccccctcaaccctcaaagacttgtggaccaacatcaacgttggtgataagcccctgaacaccaaaactgagctctttgtcgattacatcgccaacaagatgaataatgcttggattggcttggagaaggcgccggaggggtctttcaagaacaagattcatgggttggggttgcggctcttgtcgcgggttaagccctctgagatatttttgaagtctatatcgaaggaaatcactagtgttgaaatcatttatccatcaagtttgaatgctcaacttgttcgtcgaagactaagacacattgctgtgaggggagcagttatccatcggaattacttatacggtttagtttcgttgattccattgacttcagcacttagcattttacctttgcctaatgttccgttcttctgggttttatttcgcacttattctcattggagagccttgcagggaagtgagaggctgtttcaactagtctcagataacagcaagacttcaaacacttgtacatatgaaaagaaaactgagcacaaggaatctaaaagtcaaagacatagttcaaatgaaccttgttgggtgttgaggccatccaaagaacttgagaatcttgtccatctagaagatggtcaagagagtcttagtcaacatgccatcataaacatttgcaagatctatgacttgaacccagtagatgttataaaatacgagaagtccgtcttttaatcagttttgtaacaacttgcattagaattttctattcaatccacttacttcacaatgccataaatttttacccaatttaaat

SEQ ID NO: 227 - DNA, 1123 bp, Glycine max
ttaattaaaaattctccttcactttctttctcgtaatcttcgcctcccttcaactccaccctctctccttcttacctccttgaccatgatgagtttcgccatggattcagtttcggtgttaaaccctaaactctcccactcccattcctctctcccattcagcaggttcccccattccctcaacttccaccccttactcaaaccccgcgcagttaacgccgccgtcccccgtaacggcctcgccgcctgcttcctcaccctccaccgacggaaaccgttaaccgtcgctttcacagcttctcaccaagactcggaacacagagagattgaagtggagaaggagcgtgacgtccatgcaggctctgaagaatctcaggaagcgtggaagcaggttctggagacgtttagggaacaggcagagaagtttcagggcgtttctcaagaggcttatgaggtgtattctaagaaggctgctgtcattctgacagatgccacggagcagttaaaggtgctggcagataagacaaagaacgagttgagtgtggcagcaaaggaaatcactgacgaagggaaagagtatttgtctgcagcggcggatagttcaccagaggtgaaggagattgtggaaacgtttacctcaccgcctgaggatattcagaaattgtctggagtgagggacttctatgttggtgtaccttatggtttgatgctttctcttggtggcttcctttcctttatggtaactggcaacactgcagcgataaggtttgggatgattttaggtggtgtcctcctggctttaagcattttaagtctgaaatcctacaaaaaaggacgcacctctcctctcgctttgaagggccaagctgctatagcaagtatattgtttctgcgggagataagctcaataggcaaaggatcatcttatttcactgccttgatcagtggtgcagtggtggcattctatatctatagaatagtactggaacgtaatcatcaaaagagctcaaacttggaaactgaaccaggaaactagttctatgatgagtgtaaaaaattgaagatctgcatgaagatcaggtaaaatactgaagatcgagttgaagatagtcagtatttaaat

SEQ ID NO: 228 - DNA, 982 bp, Glycine max
ttaattaagcctctactacatcatcacattcacatttcagtaccttctctttctcccagtctctcacacacaacaattgaagaagaaaatggttgacaatgattcgctctcggaattcctcgcatctgcggtcgacgcggctcagaaagctggcgagattattcgaaaaggcttctaccagaccaaaaatgtggaacacaaaggacaggttgatttggtcacagaaactgataaagcatgtgaagaactcatatttaatcatctgaaacagctttatcccactcacaagttcattggggaagagaccacagctgcctatggcactacagaacttacggatgaacccacatggatagttgatcccctggatggaactactaactttgtgcatgggttcccctttgtttgtgtctccattggtctcacaattggaaaaactcctacaattggtgttgtatacaatccaataattaatgagctttttactggaatccatggaaaaggtgcctttttgaatgggaatcccataaaagtatcgtcacaaactgaactaatcagctctcttcttgcaactgaggctggaacaaaacgtgacaaagaaacagtagatgcctctaccgataggattaaaagcttacttttcaaggtgagatctcttcgaatgagtggctcctgtgctctgaatctgtgtggaattgcatgtggaaggctggatgtattctttgaacttggctttggtggtccttgggatgtagcaggtggtgctgtcattgttagagaagctggaggtgttgtatttgatccgtccggtgcagattttgacataacatctcagcgagtagcagcttcaaaccctttcttaaaggatgcacttgttgatactctgcgccaaatggtgtgagaaatttactattaatcaatggcaagaacttatcatataagccatctttgttagttcgtttagcttttgctcaatttaaat

SEQ ID NO: 229 - DNA, 1169 bp, Glycine max
ttaattaatgtagcttctattccgcactcaaaattgcattgtgacatggaggctcaaattcatctacttgaacaggaagcttactctgctgtcttgcgtgctttcaaagctcagtccgatgctcttacttgggagaaggaaggtttgataactgagcttagaaaagagttgagggtttctgatgatgaacacagagagcttcttaccagggttaactctgatgaaataattcaccgcattagggagtggagacaaactggctgttaccaacctgcaaggcgcagcacatctcagcctggtcatgacattttacctagtccaactgtttcagcttcccgaaaaaagcagaagacatcccattcgggtcaatcattgcctgctttatcttcagtgaagtctgtacagtatacttctgctggacctactggcggcaggcattttgcaaatcgcagttctagtgctcttgcgtctaatgtgcctgctgaagcagctgcctttgatccattgattgggaagaaagtttggactaggtggcctgaagataaccacttctatgaggctgttgtaactgattacaaccctgctgatggccggcatgctttggtttatgatattaataaagtaaatgagacttgggaatgggttgatctcaaagagatctcacctgaggatataagatgggaaggcgaagatcctggtgtactccatagaggtggacatggtgggcaaggtcgtggaggtaggaaattctttggccatggtggcgattcgttaggtgcaggaagagggagaggtcatcccaggtttcaggccagacaagaatttcttccacctcaaaatggtattggaaggcgagttttggatgacattgagttgctgaacactgattcactagttaaggaggtagaaaggatttttgcttcaagtcctccagattcaatggagcttgagaaggcaaagcaaatgctgaaagagcatgagcaagcacttgttgacgccattgcaaggattgcagatgcatctgatggtgaaagtgatggagaacagccgttcttgcagcatggtcaattaatggaaaggggatgagagcacaggaaccaactgcatgttggaggaaatctgtctttggagctgaagtctcatgggagtccaattttggttatttaaat

SEQ ID NO: 230 - DNA, 1404 bp, Glycine max
ttaattaaatacagttacaaattgcaataacacactcattgtggttatcgaaatttgatcgcagcgtcgagaagaatgggaagtttgggagcgattctgaaacatccagatgacttttaccctctgctgaagctgaaaatggcggcgaggaacgccgagaagcagatcccgccggagccgcactgggcgttctgctacacaatgctccacaaggtttctcgaagtttcgccctcgtcattcagcaactcggcaccgagcttcgcaacgccgtttgcatattttatttggttctgcgagctctcgacaccgttgaggatgatactagcatagaaacagatgtcaaggtgccaatactgatagcctttcaccgtcatatttatgatcgtgattggcacttttcatgtggcacaaaggagtacaaagttctaatggaccagtttcatcatgtttcaactgcttttctggaacttggaaagaactaccaggaagcaattgaggacattaccaaaagaatgggtgctggaatggccaaatttatttgcaaggaggtagaaacaattgatgactatgatgaatattgtcactatgtggcgggacttgttgggctgggtttatcaaagcttttccatgcgtctggttcagaagatctggctccagatgacctttccaattcaatgggcttgtttctacagaaaacaaacattattcgagattatctggaagacatcaatgagatccccaagtcacgcatgttttggccacgacagatttggagtgaatatgttaacaaacttgaggatttgaaatatgaggagaactctgttaaggcagtgcaatgcttaaatgacatggtcactaatgctctgatgcatgctgaagattgcttaaaatacatggctgctttacgtgacccgcctatatttcgcttttgtgctataccccagataatggcaattggaacacttgcattatgctacaacaacattgaggtcttcagaggtgtagttaaaatgaggcgaggtttaactgccaaagtgattgaccgaacaaagactatggctgatgtctacggtgctttttttgattttgcttctatgttggagcccaaggttgacaaaaacgatcccaatgcaacaaaaacattgagcaggctggaagctatacagaaaacttgcagagaatctggtctcttaagtaaaaggaaatcttacattgtgaatgatgaaagtggatatggctcaaccatgattgtcatattggtcatcatggtttccatcatttttgcttatctgtctgctaaccaccataatagctagttgaaacactgatagcacgcctcgttcatggaatgcgaatttgcatgcatgcaagcaatagtatgatggctgcagttgaatttaaat

SEQ ID NO: 231 - DNA, 2191 bp, Glycine max
ttaattaagcttcagtcatgtctctctctgcattctcattccctctccatctgagacaaacaacaccaccttctgatcctaaaacatcatcaacccctttgcctttgtcttctcactcccattggggtgcagatctgctcacacaatcccaacgcaaactcaaccaggtgaaaagaaggccacatggggtatgtgcatcactatcagaaatgggggagtattattctcagaaacctcctactccactgttggacaccataaactatccaattcacatgaagaatttggctaccaagaaactgaaacaacttgcggatgagctgcgttctgatgttattttccatgtttctagaactgggggtcatttgggatctagccttggtgttgtagaactcactattgcccttcactatgttttcaatgctcctaaggacaaaattttgtgggatgttggtcatcagtcttatcctcataagatactcactggtagaagggataagatgcataccatgaggcagacagatggattggccgggtttacaaaacgatctgagagtgattatgattgttttggcactggtcacagctccacaacaatatcagcaggactgggaatggctgttgggagggatctgaagggagacaagaataatgtagttgctgttatcggtgatggtgctatgacggctggtcaagcttatgaagccatgaacaacgctggatatcttgattccgacatgattgttattctaaatgacaacaagcaggtctccctaccaactgctaatctcgatggtcccataccacctgtaggtgctttgagtagtgctctcagtaagttacaatcaaacagacctcttagagaactcagagaggttgctaagggagtcactaaacaaattggtggcccaatgcatgagttagctgcaaaagttgatgaatatgcgcgtggcatgatcagcggttctggatcaacactatttgaagagcttggactttactacataggtcctgttgatggtcataatatagatgatcttgtgtccattctaaatgaagttaaaagtactaaaacaactggtcctgtgctgctccatgttgtcactgaaaaaggccatggatatccatatgcagaaagagcagcagacaagtaccatggagttactaagtttgatccagcaactggaaaacaattcaaatccaatgctgccacccagtcatacacaacatactttgcagaggctttaattgctgaagcggaagctgacaaagacattgtcggaatccatgctgcaatgggaggtggaactggcatgaatctcttccttcgccgtttcccaacaagatgctttgatgtggggatagcagaacagcatgctgttacatttgcggctggtctggcttgtgaaggccttaagcctttttgtgcaatttactcatcatttatgcagagagcttatgaccaggtggtgcatgatgtcgatttgcagaagctgcctgtaagattcgcaatggaccgagccggattagttggagcagatggtcccacacactgcggtgcatttgatgtcacttttatggcatgcctccctaacatggtggtgatggctccttctgatgaagcagagctttttcacatggttgcaactgcagctgccattgatgatcgacccagttgtttccgatacccgaggggaaatggtattggtgttgagctaccactagggaataaaggcattcctcttgagattgggaagggtaggatactaattgaaggagaaagagtggccttgttgggctatggatcagctgttcagagctgtctggctgctgcttccttgttggaacatcatggcttgcgcgcaacagtggcggatgcacgtttctgcaagccattggaccgttcccttattcgcagccttgcccaatcgcacgaggttttgatcactgtggaagaagggtcaataggaggattcggatctcatgttgttcagttcatggcccttgatggccttcttgatgggaaattaaagtggaggccaattgttcttcctgattgttacattgaccatggatcaccggttgaccaattgagtgcagctggtcttacaccatctcacatagcagcaacagttttcaatctacttggacaaacaagagaggcactagaggtcatgacataaatttaaat

SEQ ID NO: 232 - DNA, 1026 bp, Arabidopsis thaliana
atgggccacagacacagcaagtccaaatcctccgatccgccaccgtcctcctcctcctcttcctccggcaacgtagtccaccatgttaaacctgccggagaacgccgcggatcatccggttccggaaccgtcggatcgtcaggctccggaacaggcggatctcgttccaccacatctactcagcagaatggtcggatcttaggtcggccgatggaggaagtacggagaacctatgagtttggtcgtgagcttggtcgtggccagtttggtgtcacgtacctcgtaactcacaaagagacgaaacaacaggtcgcttgcaagtcaatccctacgcgccgccttgttcacaaagacgacattgaagatgttcgccgtgaagtccagattatgcaccatctcagcggtcaccggaacatagtggacttgaagggagcctacgaggacagacactctgtgaatctgataatggagttgtgtgaaggaggggaattgttcgataggatcatttctaaaggtctttactcagagagagctgctgcggatttgtgtaggcagatggtgatggttgtgcatagttgtcattctatgggtgtaatgcaccgagacttgaagcccgaaaactttctctttcttagtaaagatgagaactcaccattgaaagctacagactttggtctctctgtcttcttcaagccaggtgataagtttaaggatcttgttggaagtgcatactatgttgccccagaagttctaaaacggaactatggaccagaggctgatatctggagtgctggtgtgattctatacatccttctcagtggtgttccgcctttctggggagaaaatgaaacggggatctttgatgccattcttcaagggcaacttgatttttcagctgatccatggccagcactatcagatggtgccaaagatcttgtgaggaaaatgttaaaatatgaccctaaagatcggcttacagctgcggaagtgctaaatcatccgtggattagagaagatggggagtga

SEQ ID NO: 233 - DNA, 1743 bp, Glycine max
ttaattaaaacttcccttcacccaaccaccttccatctccaaacaaacatgggtcggaaacacgacgccgttttggccagcgaacctgtcgccgaagaagccccctgcagccctgagctcgattccgagaagaagaagaagaagaaaaagaagaacaaaaacaaagacaagcaccaaaccgaaagcagccccaaacgaaagctcgacgaacacgacccccaaaacggcaccgaatcgaagaagaaaaagaagaagcaccacgagtccaaggggaacgccgaggaaaccaacggcgatagcaacaacaacaacggcgatggtgctaatcgcgaggaaacggcgacggatgggtctgttgtggtcaccggtaacaatgcgggagaggcgaaatacgccgcggtgaagagcttcgcggattcggggctgccggagaacgtgctggagtgctgcaagggtttcgagaagccttctccgattcagtcccgggcgtggcctttcttattggacggtcgtgatttgattggaattgctgccactggctcagggaagacgttggcgttcggcataccggcggttatgcatgttttggggaagcggaaggggaaaagttccaagggacgaaaccctctcggcctcgtgctctcacccactagagagctagctcaacagatatcagatgtcatgtgtgatgctggtaggtcttgtggtgtgcaatcaatctgtttgtatggtggaacctccaaagggccacaaatctcctcactaaaatctggcattgacattgtcattggaacccctggtcgtatccaggatctgattgaaatgggtatctgttgcctaaaagaagtatcttttgtggtacttgatgaagctgatcggatgcttgacatgggttttgaacaaatagttcgctctatactgggtcaaacgtgttctgatcgtcaaatggttatgttcagtgctacatggcctttgccagttcattacttggcacaggagtttatggatcctaatcctgtaaaagttgttgtaggctcagaagacttagctgccaatcatgatgtcatgcagatagttgaggtcttggatgaccgttctcgtgataagcgcctagttgctttactggaaaagtaccacaaatctcagaggaatcgagtattggtttttgttttgtacaaattggaagccaaacgagttgaaaatatgcttcaagaagggggttggaaggttgtatcaatacacggggacaaagcccaacatgatcgcacaaaggcactctcattgttcaagaatgcaagctgtcctttgatgattgctactgatgtggccgcacgaggattggatattccagatgttgaagtagtgataaactatagttttcctctgactacagaagattatgttcatagaattgggcgaactggacgagctggtaaaaaaggtgttgcccatacattctttatgcagcagaataagggacttgctggggagctggtgaatgttttaagagaagcagggcaaattgtaccggatgccctcctgaaatttggcacacatgtaaagaaaaaggagtccaaactttatggggcacacttcaaggaaattcctgttgatgctccaaagtctcaaaagaaaacatttgacgactctgatgaagactaagtgctggctacttgtgtttatttttggctgaagaaatatatgaattcggtcatttcttactctttttggccgaatttaaat

SEQ ID NO: 234 - DNA, 1081 bp, Glycine max
ttaattaaatatagttgcaatggctcgattttcattggatgagatatcagacactggtgcctttgtgagatctgcttccacattcagaaattggatttcgagggacctgaattcgcaatttccaccagaatcagggaggtatcatctctatgtatcatatgcttgtccttgggcttccaggtgccttgcttacttgaatattaaaggacttaacaaagctatcagtttctcggccgtcaagcccatctttgaaagaacaaatgaatctgatgactataaggggtgggtttttcctgaatcagaaactgaggtgcctggagctgaacctgatatgttgaatggagcaaagactattagggaactttatgaaattgcaagtgcaaactacaccggaaagtacactgttccagttctgtgggataagaaactcaagacaattgttaacaacgagagctcagagataatccgcatgtttaatactgaattcaacagtattgcagaaaaccccaccttggacttgtatcccactgatttaaaaccccaaattgatgataccaacgagtggatatacactagtataaataatggtgtttataaatgtgggtttgcaaagaagcaagaaccatacaatgaggctgcaagacaattgtatggggctttggacaaatgtgaggatatactaagcaagcaacgctatatatgtggcaacacactcactgaagcagacattcgtttgtttgtcactctcattagatttgatgaggtttatgcagttcacttcaagtgcaacaaaaaactgctgcgcgaatacccgaatcttttcaattacactaaagacattttccaaattcctggcattagtagcacagtgaacatggaacatataaagttgcattactatggaagtcatccttctatcaatccatttgggatcgttcccgtagggccaaatattgattattctgctcctcatgacagagaaaggttttctgcataggtggtttatagcatatttgtataatgaggagtgctagcaacacactcctcctaacacacaccctatcattgcttgaatttaaat

SEQ ID NO: 235 - DNA, 1091 bp, Glycine max
ttaattaatcgtgcaacatagcacaaaacccttaagccgttaagcaccttcaacgccgccgtagtttgttattggtttggtttgatggagatggagggtgagaaacagcacaagtttgatgtggacctcggcaacctcatggctttcgattcctatcacaccttcccttctcaaccatctctttccagggaggacctcatcaaacagtgtttactgaaaggcactcacttggttcaagctatcgcagatgccctctttatcttaccatcgaccgaagatttggatggaccccttgtcaccttgcctcccccactcactaaattgcctagagaaaaacatctgccaaaaccaaagcctcctactaaatgggaagcttttgccaaaaagaaaggcatacagaaacggaagaaagacaaaattgtatatgacgagcagtctggaacctggaaacgcagacatgggtatgatcgtgcaaatgatgaagctgctatacctatcattgaggcaaaaccaactgatgatccagaagaggatccttttgccaaaaggaaagaaaataagaagaatagaattgaaaaacaggagaaaaatcgattacagaacttgaaagaagctgcaaaatttggtgctttaccaagccatattcagttggctgctacagctttgcctataacaggaactcaagcagcgcccaagaaagttacaaaggatgaactaggtaatgtagcaggaattgcagcaactgcaacagccagtgggggaaagtttgacaagaaattggcaggtgaaaagcctcagaaacatgaaggaaaatatcggaagttcctgccagtggtggaaggaaccgggataggatccctggagagggagcaaactgaaaaaatattgaacaagatcatctccaagaattctcataacatactcaacgttgaaaaggctgtcacgatgcacaatgtgaagaaagagaagaaacgaaggagcgagaaaggaaagacttcagcaactactgacaagaaattgaaaactcagaaaaagtcttttaaaaagggaagctccaagaaaggcaaggcgaaaggaaaatagatttaaat

SEQ ID NO: 236 - DNA, 974 bp, Glycine max
ttaattaagtgggtggagagaggaacagaacagagcaacatgaagccaccaacgaaacccatttcgagccctggtcgaaccgagaagtttccaccaccgttgatgagattcttgagaaacaatgcctcaagcagaagcagaggaaggtcaagaaccaccaccgccatgtttctgagaaagaagaacaccaacaatattgaaacacaagaaccctcttcccccaaagtcacttgcatggggcaagtccgcgttaaacgctccgcctccaaaagggtgccctccgccggcgccggaactccgaccaagtttcggtgctgctcatgggtcccacatgctctgttttttcaccgtttaataaaacccgaagtttgtttcccctttcagtgcaaacaagtttggcccaattggaggttcttacaaagaaagaaaagggattccaaagtcacggaaacttcttcgccgaaaacagagttgaatttcaggggaaggtttaaccctaattacgacgactcagagcataaagatagagttattgttaaccctcccgcttttgtttccaacacttcaagtactccaccgaggaacgctttgttattgacacgctgcagatccgcgccggggaggaggttcttgaacgaagagacagaggtggttgaaaaaaatagagtaaacagagaacactctgagaataacagagaccggaagttggaggcgaagttacggttcttcaaagagcttgaagagtcactgagggagagaataataatggagtcagaaaaagcaagggaagaatctgactctgttcatcctctggttctgacgaggtgcaaatctgaacccgcgagaaccgcacaaaaactcgatcctgaaatgaacgggctttcgaagaagacaacgttggggttcgctcatgcttggttttcacatggtttgtgattattctattcttacctctgtaactctgttatttaaat

SEQ ID NO: 237 - DNA, 864 bp, Glycine max
ttaattaacaaatttctccatagttatgggcacttccattctcgacgccctgaacgttcgcgtggaaggttccggcgacaagtaccttgtcctggcccacggcttcggcacggaccaatccgcgtggcagcgcgtgctcccttacttcacccgcaactacagcgtcattctctacgacctcgtctgcgccggcagcgtcaaccccgaccacttcgactaccgccgttataccaccctcgacgcctacgtcgacgacctcctcaacatcctcgacgccctccgcgtcccccgctgcgcctacgtcggccactccatctccgccatgatcggcatgctcgcctccatccgccgcccggacctcttctccaaactcatcctcatcggcgcctcccctagattcctgaacgacaaggactaccacgggggatttgagcagggagaaatcgagcaggtgttttcggcaatggaggcgaactacgaggcgtgggtcaacggattcgctccgctggcggtcggggcggatgtaccggcggcggtgagggaattttcccggacgctgttcaacatgcgccctgacatctcgctcttcgtgtcgcggacggtgttcaacagcgacctgagggggattctgggcctggtgaacgtcccctgctgtattatgcagacggcacgtgacatgtccgtgccggccagcgtggctacctacatgagggaccacatcgccggaaagagcaccatccagtggctcgacacggaggggcacctcccccaccttagtgctccttcatacctagctcgccagctagagattgcgctctcgcagtagcgcgtgtaagtctaggcgcgtggctctggtatttaaat

SEQ ID NO: 238 - DNA, 2048 bp, Glycine max
ttaattaatggttgtgtgtgtgactcttctctcctcacaatgctgcctcacaagcacactctggtggttgtggccactgtggccacactcgcgctggcggcggtgctcgcagcaccacaagcagatctggcctccgagcgagctgcattactctccctccgttcctccgtgggaggccgtaccctcttctggaacgccaccagggacagcccctgcaactgggccggggtccaatgcgagcacggccacgtcgtcgagctccacctccccggcgtcgctctctccggcgaaatccccgtcggaatattcgggaatctgacccagctccgcaccctcagtctccgtttcaacgccctcagaggttccctcccttcagatctggcctcctgcgtcaacctccgcaacctctacattcagcgcaacttgctcaccggccaaattccaccctttttgtttcatttgccggacctcgttcgcttgaacatgggcttcaacaacttctccggcccctttccgtccgccttcaacaaccttacccgtttgaaaactttgtttctcgaaaacaaccagctctccggcccaatccccgacttgaacaaactcaccctcgaccagttcaacgtctccgacaacctcctcaacggctctgtccctcttaagcttcagacattccctcaggactcttttctaggtaactccctctgtggccgaccactctctctctgtcccggagatgtcgccgatcccctctcggtcgacaacaacgccaagggcaacaacaacgacaacaagaagaacaagctgtccgggggcgccatagcggggattgttgtcggatcggtggtgtttcttctcttgcttgtgttcctcttgattttcctgtgcaggaacaagagtgccaagaataccagcgcggtcgacattgccactgtcaaacatcctgagacggagtctgaggttcttgccgacaagggtgtctccgatgtcgagaacggtggtcatgccaatgtcaaccctgcaatcgcttctgtggcggcggttgcggctgggaatggtggtagcaaggcggaagggaacgcgaagaagttggtgttttttgggaatgcggcgagggcgtttgatttggaagatttgctcagggcttcggcggaggttttggggaaagggactttcgggacggcgtacaaggcggtgttggaggcggggccggtggtggccgtgaagaggttgaaggatgtgacaatttccgagaaggaatttaaggagaagattgaggcggtgggagcgatggatcacgagagtttggtgcctctcagggcttactatttcagcagggatgagaagctccttgtctatgattatatgcccatgggaagcttgtctgcccttttacatggaaacaaaggagctggtaggacaccactgaattgggaagtgagatcaggcattgcacttggagctgcccgtggcattgagtacctacattcacgagggcctaatgtttctcatggaaatatcaagtcatcaaacatcctcttaaccaaatcatatgatgccagagtgtctgactttggccttgcacaccttgttggcccctcctctacccctaaccgtgtggccggctaccgtgcgccggaggtgactgatcctcgcaaggtgtctcagatggcagatgtgtacagctttggtgtgttgctcttggaacttctgactgggaaggcacctacccatgctctcctgaatgaggaaggagtggacctccccagatgggttcaatccgtggttagagaagagtggacttctgaggtctttgatcttgagctccttaggtatcaaaatgtagaagaggagatggttcagttgttgcaacttgcagttgattgtgcagcacaataccctgacaagcgcccttcaatgtctgaagtggtaaggagcatacaagagttgcgaaggtctagcttgaaagaggaccaggaccaaatccaacatgacaatgatatactattatagaagaacatgtatcttctccctcgactttgcatttaaat

SEQ ID NO: 239 - DNA, 868 bp, Glycine max
ttaattaaaagatgggcaccaccttgatgagatgctcccacgcaaacgctctcttcagagctctcaaacccaaaccccgcaattcttcactgccactttcttcaatggccatcaacaaaggtaatagtaataaggcatatgatgcattgctgttggatgctgggggcaccctattgcaattggcaaagccagttgaggagatttatgccactattggatccaaatatggtgtgactgtggatccagctatgataaagcagggatttaagagagcatttgctgctccgtggcctgaaaagctgcgctaccagggagatgggaggccattttggaaacttgtagtttctgaagccactggttgtggagatgaagattattttgaggaagtttatgagtactatgcaaaaggtgatgcgtggcatcttccagatggagcttttgaaacaattacttttctcaaggatgctggagttaagatggctgttgtatctaattttgacaaccgcttaaggaagctattgaaagatcttaatgttttaaatctgtttgatgctgtcattatatcatcagaggttggatatgaaaaaccagatccaagaatattccaagctgctcttgatgaagtaaatgtagaggcttgcaaagccttacacattggagatgatcagaaggcagataaactgggggccaatgctgtggggattgattgttggttatggggtatagatgtgaagacattctctgatatacaaattcgaattcttaattcagaggcataacacttgatgtggtttgtagctctgatttgatcatgctgataactagctagcattttaattaggtggatgactaacactgccatttaaat

SEQ ID NO: 240 - DNA, 1793 bp, Glycine max
ttaattaaagtatcacaaaattattcagtgtgaagcaatatggggaacacgtgtgttggtcctagcatttcaaaaaatggttttgttcaatcagtttctgcggcgatttggcggtcccaattgcctgaaggttcagtgtctaatagagaatctgtaaaagaggaagcaactagtgtgcccgaatcgcccttgcctgtccaaaacaagcctcctgagcagataactatgccgaaacaagaagccaaacaagagggaaaatcagaaatagaaccggaaaaggaacaggataagaagaaacagaagaaacgtggttcagtgaagagagtttctagcgcagggcttcgtgttgattctgtgttgcaaagagagaccgataatttcaaggagttcttcactcttgggagaaaacttggacagggtcagttcgggacaacgttcttgtgcgtggaaaaggcaacagggctggagtgcgcctgcaaatctattgcaaagaggaagctcgtcaccgatgatgatgtcgaggatgtgagaagagaaattcagataatgcaccacttggccgggcatcctaatgttatatccatcaaaggtgcatatgaggatgccgtggctgttcatgttgtgatggaattatgtgcaggtggagagcttttcgataggattattcagcgtggccattataccgagagacaggcagccaagcttactaagactatagttggcgttgtggaagcttgccattctcttggtgtgatgcacagagaccttaaacctgagaattttctctttgtcaatcagcacgaggattcccttctcaaaaccattgactttggattatctgtcttctttaagccaggtgatatatttaatgatgtggtgggcagcccatactatgttgccccggatgttttgcgaaagcgttatggtcctgaggcagatgtttggagtgctggtgttatcctttacattcttttgagtggagtacctccattttgggctgaaaacgaacaaggaatatttgaacaagttctgcgtggtgatcttgacttttcttctgatccctggccttcaatttctgaaagtgcaaaagatttagtaagaaaaatgcttgttcgcgaccctagaaggcggttgactgcacatcaagtattatgtcatccttggattcaagttgatggtgtagctcctgacaagccacttgattctgccgtattaagtcgcttgaagcaattttctgctatgaacaagctcaaaaaaatggcccttataattattgcagagagcttatctgaagaagaaatagctggcttaaaagaaatgttcaagatgatagatgcagataacagtggtcaaatcacttttgaagaacttaaagctggtttgaaaagagtcggcgctaatcttaaggagtctgaaatttatgatttaatgcaagcagctgatgttgataacagtgggacaattgattacggcgagttccttgctgcaacgttgcaccgcaacaaaattgaaagagaagataatctatttgcagccttttcttactttgataaagatggaagtggctatattactcaggaagaacttcaacaggcttgtgatgagtttggcataaaagatgtccgtttggaagagataatcaaggaaattgatgaagataatgatggacgcatagattacaatgagtttgtggctatgatgcagaaaggaaatcttccagcggttggtaagaagggcctagaaaatagcttcagcgttaagttcagggaagcattaaaattgtagatttaaat

SEQ ID NO: 241 - DNA, 972 bp, Glycine max
ttaattaaagcaaggatggcgtcgagaccagaggtagttgcgccgcctgagattttctacgacgatgccgaagctcgcaagtacacctcttcttcccgtattgttcaaattcaggcgacgctgtcagagagagctctcgaactacttgctttgcctgatgacagcgttcctaaattactccttgatatcggttgtggatcgggacttagcggtgagacactctccgagaatggacaccattggattgggcttgacatttcagcatcaatgcttaatgttgcggtggagcgagaggttgagggtgaccttttacttggtgacatgggtcagggtctaggaattcgtcctggagttattgatggggccatcagtatatctgcggttcagtggttatgcaatgctgataaatcctctcacaaccctcgattaagattgaaggccttttttacatctttatacaaatgcttatcaaatggagctagagcagtatttcaagtgtatcctgaaaatatagaccaacgtgaattgattttaaatgctgcaatgcatgctggatttgctggtggtatagtggtggattttccacacagttctaagaagaggaaggagtttcttgttctcacttgtggtcaacgctcggtaaatgtgtccatttccaaaggtaaaaatgaagatagggagagttgctctgatgaggacagtgaagatgaagaaaaacagacagtatgtatatcagacaggcatagaccgcggaagaaacagaagaataataagagtggcaagggaaaggaatggttactaaggaagaaagagcagatgagaagaagaggaaatgttgttcctccaaataccaagtacacgggtcggaaacggaaggatcgcttttgatcttgtctggcatttgcctcagggtcgtgagtatgaaaagctagtcctatttgttatttgttaattgccgttaccaatttaaat

SEQ ID NO: 242 - DNA, 1653 bp, Glycine max
  misc_feature (1572)..(1572): n is a, c, g, or t
ttaattaagagttttgcagagttgaatcgtgaaagaggaatggcgaagcacgaggagcttccgatcccgatttacaacaacctagaacctgtctatggcggaagttccgcactcgaagaagctcagcttcgtttcgacattttgaagtccaaattcatcgatatcttcggccatcatcctcaaatctttgctcgctcacccgggagagtgaacttgattggggagcatattgattatgaaggttattcggtgctgcctatggcaattcggcaagatacgatcgtggcgattcggaaaaatgatgccgaaaaggttctcaagatcgctaacgtgaatggtgaaaaatattcactttgtacttatcctgccgatcctctccaggaaatcgacttgaagaaccacaaatggggacattattttatttgtgggtacaaaggtttccatgactatgcaaaattgaaaggagtggatgttggcaaacctgttggacttgaagttcttgttgatggaacagtgccgacaggttctggactatcaagctctgcagcatttgtctgctcatccacaattgctattatggctgcttttgatgtgaacttcccgaagaaagaacttgcacaagttacatgtgattgtgaacgacatattgggactcaatctggtgggatggatcaggcaatctctgtcatggccaagactgggtttgcagaactgattgatttcaacccaattcgtgcaacagatgtgcaacttcctgctggtgggacttttgtgatagctcattctttggcagagtctcaaaaggctgttactgctgccacaaattataataatagggttgtcgaatgccgtttggcttctattgtgctcgctataaagctagggatggatccaaaagaggcaatttcaaaagtgaacacactgtctgatgttgaagggttatgtgtatcatttgctggtattcataactcatctgatcctgtacttgctgtaaaggaatatttgaaggaagaaccatatacagctgaagaaattgaagcagttacaggggaaaagctgacttcatttttgaacaataatgcagcttatttagaagttgtaaaagttgcaaagcaatataaattacatcagagagctgctcatgtgtattcagaagccaagagggtacatgctttcaaggatgttgtatcctcaactctaagcgacgaggacatgctaaagaagcttggcgaccttatgaacgaaagtcatcatagctgcagcgttttatatgaatgcagctgtccggagttggaagaacttgtaaatatttgtcgtaacaatggtgctcttggggcaaggcttactggagctggatggggtggttgtgctgttgctttggtgaaagagagcatagttccacaatttatccttaatttgaaggaatgtttctaccagtctagaatagacaagggcgttattaagaagaacgatcttggcctttatgtatttgcttccaagccatcaagtggtgcggctatcttcaagttttagtgttctttaacccgcttcccttcttatggcatttaaatncttcccgagatctaaacacaaattagatgcaatttctgatggagtaagattaaatggtaccctcatcgttaagttatttta

SEQ ID NO: 243 - DNA, 1945 bp, Glycine max
ttaattaaacaattaatcccgaatagtagaggtagaagatggaaaatacatgcctatggattcagaaagagggtcgcagaagaaaagattcattgcatggcttattgaatgatagggaaatatcagaggaagaatcttcaaaatcacagttaaagaagttgattaaaagatcaaactctcatcgggcaatagttgtaaatgctatccaatcacaaatcagcaaagttttcttcaaggatttgttctttcgacgtgtccatggactagacaatcggattccaaaacatgtggtgagtgtggatgagaaatacatccgccgctgcctggaattcatacataacactgcattaaaagcagctcaattcaacatacctgagagcttaagagccacaaacatggagactttatcagaaagcttgaatacagtgaaattttttggtggaaatgcatgtggtttgggacattttgtctttgaatgtcctgtggccactgagaatgggagagtagttataagtgctaatgctggggaccagtggaccttaggttcaataatggggagcaagagcatgataaatatattgaatagtactcttcttcagcagtttggtgcttcacatagaactgacaatttgaacaggatgaacttttctgatcctgaaggattggtatgctatgattttatggactctcctagtgatttatgtatctcttcgtcgcataaacttggaaaggaaaaacagttagtgcgaagtcataagtatggctccatttctgttcataaaaggcttgtttccacttctagcaccacctctacttcttctgattggttgtcttcaacatcttccactctatctcagggaatgatccagtgttcttggaagcaagggattcctcattttgttttttctgcagatgatcagaaggaggtctatgtagcaaaattgaagaaggtagactcaacagataataaggctttggactatgtgtatgagtttcacttgaacaagggtggccaaaagggtcgcgagattcctgatggtgattttccatttgttgggaagatgcatgtatcaacgagtttcaccctttgcccgaacaattgtagaataagggagacggagtttacactattccataacatggaaatttctgacaaagaaatgtccacatcagagcattctcacaggaagagcaaggggctgtcgaaggtgtcgaaagtttttaaaactagcccatcatcaaaacgcagaacactctcaaggtttggtggatcaagtgccataaaggagagttgtccgtgggagccatatgctcttggcgggaccaatttattagatactgatgttcctccaaattttgaaatggctaccattgttgtgaaaaaccatcttccttgtaaaaaaccagagaaagtaggagggtggggtttaaaatttcttaacaaatctggtgaaaatcaaatcacgttgccatctgaaagtagtaatcaaaataatggcgactgctcaagtagcacgagcattctaattccggcaggctttcatggtgggccaagaaccagaaatggtgggccatccagtctgatagatagatggaaatctggtggccactgtgactgtggtggttgggatgaggggtgccctctgactgtactagagagaagatctaacaaagctgaggttatgtctaaaatagatacaggagacgggtgcaagtcagttgatttggttattcagggttcaagtgattacggccccaccttgaggatggtaaatgttcacgatggtttatattatattcatttccatccacctctatctgcactacagtctttctccattgctgtggcaataattcatgcacaaagtcctacacttcagcccaatggtgcaaagaagctgtcataactatagttgaatctgaggttatttagccgtatttaaat

SEQ ID NO: 244 - DNA, 1400 bp, Glycine max
ttaattaatttttgggttttctgagaagtgcgtgtgttgatggggggtcaaaattctaaggaggaaagttggaggcagagttcatctgtcaggtcttcttcttcttcttggagtgcttacttggatccactatcgagttatggtttcaatgaaccgcaaccatcatattcttcttatggctatgaagcttatggtggcgatggaatggtacgctatgatagtacaaagctagagaggaggtactcaagaatttctgatcattacagttccatagatcaggttagtgaggctcttgcacttgcaggccttgagtcttctaatcttattgttggtgttgatttcaccaagagtaatgagtggacaggcaagaattcattcaataggcgaagcttgcatcacattgggagaggtctgaacccttatgagcaagcaatatcaattattgggaaaagcttggcagcattcgatgaggataacttgatcccctgctttggatttggagatgcatcaacacacgatcaagatgtcttcagtttctatccgagtgaaagattttgcgatggatttgaagatgtgttgagtcggtatagggaaattgttcctcatcttcgacttgcaggtcctacttcatttgcgccaataattgaaatggccatgagcattgttgaacagagtggaggccagtaccatgtgttggtgataatcgcagatggccaggtaacaaaaaatgtagacactaaacatgggagaccaagtccacaagaacagaagactgtggatgccatagttgcagctagtaaatttcctctttcaatcatattggttggcgttggagatgtaccgtgggacatgatgaaggaatttgatgacaatatcccagctcgggcctttgataattttcagtttgtgaatttcacagagattatgtcaaaaagcatccctccttcacgaaaagaggcagcatttgcacttgctgcattgatggaaattccttctcagtacaaggcagcaatagagcttaagctactgggtagtcggcaagccaatgctcctcaaagacatgctcttccacctcccagatatagttctcatgctgcaaggtttgagccaagtatccctcctcaacatggcaacagccacccatttgccacagctccttctgccccaagttccacttctgacaatcaactttgtcccatttgtctaagcaatgcgaaagatatggccttcggatgcgggcatcagacatgctgtgaatgtggacaagatcttcagtcatgccccatgtgcaggagccccataaatacaagaattaagctttactaatcgtatgtggcttgggaattggtattattttttttcttatttttgtgtggtgccagtcacaattctatttaaat

SEQ ID NO: 245 - DNA, 743 bp, Arabidopsis thaliana
aataagcattataaataaacccaaagaggtgttagatttatatacttaattgtagctactaaatagagaatcagagagaatagttttatatcttgcacgaaactgcatgctttttgagacatggcaatcttccgaagtacactagttttactgctgatcctcttctgcctcaccacttttgaggttcataacttttgtctttacttctccatgaatcatttgcttcgtcttatccttaattcatatgtgtttgatcaatgataataattcatcattctcttcagcttcatgttcatgctgctgaagattcacaagtcggtgaaggcgtagtgaaaattggtatgtaacgctaacatatatgtaaagtgttatatctctgtttatatatgatttttaaacggttaaaaactagtcatatgtgtataaatatatcatgtgaagattgcggtgggagatgcaaaggtagatgcagcaaatcgtcgaggccaaatctgtgtttgagagcatgcaacagctgttgttaccgctgcaactgtgtgccaccaggcaccgccgggaaccaccacctttgtccttgctacgcctccattaccactcgtggtggccgtctcaagtgcccttaaacatatacacatacagatgtgtgtatatgtcttccgcgagcacacacgtacgtttatgttttaaggacaatagtatgtatgagcagctataaacaaaccagaagttaatggttcatgttg

SEQ ID NO: 246 - DNA, 933 bp, Arabidopsis thaliana
gtttcttgtttgttgattaacccttaattaagatggaggtctcatggaatgaattacatatcaaagagcgtgtgggtgctggatcatttggaactgttcatcgtgctgagtggcatggatcagatgttgctgtcaagattttgtctattcaagatttccatgatgaccaattcagagaatttctcagagaggttgctataatgaaacgtgttcgtcacccaaatgttgttctcttcatgggtgctgtgacagagcgaccccggttatcaataataacagaatatttgccaagaggcagtctttttcgccttatccataggccagcttctggggagttgctagatcagaggaggaggctacgtatggcattggatgtggccaaggggctcaactacctacactgtcttaatcctcctgtagtgcattgggacctgaaatctccaaatctactggttgataagaactggacagtgaaggtttgcgattttggactttcaagattcaaggcaaacactttcataccatcaaaatctgttgcaggaacacctgagtggatggctccagagtttcttagaggggaaccgacaaacgagaaatcagatgtttacagtttcggagtagtcttatgggagttgattactttgcaacagccttggaatggactcagtcctgctcaggtggttggagcagttgcattccagaacaggcggcttataattcctcccaacacctctccggttttggtatctctaatggaagcttgctgggcagatgagccgtctcagcggccagcatttggtagtatagtggacacattgaagaagctactaaagtctccggtgcagctgatccaaatgggtggagacaaaggggtaattccaactaaatcagctcccatactatagatttaaatacccagcaaattggagctct

SEQ ID NO: 247 - DNA, 2058 bp, Arabidopsis thaliana
cgattttccatgattcgaagatacagagccttagcgatgaagaaaaagccctaaaaaccaaagctttgatctctccgaaatcggagtttctttctttgtttggtaaatttggttttcgaaatgtataagaaccagctacaagagttggctcagaggagctgctttaatcttccttcgtatacttgtattagggaaggtcctgaccacgcgccgcgattcaaggctactgttaactttaacggcgagatctttgagagtcctcagtattgttctactcttcgtcaagctgaacactctgctgctgaagttgctctcaatgctctctctaatcgtggtccttctcactctcttgccgccaggatcttggtttgtttcgcttcctcttactctctttggcattttacttggaaaattgtgagctttgaatgctgaatttgcatgttgttttaggtgctttaggtcactgatgggtttagtttgtggttaggtttttacttattagggtcggtgctgagatctctgacttgctttttagggatttgggtttctgggttgtctgattagagagagtgatcttcacattcactgatctatggatccaaagtttgaatcttgttcttacccattgattggtttgggacttaaatgagtagaacaaataacttttgtgattttggatgcatgtttacttctgatgttttgcttgttgcatgactgatgatacttttcttggctctgttcttttggattatggtttgtgtaggatgagacgggtgtgtataagaatcttttgcaagagatagctcaaagagtgggagctcctttaccgcgatatactactttcaggtcaggtcttggtcaccaacctgtgtttactggtactgtagaattggctggaattacgttcactggagatccagctaagaacaagaagcaagcagagaagaatgctgcaatggctgcttggtcttccctaaaacaatgtgagtcctaattctgattttgtcagttttgatatggttttagtttaacgcaggcgttgatcaaatgtaactctgcttacatggtttgatgttttttatgttcttcttggtaacagtggcaaaagaaacatcaagttcaatgcctgagcctgagaacattgacgaactagaacaggtgattatagcaagagctttgataaactatcgtatcaaggaaaacattggcacaggaagctcctcgagtgccccagttccatttgcaaagaagttctttatgcagaaccttagaccaacaagtccacagccttctcctgcaaccacatcgagaatcttaccctttatttgcccaaaacaaccttccagaagcagcagatcatccttagcagcaacttccggtattgacagaattatggcagcagccttggaaagccgcagctaccagcggcctcagcagagatttgcaaatccgccttatgttcctatgaggcaatttagatcgcaatgccatgggatggctccacctgtcacaatcagaaccgctgtaccggtcttctctgcacctccaatgcctcctccaccatgtacaaacaacactcagctaccttcttctgtgtatgtcccatcgctgatgcgaactgcaccacctgtgaggatcgcgccgcctgtcacaatcagaaccgcggtgcccgtatttgcttctgcgccaccggttagaattagaaccgctgtgaagcccacagttgaggcaggagaaacccgcatatcatcagtccaagaaaaggagagtataccagtcttgcctgatagtcttgaaattggagtagaaggaagtactataacaattacagattgtgagaaaacagcgtcaaaggaaaccgagagagcagagtttaaggattcatcgaaaggagaaccggagacagcaagagagcgactggagaacctaaagatctgatgccttgaagactgtctctgggtttagttttttttgaggttggtttctgaaaattgttacattagtaatctcgttcgttattatactcggtggatcgagtagtttgataatccgaaagat

SEQ ID NO: 248 - DNA, 1202 bp, Arabidopsis thaliana
ttaattaaatggcggaagtaaatggagtcattccaacaatagacttggaagaggttaatgatcagattctgaatgagaaaatccgtgaagcgagtgagagatggggatgtttcacggtgataaaccatggagtttctttgtctttgatggctgagatgaagaagactgttagagatctccatgaacgtccatatgagatgaaactgcgaaacaccgatgtgttactagggaatggttacaagcctctaagtgagttcaatcctttttatgaatcatttggtctttttgacatggcatctcctcaagctgtcaatagtttttgtgataaactcgacgcctcgccagatcaaaggttaatttatcttttttataatgtttttgatgacgtcgttatcattttttgtacaattatattggtcccaataacagttttggatccatcaaaaatgtttgaaacattaatatatgctgtcttttttttttttggttgttggcttgcagggagattttgctaaagtatgcaaaagctactgatgatcttgcgaggagtctagcaaggagattagcggagagctacggagtggtagagcccaattttttgagaggatggccaagccaatttcggatgaacaaatatcattttaaaccggattctgttggaaaactcggtgtgatattacacacggatcctggtttcttgacaattcttcaaggtgatgaggatgttggtggacttgaagccatggacaactcttcaggatcctttttccccatacacacattgccgaacacgcttcttgtcaaccttggtgacatggctacggtgggatgatatcacccgtagttagtatatagttccaaaaatatgttgaacatgaaaattaaactttattttttttggtttttgaaactttatgatagatatggagcaatggaaggttatgcaatgtgaagcatagagtgcaatgcatagaggcaaaaatgaggattactattgcttcgttcctattaggaccagtggatagagatcttgaagctccagatgaatttgtggatgctgaacatccgcgactatacaagcctatcagtaacggaggactaagaaagattagacttagcaagcatcttcatgctggcgaatctctcaagttcataaccataaatgagttaagtgacgtcccaaagatagattaaggcgcgcc

SEQ ID NO: 249 - DNA, 379 bp, Arabidopsis thaliana
ttaattaaatggcggaggagagcagagtcccatcatcggtgtcggtaacagtcgcccacgaccttcttctagccggccaccgctatctagacgtcaggactccagaagagttcagccagggacatgcctgtggggcgatcaacgtgccttacatgaatcgaggagcatcagggatgtcaaagaaccccgacttcctggaacaagtctcctcccatttcggacaatccgataacatcattgttggctgccagagcggtggtagatctatcaaagccaccaccgatcttctccatgcaggtttcacgggagtcaaagatatcgtcggtggctatagtgcctgggccaagaatggccttcctacaaaggcttgaggcgcgcc

SEQ ID NO: 250 - DNA, 2824 bp, Arabidopsis thaliana
ttaattaaatggcgacacattctatgatcattccttctccttcttcttcttcctcgtctctcgctactgctgcgtctccgtttaaagagactctaccactctttagtagatctctcacattcccgagaaaatccttgttttctcaggttcgcttgagattcttcgccgagaaacattctcagcttgatacttcaaatgggtgtgccactaatttcgcttctttacaagattgtgagtttcttctccagtttctatgtgactagattagtttttgatagaattcttgatgaagtttcttgtacctgtcgttgattgtgttgttaggattgtaacagttttatgtctattgaagaaagttgttcaagattgtatctttatgaccttttatactcaaagataccatctttgattgtaaagtttatgtctttgagtattctaggattgaatgtagaagattagagtgattgtgagttggttagatagcaatgagtaagggtttggttttggaatttggttaataaagtctctttctttatgaactgaagtagttttgtagcctctgtctgtgtttttgacgattgaagaaagtagttcaagattgtatcttttgtactcaaggataccatttctcatctaaggattatgtctttgagtattctaggattgaatgtagtagattagagtgattgtgaggtagtgagggtttggtttagcaatttggttgataaagtctctctttttatgaattgaagtagttttgtagcttttgtttgtgtttttgattctttggaggatggtttttaccaaattgtttcagctggagatcaacttacagaggaacatgttacaaaaggagagtctactcttagtattacagttgttggagcgtcaggggacttagccaagaagaagatatttcctgcattgtttgctctcttttatgagggttgtcttcctcaggacttttctgtttttggttatgctcggactaaactcactcatgaagagcttcgtgacatgattagtagtactttaacttgccggattgatcagaggtatattctgctatacgtttttagtgtatgttttagttaaagtttatgctttggttatatgaacaaaagttggaatcaacagggaaaaatgtggggataagatggagcagttcttgaaaagatgcttttaccattcgggtcagtataactcggaagaggattttgcggaactaaacaagaagctcaaagagaaagaggtaattttctttcactctctctatgcttatttcttgtaccaatggcacgaagcacatttctaattcctttctgctttgtaggcaggaaagatatcaaacaggctgtactatttgtcgatacccccaaacatattcgttgatgtggttaggtgtgcaagtcttagagcctcctcagagaatggctggacaagggtcattgtggaaaagccatttggtcgtgactctgaatcatccggagagttaactagatgtctgaaacagtatcttacagaggagcaaatcttcaggttagccatttccttagcccaacagccatcactgccattcatttttaagctggaacttaactgcaatgttatgtgacatacgtaggattgatcactatttgggaaaggagcttgttgagaacctttcagtgctccgattctcaaatcttgttttcgagcctctgtggtcaagaaattacatacgcaacgttcagctgattttttctgaggatttcggaacagaagggcgtggagggtaagctttcataaacaacttacaaagcatgaacactgaacacctttgatcagtatgacactgaacaccttactaatgttaaatcgatgcagttactttgatcaatatggaatcatacgagacatcatgcaaaaccatctcttgcaaatacttgcactttttgcaatggagacgccagtgagcttagatgctgaggacataagaagtgaaaaggtaagacttttttcactaagaagaaaagctttaggttggttataaaatactataccgatgattatgtgttcctgtaaggtgaaagttttgagatcaatgaaaccgttgcggcttgaagatgtggttgttggtcaatacaaaggccataacaagggaggaaaaacttatccaggttatacagacgatccaacggttccaaatcacagtctcactcctacatttgctgcagcagccatgttcatcaacaatgcgagatgggacggtgttccttttcttatgaaagctggaaaagctctccataccagaggagcagagatcagagttcagttcagacatgtcccaggaaacttgtacaagaaaagttttgctactaatttagacaatgcaacaaatgaactagtgattagagttcagcctgatgaagggatatacctgaggatcaacaacaaagttcctggtcttggaatgagactagatcgcagcgaccttaaccttctatatcgatccaggtacaacaatgcatactactgattctagttttcctatagagattatttatttatattcttttggggttgataggtatccaagagagataccagatgcatatgaaagactgcttctcgatgcaatcgaaggagagaggaggttgtttatcagaagtgatgagctagatgcagcatgggatctattcacaccggctttgaaggaactagaggagaagaaaatcattcctgagctctatccatatggaagcagaggtcctgttggtgcacattaccttgcatctaagtacaatgtgagatggggagatcttggagaagcttaaggcgcgcc

SEQ ID NO: 251 - DNA, 532 bp, Arabidopsis thaliana
ttaattaaatggcttcaggaggatcaaagtcggcagctttcatgcttctgatgctgaatcttggtctctatttcgtcatcaccatcatcgcttcttgggctgttaatcacggcatcgagagaactcgcgagtctgcgtcgacactgtcacttccggcgaagatattcccgatatacttcccggtggggaacatggcgaccggttttttcgtaatattcacgttaatcgccggcgtcgtcggaatggccacatcactcaccggaatcatcaacgttcttcaatgggactctccgaatctccactccgccgcggcttcctctctaatctcctggtctctcactctcctcgccatgggattggcctgcaaggagatcaacataggctggaccgaagccaatctaagaactcttgaagttctgactataattgtgagtgctactcagttgttgtgcaccggagctattcatgctggagtcggagaaacagtcgcctccggagaaaggcctcatcttgggagagtttgaggcgcgcc

SEQ ID NO: 252 - DNA, 1060 bp, Arabidopsis thaliana
ttaattaaatggccaccgtcacatccaatgcttcacctaaatccttctccttcactgtttccaatcctttcaaaaccctaatccccaacaaatcaccatctctctgttatccaactcgcaacaagaaccatcaccgtctaggtttctcgataaaagccaccgtatcaacaccaccttcaatcgcaaccggaaatgcaccttcaccggattacagagtcgagattctctccgaatctctaccatttatccaaaaattccgaggtaaaaccatagttgtcaaatacggcggcgcagcaatgacttcgccggaacttaaatcctccgtcgtaagcgatctcgtgctcctcgcgtgtgtcggtcttcgtccgatcctcgttcacggtggtggtcctgacatcaaccgttacctgaaacaactcaacatcccagctgagtttcgtgacggactacgtgtcaccgacgcaacgacgatggagatcgtctctatggttttagtcggaaaggtcaataagaatctggtttctcttattaacgccgccggagccaccgctgtggggttatcaggacacgacggtcgtcttctcacagcacgacctgttcccaattcagctcagttaggtttcgttggtgaagttgcaagagttgatccatctgtgttacgtccgctcgttgattatggttacattccagtgattgcctctgttgctgctgatgattctggtcaagcttacaatatcaatgcagatacagttgctggagagcttgcggccgcgcttggagctgagaaactgattctgctgactgatgtggctggaatcttggagaataaagaggatccaagtagtttgataaaggagattgatataaaaggagtgaagaagatgattgaagatgggaaagttgctggtgggatgattcctaaagtgaagtgttgtataaggtctctagctcaaggagttaagactgctagtattattgatggaaggagacaacattctttgcttcatgagattatgtctgatgaaggagctggaactatgattactggataaggcgcgcc

SEQ ID NO: 253 - DNA, 1213 bp, Arabidopsis thaliana
ttaattaagtgtctcttcaaacttcggttactccgttttagtcgacaacaatggcctctgtttcaaggaggttactgaggagagagacgatcccctgtttcagccacaccgtgaggaaactcttctccaccgttggatctccttcttttgctcagagactcagagatctccccaaagacttcccctctaccaacgccaaacgtgacgcctctctgcttattgggaaaacgcctcttgtgttcctcaacaaagtcactgaaggttgtgaagcgtatgttgcagccaaacaagaacatttccagccaacttgtagcattaaagacagaccagctatagccatgattgcagatgcagagaagaaaaaactaatcatccctggaaaaacaacactgatagagcctacttcaggaaacatgggaatcagtttggctttcatggctgctatgaaagggtacaggattataatgacgatgccttcgtacactagcttggagaggagagtgacgatgagatcctttggtgctgagcttgttctcactgatccagccaaaggaatgggtggaactgttaagaaagcttatgacctccttgatagtactcctgatgctttcatgtgtcaacagtttgctaatcctgcaaacactcagattcattttgatacaactggtcctgagatttgggaagatacacttggaaatgttgatatatttgtgatgggaattggcagtggaggcacagtctctggtgttggccgataccttaaatctaaaaaccccaatgtcaagatatatggagtggagcctgctgaaagcaacatactcaacggtggcaaaccaggtccacatgctatcacaggcaatggtgttggattcaaaccagaaatcttggatatggatgttatggagagtgttcttgaggttagtagtgaggatgctataaagatggctagagaattggcattgaaagaaggtctcatggttgggatatcgtcgggagctaacaccgtggcagcaattagactggcgaaaatgccagagaataaaggcaaactcattgtgacaattcatgcgagcttcggagaaagatatctgtcgtctgttctgtttgatgagctgaggaaagaagcagaggagatgaagccagtttcagtggattgatgaaggaagactgacactttaccaaaaatctcgggagcaaaagattatggcgcgcc

SEQ ID NO: 254 - DNA, 775 bp, Arabidopsis thaliana
ttaattaatttcattcttctaagccctagctcaaagctttctctctcaaatccgccatgactaaacagcacgcgaactggtctccttacgataacaatggaggaacatgtgtggccatcgctggatcggattactgtgttatcgccgccgatactcggatgtctactggttacagtattcttagtcgcgattactccaaaatccataaactagcggacagagctgttttgtcttcctctggcttccaggctgatgtgaaagctttgcagaaggttctcaaatccagacacttgatctatcaacatcagcataacaagcagatgagctgtcctgcaatggcccagcttctctccaacacgctttatttcaagcggtttttcccctactatgcctttaatgttctaggagggcttgacgaggaaggaaaagggtgtgtctttacttacgacgctgttggctcatacgagagagttggatacggtgctcaaggttctggttccacactcatcatgcctttccttgacaatcagctcaagtctccaagtcctcttttgctacctaaacaggattcaaacacgcccctttccgaagctgaagcagttgacttggttaaaactgttttcgcatctgccacagagagggatatctacactggagacaagcttgagattatgatacttaaggccgacggtatcaagaccgaactcatggacctgaggaaagactaagctcctttagtgcatttagccaaccttatcggtttgttaggcgcgcc

SEQ ID NO: 255 - DNA, 1628 bp, Arabidopsis thaliana
ttaattaactttgaaagaacaaacggagacagagagtgagagaaaatggcaatggttgttccaaaagaagggcttgtggttatggacaaggaatctgtttcttcagcttcatcggattctcatcttcgtctccaacctcactttcctgacttcactattcctgttaaagtcagttccttttctttttgttctttctggtccagtctctctctgcttttatgagtatatttgaatttgtggagttttaacattctggattatgttttggtaatggtattatgttgtttggatatgcatgagataagggtctgctacttgattgaatgattttatagaaccattgtgtgatattttctctctgttatgtttgattcaggatttcttcaagtctagggaagcccgtgagtttcttagtggggctttagctggagctatgaccaaagctgttcttgctccacttgagactataaggtctgtatagtcccttgtgatctcctcaataatacactttgatgtctaaaatttaactaaaaattgcattgtgcggtgtgaaatctggcaggacaagaatgattgttggtgttggatcgagaagcattccaggtagttttctggaagttgtacagaagcaagggtggcaaggtctttgggctggcaatgaaatcaatatgattcgaatcattccaacgcaagcaattgagttagggacattcgagtgggtaaaacgtgcaatgacatcagctcaagtgaagttgaagaagattgaggacgccaagattgaaatcggtgattttagtttcagtccgtccatatcgtggatctctcctgttgctgtggctggtgcatctgctggtattgccagtacacttgtttgccatcctctcgaagtcctcaaggtaatgtcttagtcaatcaaagtctgttttataacgctattgaatttttttagtctagagttgaaagagagtgatgttctctgatctttaccaggatagattgactgtgagccctgagatttatccaagcttaagccttgcaattccaagaatttttagagccgatggaatccgtggattttacgctggcttaggaccaacattggtcgggatgcttccttacagcacatgttattacttcatgtatgacaaaatgaagacctcatactgcaaatccaagaacaaaaaggctttaagccgtccagagatgcttgttcttggagctttagctggtaagtaattgaagaaaccactccctttacagtatttccttacttaaatcatgtttaagactcattgagttgtgactggggtcaggtctaacggcgagcaccataagcttccccttggaagtagcgcggaagcggttgatggttggagctctgaagggagaatgcccaccaaacatggctgcagcaatagcagaagtagtgaagaaagaaggagtgatgggactctacagaggatggggagcaagttgtttgaaagtcatgccatcttcaggcattacttgggtcttctatgaagcctggaaagatattttgcttgccgccaacaccaaaccactcatataatgacgaaattgtaacctaagttattattgtttctttaaagctaaagcctgggcgcgcc

SEQ ID NO: 256 - DNA, 466 bp, Arabidopsis thaliana
ttaattaaatgcaggcggtatcagttgatgaaaccaaaaacacggtggtgctacgggcggagcacaagaatgaagaaggccggaaatctgttgataagttcgaagtgaagacacgtaatccggagacgatcaagagcgttgagcggaagcttatggagaaaggtgttcaacggatggatcgtcatccttccgatgggattcctctcaggcgaccaccatcgaagtcaggtcacggcgggaagtacacgtgggaaggacctgatcggatggaggattacgagatgcagccggatccaccggcgatggatgaaggagatcctaattacgacgaggaacaggtgaagaagagtggtgatgacgtggcggttgagcttgtgaaaggagaggttgaggtggctaaggaggctccggctggtgttgctagggttgaggttgatcctcgcttggtcggtcgttgaggcgcgcc

SEQ ID NO: 257 - DNA, 610 bp, Arabidopsis thaliana
ttaattaaatggcggactacgacgacgaaattgaccagaataaccaacctttcatccccaaagaaactgctctacaagcactaaactcaataatccagctccacttcgagaaaaccttagagaagaaacgagccattgaccaccagaagaagaagctccacaagctatttcagctcttcttcatcttcctcgccgtaatcttcttctccctctctcaaccctcaggtcgtcttcactgccgccattgctgggcacccatctgcctcctatccttctctcacctcttcttctacgtctccgtcgctcaaactctccgttgcatcaacggcttcaagtaccagcgtcgctgccataagctcactctcggtctcgccactcacaagctccgtttcatcaagtcaagaatcgctgccggagatttcctcggtggaggcgacggtgatgaggcctctgctgctgcttgggatctggaagttccgtatcaagaaccacctgatagctactttggcaagtttaagagaaattgggctctctattttgggttcttgatccttctttacactttcatgatctctttctctgtcgttatcctctgtttctgaggcgcgcc

SEQ ID NO: 258 - DNA, 2958 bp, Arabidopsis thaliana
ttaattaacacagatctctgaaatcgaaaaagcttgagctgtgttaatggcggaggagaaatgggtggtgatggtgacggcgcagactccaacgaatatcgccgtgattaagtattggggaaagagagatgaggttcggattcttcccattaatgatagcattagcgtcacgcttgatcctgatcacctctgtactctcaccaccgtcgctgttagtccttcctttgatcgagatcgaatgtggctcaatggcaaggtactacttgctcttcattttctcataagcttagattcatataaattgaattgtgaaatgaacttggattaggtaatgtattgttgtgatttataagcatttgagtattgttggtttttgttgatgttgtttttttccggtttcatgctagtataggaaatctcgctttctggaagtaggtaccagaattgcttgagggaaattcgaagtcgtgctgatgatgtagaagataaagaaaagggtatcaagattgcgaagaaagattgggagaagctgcatctgcacattgcttctcataacaacttccctactgctgctggcttagcatcttctgctgctggttttgcttgcttaggtactctgattttttctctacgtttccttgtgggtgttggtttcttagcataaaacacgaaaattccgccatttttggactctttctttttttgtcattgttaaagtgaaggaacctcattgtatgtttatggatacttgaagattgctttaagctaggatgagatagtacaatcatgaaaatgtaggtgctttttgtttgttggatttatgaactttattacagtgtccgattgatcttttttagcatagattctctggataatacacgatcaaatggtaacatggctttcttctctttattcctcatcttccttctagatctgtatcttttctgcataatgtagcttagaattgctcaactttaatgacattgatcctgtctctttcctccagtgaatgattttctagattccctaagtcgatctatcttttggaatggaaattgctcaatgtagtagtatataacgcttgcttttgggtacagtttttgctcttgccaagttgatgaatgtaaatgaagatccaagccaactttctgctatagcaaggtataacttaccttacctgactcgcattttcacccttaatgatcttttttgtatcttccatgttaactgtacgagttactattatccttgttttacagtgactgttaaatatcatctgttgttattttttaagttgtgattttaattgaatcatgtatagttcgacgttcctctagaaaataagtggtaccagtatatatgattataacttatattgtcatttctccatgtaggcaaggttcaggaagtgcttgccgtagtttatttgggggatttgtcaagtggaatatgggaaacaaagaagatggaagtgacagtgttgcagttcaactggtagatgataagcactgggatgatcttgttatcattattgctgtggtatgaatcttaaatacctttaatctagtgcatttttaaattcatgcgcagtatcgatcctattcttcatcttctatattatgtcagtctctaattaactttttgttacacttccttgtctaatgatatgaatgaaggtgagctatacgaagaagtacatttctgctgcttttcttgaataagaagatcttaactctgtgataattctatgttttcttatcatttccatcatagcctgcaaaagcttcttcgttcagttgttttttttgtccatctttttcatctcatacagcttgtgttacatgcaggttagttcacgacagaaggaaacaagcagcacctcgggaatgcgtgagagtgttgagacaagtttgcttttacagcatagagcaaaggtatgttctctttttgatgattgataacagtctgtatcacctaaaattacctttgttgggttcctaaacaaagtatatgaattgttttggttgtgcttgcttaacttcaaaaatgaaaatagcccccttaacttcgtgctctaaattctccttaggaagttgtcccagtacggattttgcaaatggaagaagctataaagaatcgagatttcacatcttttacaaaattgacgtgttcagacagtaatcagtttcatgctgtttgtatggatacatctccacccatattctacatgaatgacacctcccacaggtatctttttctcttattttgtttcatttggcagtcatttgcagcttttagctatcagtgatgtggtattgatcgcaatccactaactaatgatgccaggataatcagcttagttgaaaagtggaaccgttctgccggtacaccagaggtatgtatgcttgcttactccatagctcaaaagcaagtattgaatttcatataggtttcgagattatgacgttggacaagtcttctgatcttaatctcgttgtcctggacagattgcttatacatttgatgctggcccaaatgcagtcatgattgcaagaaacaggaaagtagcagttgaattgctgcaggggctgctctactgcttccctcctaagcctgacacagacatgaagaggtgagataggaattgttattgatctgattgattgatttaattcctgactaataaaaatggtgttttggtactttgtatagttacgtactgggggatacatcgatagtaaaagaggcaggcttggaaggagagcttccacaaggaattaaagacaaaattggaagtcaggatcaaaaaggtgaagtgagttattttatatgcagcagacctggaagaggtcctgtggtgcttcaagaccaaactcaagctcttctccatcctcaaactggcctccccaaataaccatttctatgtcttgttgttacttcaactctgagaggcgcgcc

SEQ ID NO: 259 - DNA, 2175 bp, Arabidopsis thaliana
ttaattaaagtcatttgagcaaacacagatggacatcatctcagggcaagctctgtttctcctcttttgctttatctcatcatgtttcctcatctcgacaaccgcaagatcccgacggagttctggccgagccgccacgctgcctcctggacctccacgattaccgattatcggaaacattcaccaagtcggtaaaaacccgcacagctcattcgctgacctcgcaaaaatttatggaccaatcatgagtcttaagtttggatgtctaaactcagtcgtcataacttcaccagaagctgcaagagaagtactaagaacacacgaccaaatcttgtctggccgtaagtccaatgactctatacggtgctttggtcacgaagaagtttccgtcatctggcttcctccgtcgtccgctcgttggaggtacaaacctaatttcatttttcttttaccacttcgtatttagtttaacaattttcaaatgcttgtttaaactaaaattttgtatttgtacgtaaacataattaataattttattacggtttgtcggtttctaataaattcaactgtttttggatacaatcttagtcgaaattacggtttattgacgcttgtaacgagtaaaaactttagagtgttgtcttgaggtgttccaattgttaatcttcaaacataaacgcaaacgtaacaaagacaccaattagagtataatggatcgctgttatgatttgtctcaggatgttgagaaaactgtcagtgactctcatgttctcaccgcagcgtaccgaagccactaaagctctgcggatgaagaaagtgcaagagcttgtaagcttcatgaatgaaagcagcgagagaaaagaagcagttgatatttctcgtgcatcctacaccacagttcttaatatcatatccaacattctgttttcggttgatctcggtagctatgactcgaaaaaatccaacgaatttcaggacacggtgattggtgccatggaagctgctgggaaaccagacgctgctaactactttccatttatggggtttcttgacctacaaggtaataggaaggcaatgaggggtctgacggagaggttgtttagggttttccgtgggttcatggatgctaaaatagcagaaaaatcattagggaattactctaaagatgtttccaacagagatttcttggattcgcttctcatcctcaacgaaggagatgaagcagagctcgacaataacgatattgaacacctactcttggtaagttctaccagcttgcagataatcaagattgtagtcaattttctgttcattcgttttgagatgaaatttcattactcgcaatcttccaacaaatcttgagacggaaatgtcaaaaatatgacttgatcatataaagacatcttgaatacggtttcgcaatgttatgttctttttatcaatgtcttgagatgaaaccacatgaatctttatatacggttccacaatgtcaagctcacttatttatatatgattgtatttcaggatatgtttacagctggcacagatacaagctctagtactctagagtgggcaatggcagagttacttagaaaccctaaaacgatggtaaaagctcaggcagagatggatcgtgtgttaggtcaaaacagtgttgtgcaagagtcagatatctcaggattgccatatttacaagcggttgtgaaggaaacttttaggttacatccggctgctccgctactagtcccacgaaaagcggaatcagatgtggaggttcttgggttcatggtgcctaaagatactcaggttctagtgaatgtgtgggccataggacgagacccaagcgtatgggagaatccgagccagttcgagccagagaggtttatggggaaagatattgatgtgaaaggtagagattatgagcttacaccgtttggaggaggacggagaatatgtccgggattgcctttggctgtgaaaacagtgtctcttatgcttgcttctcttctttattcctttgactggaagcttcctaacggtgtcgtttcagaggacttggatatggacgagacctttggtatcacattacacaggaccaacacgttatatgccattcccgtaaagaaacagaccattaattagccattgtaatactttcctctgtttgggcgcgcc

SEQ ID NO: 260 - DNA, 1916 bp, Arabidopsis thaliana
ttaattaaatggacctctcactaattcaaggcatgtctctgcctctctattttctcttaacattattctttttcttctttgctaccgcaaaaacgcggagaagctctagcaccggcacgcttccaccgggtcctccgatactgccattggtcggaaacatattccaactcggattcaatcctcaccgttcacttgctgccttttcgaaaacgtacggacctataatgagtttgaagcttggaaggttaaccgcagtggttatatcttcaccagaagcagctaaagaggcacttagaacacacgaccatgtcatgtccgctcgaacctttaacgacgctcttcgagcctttgatcaccataaacattctattgtctggattcccccctctgctcgttggaggtactaactctatctaagatcaacatttcatttctttttaactctctttgtgttgatatcatccgtgtactaaacttcaatttaaaactttaaatctatacacacgtgaagtgattagctacgtacaactccattaaagttctgtatgtatgcattgtcaggtttctgaagaaaacaataacaaaatatttgttatcaccgcaaaacttagatgctattcaatctttaagaatgagaaaggtggaggaactagtgagtttagtaaatgaatttcgcgagagaggagaagctattgacctggctcgtgcttccttcgtcacatctttcaatatcatctcaaatgctctgttttcagtagatttagcgacgtatgactctaactcctcgtcttacgaatttcacaacacagtggttcacctgacggatatcgccggtatacccaacgtaggagactatttccagtatatgaggtttcttgatttgcaaggtacccggaaaaaagcggtgctctgcatagagaaattgtttagggtttttcaagaattcattgatgctcgattagccaaaagattttctcggacagagaaagagcctaaagaggcttcaagcatcgatatgctagactcccttctggatctcacacagcaaaacgaagcagaattaacaatgaatgatctcaaacacttgcttctcgtaagtctttcacacacaccaatggtaagattaagatattgtttggatgcaaatatcatcagtttacctattttgtgacaggatgtgtttgttgcgggcacagacacaaactctagtacaatggaatgggcaatgacggagttattccgtagcacggagaagatggtcaaagcacagagtgagatacggcaagtgattggtcaaaacggtttcgttcaagaatctgatatcccgagtctgccttacttacaagcaattgtgaaagagactcttcgtttgcatcctgcagctcctttgatccctagaaaatcagaatccgatgttcagattatgggtttccttgttcctaaaaacacccaggtttttctcatacttatctttattacaccaacattcattacttgagatattacaccaataaaaaagtttggtttggttaaaatcttccacctctgtttctcgagattaggttgttgtgaacgtatgggcgataggacgagacgcgagcgtgtgggaaaatccaatgaagttcgagccagagaggttcttgttacgagaaaccgatgtaaaaggcagagatttcgagttgataccgtttggatcaggaagaaggatgtgtccgggaatctcgatggctcttaagacaatgcatatggtgcttgcctctcttctctattcctttgactggaagcttcaaaacggtgtcgtccccggaaacattgacatgagcgagactttcggtcttaccttacacaaggccaaatctctttgtgccgtacccgtcaagaaacctacaatatcgtcttcttattaaggcgcgcca

SEQ ID NO: 261 - DNA, 2124 bp, Arabidopsis thaliana
ttaattaaatgtgggcattgctcatttgggtttctttgcttctcataagtatcacacattgggtttatagttggagaaatcctaaatgcagagggaaacttccacctggttccatgggtttccctttactcggcgagagtatccaattcttcaagccaaacaaaacttcagacatccctccttttatcaaagagagagttaagaagtaagtatctcacttctctcattcaaaacaatgtgattaatgcttataatgtgtgttttaaaagtgatgttgatatgtgcaggtatggcccaattttcaagaccaatctggtggggagaccagttattgtatcaacagatgctgatttgagttattttgtgtttaaccaagagggacgttgtttccagagttggtatccagacacttttacacacatctttgggaagaagaatgtgggttcattacatggtttcatgtacaagtaccttaaaaacatggttttgactctctttggccatgatggtctcaagaagatgcttcctcaagtagaaatgactgccaataagaggttggagctttggtcaaatcaagattcagtagaactcaaagatgcaaccgcaagcgtgagtttcccattcagaatatagacttttatatatgtttcagtctataatgttttattacttgtctaacatgttagtatgatcagatgatatttgatctcaccgcgaagaagttgatcagccatgatccagacaagtcatcagagaatctaagggcaaactttgttgctttcatacagggattgatctctttcccttttgatatcccaggcacagcttatcacaaatgtctacaggtgaatatcaacgttcatgcttcaaaagctttactcacattggtactaatgcttgaaacttgctttgcagggtagggcaaaggcaatgaaaatgttgaggaatatgcttcaagagaggcgtgagaaccctcggaagaatccaagtgatttctttgattatgttattgaagagattcagaaagaagggacaattctgacagaagagattgcactggatttgatgtttgtcttgctatttgccagctttgaaacaacttctttggctctaactttagctatcaagtttctctcagatgaccctgaagtcctaaagcgtttaacggttagtcagaagatacaagtagcaaacatgacaagttgtatggttattatcgaaaaagctaaactgatatgtgttcatcttcatcaggaagaacatgagacaattctgagaaaccgggaagatgcagactctggacttacatgggaagaatacaagtcaatgacttacacatttcaggttgctttaaagttttatcaaagtaagatatcttctttagtttcaaatacaaaatccagctgatcctaagtcttaaaattgttctataagcagttcataaacgaaaccgcgagactagcaaatatagttcctgcaatcttcagaaaggcgttgagagatataaaattcaaaggtatgatttaataaaggaacaatatataacattctcaatgattaagtgcctcttttaatctttatattatcataaagagtttgtcaatgatacagattatacgattccagccggctgggcggtgatggtctgtccaccagctgtacatttgaatcccgaaatgtataaagatcctttagtctttaatccatcaagatgggaggtgagtggtcaaacctaaataagtaacttttactccaagtaaagtaaaaataataataacaaaacaaatcaaacaatacatacagggatcaaaagttacaaacgcatcaaagcacttcatggcgtttggtggaggtatgaggttctgcgttggaaccgacttcacaaaattgcagatggctgcgtttcttcacagcttggtaacaaaatacaggtttgacataatcatctctcttaagtcattattctttcaactgtgtaagaacactaaggctgattttgattccggctcttgaaattatcaggtgggaggagataaaaggagggaatataactcgaacgcctggattacagtttccaaatggttaccatgtcaaactccataagaagagagactagggcgcgcc

SEQ ID NO: 262 - DNA, 1643 bp, Arabidopsis thaliana
ttaattaaatccgaagctaaaagaaaacactagaggaggtgaagatttttaaaaatgtcattcttatcattttctcctatttctctggacttattatctagtaatgtcttcttaaccattctagcgattatcatatccggtttacttaaaaccattacgtaccggaaacacaattcgaaccatttaaatctcccgcccggcccaccaggatggccggtgatcggaaacttatttcagttcacgcgctccgggaaacagtttttcgagtacgtcgaggatctcgtaaagatctacggtccgattcttactctcaggcttggtactcgaacaatgatcatcatctccgacgccagtctcgcccacgaagcgttaatcgaacgtggagcacaattcgcgacccgacccgttgaaactccgacccggaaaatcttcagctccagtgaaatcacagttcattccgctatgtatggacctgtgtggaggtcattgagacggaacatggttcagaacatgcttagctcgaatcggctcaaggagtttggttctgttagaaaatccgccatggataaactcatcgagagaatcaaatctgaagctagagacaacgatggactcgtctgggttctgcaaaacagcagatacgctgcgttttgtgttttattagatatctgttttggagttgagatggaagaggaatcaattgagaagatggatcagttgatgacggcgatattaaacgccgttgatccaaaactccacgattaccttccgatcttaacgccgtttaactacaatgagagaaatcgtgctcttaagcttcgtcgggaacttgtagatttcgtcgtcggattcatcgagaaacgacggaaggcgattcggaccgcaacggtatcgtctttctcgtatcttgatacactctttgatcttagaatcatcgaaggaagtgaaacgacgccgtctgatgaagatcttgtaacgctctgttcggagtttctcaatgccggtacggacacgactggggcggcgatcgagtggggaatcgcagagttgatagcgaatcccgagattcaatctcgactgtacgatgagattaaatcaacggttggagatcgtgcggtcgatgaaagagacgtggacaaaatggtcttgttacaagctgtagtcaaagagattctccggcgacatccaccgacttactttacattaagtcacggtgtaacggaaccaacgactctctctggctataacatccctgtcggggtcaacattgagttttatcttcccggaattagtgaagacccgaagatctggtcagagccaaaaaagttcgaccctgaccggttcttatcagggcgggaagacgccgatataacaggagttgctggagtgaagatgatgccttttggtgttggccgtaggatctgtccggggatgggaatggcgacggtacatgtgcatttgatgatagcgaggatggttcaagagttcgagtggttagcctatccaccgcagagcgagatggattttgccgggaagttggtgtttgcggttgtgatgaagaagccgttgagggccatggtgagacctagggtacaatgaaagccgcaggtttgtagcatatccaacttttaaaaaggcgcgcc

SEQ ID NO: 263 - DNA, 790 bp, Arabidopsis thaliana
ttgtttgttgattaacccttaattaaatgtcttcatccaacgcctgcgcctctccgtcaccgttccccgccgtcacgaagcttcatgtagactccgtcacgtttgtaccgtccgtcaagtcaccggcctcctccaatccattattcctcggcggcgccggtgtccgaggccttgatatccaaggtaaattcgtgatcttcaccgtcattggagtatacctagagggtaacgccgttccttctctatctgtcaagtggaagggaaaaactacggaggagctaacagaatctatcccgttcttccgtgaaatagtcaccggtgcgtttgagaagtttatcaaggtgacaatgaaactgccgttaacgggacaacaatattcggagaaagtgacggagaattgtgtggctatatggaaacaattagggctttatacggactgtgaagctaaagctgtggagaagttcttggagatcttcaaggaagaaacattccctcccggttcatcgatcctcttcgctctctcccctaccggctctcttacggttgcgttttcgaaagatgatagtatccctgaaaccgggatcgctgtgatcgagaacaaattgttggcggaggcggttctggaatctatcatcgggaagaacggtgtgtcacctggcactaggttaagtgttgcagaaagattatctcagctaatgatgaagaacaaggacgaaaaggaagttagtgatcactctgttgaggaaaaactagccaaagagaactgaggcgcgccaaaaattggagctct

SEQ ID NO: 264 - DNA, 1684 bp, Arabidopsis thaliana
ttaattaaatgacaaacatttggcttctgtcacttatcttcgtcatttgtattcttgtagccgtgttcaaccacaagaatcggaggaattatcaacggacaccaccgtctcctcctggctgtcctatcatcggaaacttgcatcaactcggagaattaccacatcaatctctatggaaactctccaaaaagtatggccctgtgatgcttttaaagcttggaagagtaccaacagtcatagtttcttcctctgaaacagcaaaacaagctttgaaaatccatgacctccattgttgtagtcgtccaggctttgcaggtactacaattttaactttggtttctctgttcaaacccttgaatcttgaatcttgaaatcttgaatctttttgtatcttgaatcattctttaggggcaagagagctctcttacaactatctagacattgctttttctccttatgatgattattggaaagaagtaaggaagctcgctgttcaagaacttttcagtagtaaacaagttcactctatacaaccgataaaggacgaggaggtcaagaaactgatcgattcaatctccgaatcagctgctcagaagactccgatcaacttgaacaagacattgctggctttaactgttagtgtggtctgcaggacagcgtttagtgtgaattttgagggaactgtgctcaacagtgaacgattcaataacatagtccgtgaggcgctcgagatgttgggaagcttttctgcctcagatttcattccgtatgtcggaaggatcatcgacttgttgacgggtttgcaaggacggcgagagagaagcatgagagatctcgatgctttctatgaacaaatgtttgatctgcataaacagaaaaaggaagaaggtagtgaagactttgtggacttgctgttgaggttggagaaagaagaagctgttcttggaaatgacaagctcactagaaaccatatcaaagcgatattgatggtaactaatcatatattcacaatcaaatctgtaagaaaaatttaaacaattgatgtttatatgttgttacaggatgttcttctagcaggaatggatacttctgcaataaccatgacatgggcaatggcagaactcgcaaagaatccacgagtgatgaaaaaagttcaatccgaaatcagaagtcaaatcaagaacaaagaaagaatcagctttgatgacactgataagcttgagtacctcaaaatggttatcaaagaaacatggaggttacatcctacaacacctcttctaatcccaagggaagcaatgtctgaatttgagatcaacggctacacgattccagttaagacacggcttcacgtgaatgtatgggctattggtcgtgatcccgatacctggaaagaccctgaagtgtttctcccggagaggtttacggataataatattgatgcaaaaggacagcattttgagctgttaccgtttggaggcggccggagaatgtgtcctgcagtttatatggggacaacaatggtcgagtttggtttggctaatcttttgtatcattttgattggaagttaccagaaggcatgaaggttgacgatattgacatggaagaagctcccggactcactgtcaacaagaaaaacgagcttatacttgtgccaacgaagtttctagatccttaaggcgcgcc

SEQ ID NO: 265 - DNA, 1990 bp, Arabidopsis thaliana
ttaattaaatgaacacttttacctcaaactcttcggatctcactaccactgcaaccgaaacatcgtcctttagcaccttgtatctcctctcaacacttcaagcttttgtggctataaccttagtgatgctactcaagaaattgatgacggatcccaacaaaaagaaaccgtatctgccaccgggtcccacaggatggccgatcattggaatgattccgacgatgctaaagagccggcccgttttccggtggctccacagcatcatgaagcagctcaatactgagatagcatgcgtgaagttaggaaacactcatgtgatcaccgtcacgtgccctaagatagcacgtgagatactcaagcaacaagacgctctcttcgcgtcgaggcctttaacttacgctcagaagatcctctctaacggctacaaaacctgcgtgatcactccctttggtgaccaattcaagaaaatgaggaaagttgtgatgacggaactcgtatgtccagcgagacacaggtggctccaccagaagagatcagaagaaaacgatcatttaaccgcttgggtatacaacatggttaagaactcgggctctgtcgatttccggttcatgactaggcattactgtggaaatgcaatcaagaagcttatgttcgggacgagaacgttctctaagaacactgcacctgacggtggacccaccgtagaagatgtagagcacatggaagcaatgtttgaagcattagggtttaccttcgctttttgcatctctgattatctgccgatgctcactggacttgatcttaacggtcacgagaagattatgagagaatcaagtgcgattatggacaagtatcatgacccaatcatcgacgagaggatcaagatgtggagagaaggaaagagaactcaaatcgaagattttcttgatattttcatctctatcaaagacgaacaaggcaacccattgcttaccgccgatgaaatcaaacccaccattaaggtatttatcacgttcctttcatataaggtttcgatcgtaaaaatatcaaaagaacaatttttgttaaattttatttgagaaagcatgcatatcaaatttatttacacatactaacattttgattcataaaacatttataaaagaagaaagaaacattttgtggtaaaagttgattagttacaatatttgttttttttttgctaaacatgggctacttttttgtttgtctcttttgattactttggtcaaagacagatgcatgcaacttaattgtatttatttttatgttatacaaaaattaaagatccaaaattaataaaagctggtatatatgtttataatgaataggagcttgtaatggcggcgccagacaatccatcaaacgccgtggaatgggccatggcggagatggtgaacaaaccggagattctccgtaaagcaatggaagagatcgacagagtcgtcgggaaagagagactcgttcaagaatccgacatcccaaaactaaactacgtcaaagctatcctccgcgaagctttccgtctccatcccgtcgccgccttcaacctcccccacgtggcactttctgacacaaccgtcgccggatatcacatccctaaaggaagtcaagtccttcttagccgatatgggctgggccgtaacccaaaagtttgggccgacccactttgctttaaaccggagagacatctcaacgaatgctccgaagttactttgaccgagaacgatctccggtttatctcgttcagtaccgggaaaagaggttgtgcggctccggcgctaggaacggcgttgaccacgatgatgctcgcgagacttcttcaaggtttcacttggaagctacctgagaatgagacacgtgtcgagctgatggagtctagtcacgatatgtttctggctaaaccgttggttatggtcggtgaccttagattgccggagcatctctacccgacggtgaagtgaggcgcgcc

SEQ ID NO: 266 - DNA, 2086 bp, Arabidopsis thaliana
ttaattaaatggcagcaatgatcactgttgactttcaaaatagcttcatcttcatcctcttttgtctcttctctctcatttgttactctctcttcttcaggaaaccaaaagattcacgagctggtcgtgatcttcctccgagccctccttcttttccggtaattggtcatctttattagggacaatgtcccacatcgaaagttgagtaggatcttaagtgatatatataagatatgggtctctccacctattgccaattggttttaggttggaagcccacagtctaatatggtatcagagcccgatccgcacatactcaatccgatccacatcggtccggcccaatacttggcccgccgatccatgcccaaacatatcgagatcaatggctagaagagccatcatctcgagggggcgtattagggacaatgtcccacatcgaaagttgagtaggatcttaagtgatatatataagatatgggtctctccacctattgccaattggttttaggttggaagcccacagtctaataatcttcaccttcttctctctgctcttgttcacaagtcttttcaaaaaatctcctacaagtatggacctctcctccatctccgtgtctttcatgttcccatagtcctagcctcctcggcctcagtggcctacgaaattttcaaggcccaagatgtgaatgtctcctctcgcggtcacgctccagccggggagtctctcttgtttggatcttctagcttcttcttcgctccctatggagattactttaaatttatgaggaagctcatagccacaaagcttcttggaccgcaggcactcgagcgttcaagaaaaatccgtgcagatgagctagatcggttttacagaaatctgcttgacaaggcgatgaagaaggagagtgtcgatatcgttgaggaagcagcgaagcttaataacaatatcatctgcaagatgatcatggggaggagttgttctgaggacaacggtgaggcggagagagtcagaggcttggtgattgagtctacggccttgacaaagcaaatcttcttgggtatgatctttgataaaccgcttaagaagcttgggatctcattgttccaaaaggatataaaaagtgtttcccgcttcgacgagctgctggagaagattcttgttgaacacgaagagagaatggggaagcattataaagctaatgacatgatggatttgttgttggaagcttatggagatgaaaatgcagagtataaaatcacaagaaaccatatcaagtccttgttcgtggtaaatgttcttcccttttaggtgtgattcgtatgtcatggaataaacatatgcgctgtgaaatgatggaataaacctaggccactcttagatatagaaaatatggaaatactctaataacagtttgctactacaggatcttgtcattgccggcactgacacctcggcgcaaacaatagagtggacaatggcggagcttattaacaaccctaacattcttgagagattgagagaagaaatagaatcggttgtagggaacacaaggttagttcaagaaaccgatctaccaaacctcccttacttgcaagcggtagtcaaagaagggctaaggttgcatccgccaggggctgtgttcttaagaacgttccaagaaaggtgtgaactcaaagggttctacataccggaaaagacattgcttgttgttaatgtttatgctataatgagagatcctaagctttgggaagatcctgaggagtttaaacctgagaggtttatagcatcttcaagatcagggcaagaggacgagataagagaggaagtcctgaaatacatgcctttctcaactggaaggagaggctgtcctggatccaatctagcttatgtctctgtaggaaccgcgattggagtaatggcgcaatgctttgattggagaatcaaaggagagaaagtaaacatgaacgaggctgctggaacattggtgttgactatggctcagcctcttatgtgcactcctggtcctcgaaccctaaaccctttaccttcaagtctgcatgtacccatttcttgaggcgcgcc

SEQ ID NO: 267 - DNA, 2190 bp, Arabidopsis thaliana
ttaattaaaaaaggaagagaaaggtcaaagatgttttactatgtgattgtccttcctttagctctctttctcttggcttacaaattattcttcacctccaaaacgaagcgtttcaacctccctccctctccaccttactctctcccaatcctaggccaccacaacctcctcaagccgccggtccaccgtctcttccaccgcctctccaaaacacacggcccaatcttctccctccaatttggctcccgccgtgccgtcgtaatctcctcctcctcactcgcaacacaatgcttcacaggccaaaacgacatcattctctcaaaccggccttgtttcctaaccgctaaatacgtcgcttacaactacacaaccgtaggaaccgcgccttatggcgaccactggcgtaacctccgccgcatttgctccctggaaatcctctcctcgaaccgtctcacaaacttcctccacatccgtaaagacgaaatccaccgcatgctcacgagactctcacgcgacgtcaacaaagagatcgagctcgagccgctcttgtccgatctaacgttcaacaacatagtaagaatggttacagggaagagatactacggcgacgaagtccataacgaagaagaggcaaatgttttcaagaaactcgtcgccgatatcaacgactgtagcggcgcgagacatcccggagattacttgcccttcatgaagatgttcggagggagctttgagaagaaagtgaaagctcttgcggaagccatggatgagatcttgcagcgtttgcttgaagaatgcaagagagataaagatggtaacactatggttaatcatttgctctctctgcaacaaaatgaaccagagtattacactgacgtcactatcaaaggcctaatgctggtaagatatacgagtttatgcaaattagtgttggtagtacatataagggatctagggctgttcaattagttaggttcattcagttttttttttggttttcagatcttctgtttttttggtcaacttcagatcttgtggttcacaaatatagaaaccggttgggttttaaaagttttataatttggatttgaagtttttcgcaaaatatatctttaattattttttatattaggtagttagctaggtacagctatgaaatgtaaaaccgaataggtctatttacttttattccatttaggggcatctattgatttgatttaagattagttttacagaattggtggtatctatagaccacaccataccggaattggtcttgaaaagttatttcttaggatttgggacccatgcggctgtctatagtacggacaataatttattcttaaaaagtagaaacaattctgactattcctagtttcctaattcctactatgtagaaactattctgacccattttttcaaaatcgatatatcaatatggtttcacatttatacggttctagtttaacaagatttgttaattatgcgtaaaacagggcatgatgatcgccggaacagacacttccgctgtgacgctggagtgggcgatgtcgagcttgctaaatcatcccgaggctttggaaaaagcaaaactagagattgacgagaaaatcggacaagaacgtttgatcgatgaaccagacatcgcaaacttgccttaccttcaaaacatagtgtcggaaacattccgattatatccagcggcaccgcttctagtaccaagatcaccaacagaggatattaaagtcggaggatacgatgtgccacgtggcacaatggtgatggttaatgcgtgggctatacacagagatccagagctctggaacgaaccggagaagtttaaaccagagaggtttaatggcggagaaggtggaggaagaggagaagacgttcataagctgatgccgtttgggaatggacggagatcgtgtcccggcgccggactagggcagaagatcgtgacattagcgttaggttcgttgatccaatgctttgactggcaaaaagtcaacggcgaagcaatcgatatgacggagactccggggatggcaatgcgtaagaaaatacctctatctgctttgtgtcaatctcggcccattatgagtaagcttcaggcccatttaaaaggttaggtttgttttcttcttaaagttctttttagttttctgttttctatgcatggggcgcgcc

SEQ ID NO: 268 - DNA, 912 bp, Arabidopsis thaliana
ttaattaactcaattctctccttcgaagcttttttcttgtgaggtcagaaaagaaaatgggaagtcaacaagtagcgatttcgtttctgacgaacttggcgaaggcggcgtttgggttaggtgtggcggcgacggcactaaactcgtcgctctacactgttgatggtggcgagagagctgttttgttcgatcgattcaggggagtgttggatcagaccgtcggcgaagggactcatttcttgatcccgtatctccagacgccgcacatatacgatattcgtacgaaacctcacactttctcctccaaatctggtactaaggatcttcagatggttaatctcacccttcgtgttctctttcgccccgaggtttcgcgtctcccgtacattttccaaacattgggtcttgaatacgatgagaaggttcttccatcgattggaaatgaggtcttgaaagctgtggttgctaatttcaatgctgatcagctcctcactgagcgtcctcaagtatcagcacttgttcgtgatgctcttatcaagcgtgccagggaatttaacattgagctcgacgacatagccattactcacttatcgtacggtgctgagttctcgagggcagtggaggcgaagcaagtggctcagcaggaagctgaaaggtcaaagtttgtggtgatgaaggctgatcaagagaggagagctgcggttataagagcagaaggtgagagtgaagctgctcagttgatatcagatgcaacagctaaagcaggaatgggactaattgagcttaggaggattgaagcttcaagggaggttgcggctactctggctaggtctccgaacgtggcttacttacctggtggacaaagcatgctctttaatctgaaccctggtcgttgagctataacggcgcgcc

SEQ ID NO: 269 - DNA, 1009 bp, Arabidopsis thaliana
ttaattaaatgggaggcaaaggtgtgatgatggtggcgatactttgcctttgggcactctctgcaacatctgaagcagtaacagaggctgagccaggtttgatgatgaacttctacaaggacacgtgtcctcaggccgaagacatcgtccgtgaacaagtcaaactcctctacaaacgccacaagaacaccgctttctcttggctccgtaacatcttccatgactgcgccgttgagtcatgtgatgcgtcgcttttgctggattcgacaagaagagagctaggagagaaagaacacgacaggagcttcggacttagaaactttaggtacatcgaggagatcaaggaagctctcgagagggagtgtcctggtgttgtctcatgttctgacattctcgtcttgtccgcaagagaaggcatcgaagcagtaggaggaccttatattcctttgaagacaggaaggagagatggacttaaaagcaggacggatatgctcgagtcatatcttcccgaccacaacgagagtatctccgtcgttcttgaaaagttcaaatccatcggtatcgacactcccggcctcgtcgccctcctagggtcacacagcgtgggaagaactcactgtgtcaagctggtccatcgtttgtaccctgaggtggacccgtccttaaacccggaccacgtccctcacatgctacacaagtgtcctgactcgatccctgacccaaaggcggtccagtacgtgcgtaacgaccgtggcacccccatggtgctagacaacaattactaccgtaacatcctagacaacaagggtttgctccttgtggaccatcagctcgcacacgacaaacgaaccagaccaatcgttaagaagatggctaaggaccaggcctacttcttcaaggagttcactagggcaatccagatcttatccgagaacaaccccttgactggctctaagggtgagatcaggaagcaatgtaatctcgcaaacaagaaccattgaggcgcgcc

SEQ ID NO: 270 - DNA, 1475 bp, Arabidopsis thaliana
ttaattaatatggacaaattgaagatagcagaatggggagagaagctgaagactggtggagctcagatgagcagaatggtgagtgagaaagtgaaagatatgcttcaagctccaaccttggaatccaaaatggtggatgaagctactttagagactttagaggagcctaattggggaatgaacatgaggatttgtgctcagattaacaacgatgagtttaacggcactgagattgttagagctatcaagaggaagatctcaggtaagagccctgtgagccaaaggctgagccttgagcttttagaggcttgtgctatgaattgcgagaaggttttctctgaagttgcttctgagaaagttcttgatgagatggtttggttaatcaagaacggagaagctgattccgagaacagaaagcgagcttttcagcttattagagcttggggacaatcccaagatcttacttatcttcctgttttccaccagacttatatggtaaatctctctgaatcttatttgcttattatgcaaagatggaattgttcatatgcctataatctccggcttgtcttttgtttcatagagcttggaaggcgaaaatggattacacgctcgaggtgaagagaattcaatgccgggacaaagttctctggagtctcttatgcaacggcctgttccagtgcctccacctggtagctatccggttcctaatcaagaacaggctcttggggacgatgatggtcttgactataactttgggaacttatcgataaaggataagaaagaacagattgagattacacggaacagcctcgaattgctctctagcatgttgaatactgaaggaaagccaaatcacacagaggtagttgctacgttgtctgctcatctaacttttgtcattttccttaacaaatgtctatggaatatggattgagttatgagtatctcctggtttacattattgtttccttggatatatgtgcttaaagtgaaattgacaggacagtgataagtaataggtttatatatattatggttacaggacgatctaacggttagcctgatggagaaatgcaagcaatcgcagccattgattcaaatgatcatagagagtacaacagacgacgagggagtcctgttcgaggctctgcatctgaatgatgagctccaacaagttttatctagttacaagaagcctgatgaaaccgaaaagaaagcctccattgtggaacaagaatcatcaggaagcaaagatactggtccgaaaccaacagaacaagaagaacaagagcctgtaaagaaaacgggtgctgatgatgacaaaaaacattcagaagcatcaggatcctccaacaaaaccgtcaaagaagagaagcaggccgtgaaaatagaactggggctttcgagtgatgaagatgaaaaataagcagtctgtgtttgttgtcttcttccgacatggatatcggcgcgcc

SEQ ID NO: 271 - DNA, 1865 bp, Arabidopsis thaliana
ttaattaaatatttacccaatcagggattcaggaagagaagcagagaaagaaatggagataacactgaacagtggcttcaagatgccgatcgtcggcttaggagtatggagaatggagaaggaagggattcgagaccttatcctcaatgccatcaagatcggctatcgccatctcgactgtgctggtattcacttgttctctcaaaaccttctctttctgatctttgttgcttctggtttgtctaaatatgtgatttgaatactgggtttgttttaactttttgatagttggaatctttcttggaaaatatgtctttaagatttgttttttttttcatagtctctataaacttgttatctaaagtaaatgctctctgtacatctttatttgcatctgattctgaagttctaagtatttggaatcatagaatgatctagattctattgctgtattgatgacagattgttctataatagcttttaacttgttacttattatagacagagttcagctttgttttaattctattgtgtgatttgcgttgttttaagtcttgattttggtgtgttcgttttccttggtgcagctgattataggaatgagaccgaagttggtgatgctcttacagaagcattcaagactggtctggttaagagggaggatctcttcattacaaccaaggtccaatcgaaaactatacagctatgatctcaatttaatgtgagcaagctctgatctgtgatctgaattggttttttgcagctatggaattcagaccatggccatgtcattgaggcctgcaaagacagtctcaagaaacttcaacttgattacctcgatctcttcctcgttcattttcccgtagcaacgaaacacaccggtgaggcctctgcctcattagcgttttattagtctagagtcagagaccattgcatttcgttttattacaagtcctcctttttcactgactgagatcaagttttcttaagtgtcttctatatatgctttgcaggagtagggacaaccgatagtgctttgggcgatgacggggtattggacatagacacgaccatctctctggaaactacatggcacgacatggaaaagcttgtttctatgggtttagtccgcagcattggaatcaggttcaacttctctcactatcattacaagttctcttgtttagtcgccaatatatgaattttttgaccattaggttttttgcagtaactatgatgtctttctaacgagagattgcttggcttactccaagatcaaacctgctgtgaatcagatcgagacacatccttacttccaacgtgattctcttgtcaaattctgccagaaacatggtatctgtgtcactgctcatactcctctcggaggtgccacagccaatgccgagtggtttggcaccgtgtcatgcctggatgatccagttctcaaagtaagccccatcctctaaaccttaaaagtttggattgaacctttgacaattaaaaaaggactgcgtttatctgaattcttaggatgtggccgagaagtacaaaaagacagtggcacaagttgtcctgaggtggggaatccagagaaaaacggtggtgataccaaagacatcaaagcctgcgagattggaagagaactttcaggttttcgacttcgaactatcgaaagaggacatggaagtgatcaaaagcatggagaggaaataccgcacgaaccaaccagccaagttttggaacattgatctctacgcttgatcacactctctctatctacatgaataaatgaagcttaagaagataaacaaggcgcgccaaaaattggagctctgcagagctttcgttcgtatcatcggtttgga

SEQ ID NO: 272 - DNA, 2245 bp, Arabidopsis thaliana
ttaattaaagatggagaaaaatcaacaaaagcaggaatttctagctgagacctcagagatgaagaacaccaaaaacaacgacgactgttctgtacaacaacaacaacgatttgtgtggccatgggttggtctagtagccaacataccaacggaggtggaaccatcgggtcggagagtaggcaaaagcggttcaacgttacgtgatgagttcactatgaaagggtttaatccaacaagagtccaacccatttgggatttcaagggtcattctggttttgctttggttgaattcgctaaagactttgaaggattcgaaagcgccatgaatttcgaaaggagttttaatttagaccgtcatgggaagagagattgggaaaaaggtaaaacattgtttcagagtttttaaagtcatttgctttcttgacattgatgagttcactttctttgtaaaaggtcatcgcttgagagacaataagctctatggatgggttgccagagaggatgattataatcgaagtgatactgttgggaagaacgtcaagaagaagagagatttgaaaagtatctctcagattgtggaggaagacgagaggaaaatggttcatcttgttgagaatatgtctcaaaccattgagaagaagaagcaaagtaaacaagagcttgaacagaaagttgatgagacttctcgtttcttggagagtttggaattgcataacgttctgttaaacaaaaactaccaagaaggtaaaatagaagcacttgaataagctttaaaaacataatctgttttgtgtttcatgctgacatgtatagtccttttggtttgtttgtgtgttattgtgatgagaagggtttcagaagatgcagatgaagatggaagagttgtatcaacaggttctggatggacatgaaaagtctttggcagaactggaggcaaagagggagaagcttgacgagcgtgcaagactgatcgagcaacgggctatcataaacgaagaagagatggaaaagtccagacttgaaagagaaatggtgattatgctttccttacaaagtaggagaaaaagatcacaaggcaataaaatctttgttgttgttgttgttgtagaatcaaaaggctatgtgtgagcagaatgaagcgaatgaggaagctatgaagcttgcagaaaagcaccaggcaagtagttcgttagtgtttctgtatatattcatgaacaagtaataactaagcttccatttccaacttttgagttcctgaactatgacaacttttgcagaaagagaaggagaagcttcataaaaggataatggaaatggaagctaagctaaatgaaacgcaagagctggagttggagatagagaagctgaaaggtactacaaatgtgatgaagcatatggtggggagtgatggagataaagatattgtggagaagatagccaaaactcagattcagcttgacgctcaagaaacggctctccatgaaaaaatgatgactctggcacgaaaagaacgtgcaaccaacgacgagtatcaagacgttcttaaagagatgattcaggttcgaaaacgttctaaatctatctgttccaaactctttggcttgtccttttaacttgtgtaattactttgatgaacaggtatggaacgccaatgaagagttgatgaagcaagagaagattagagtgaagagaatggggcaattaaaccctgcacccttcttgcctgcagtgatgaagaaacataaagttacacaatcaaaggcagagaataaggctatgaagctgtgttcagtgtgggaagcaaacataggagatgtgcaatggactccatttagagtcgatgagtctgatggaacaccaaaggttaggactttaatttaggagtctactttcaattctcaaaagatggggttttagcaaaaaaagacctctgcttttacatattatatcatccacattccaaatgtgaaatgcagagagttgtggatgaaaacgacgagaagcttcgtacgctgaagaaccagtacggtgaagaagtttataatgaagtggtaagaacaaaactagagattgaggaacataacgctagtggcagctatgtgattttagagctttggaactatgaggaaaaccgaaaggcgacgatggaggaagcaacagatgtgatgttgaagataaggtccaaacttgctgctatgaagaacaaacgaaagaggcttgaggtctaacttaaagaaagaggcgc

SEQ ID NO: 273 - DNA, 1674 bp, Arabidopsis thaliana
ttaattaaatgaagatgagaaccaaatcgattccggttaggtcttcgcgcaaatccctcgattcgcttctggtaaacctatttcttcccttcgtctctatttgcttctcggaacagtctcctttagaatcggaaaactagagcttgtaatttcctggtgcagctacatgactgattttggttttgattttgattcgtatgttataatcaaagcttgttttggattctgtgtgattgtggaggttgaattttaaatttggaactcgcgaaatagaaactgtaacggttgatgtatttgtgaatgatttctggtcatcctttcacaggatgatgaagctaatgaaaacacacaatgtgatgaaagagatgtgccacacaagaagcgtcgttgtcttgggactagtgagactactgatagaggaggatctgtagagccgctgctggacttggatgcttgtattgtatgtgaagtttcagacgagcgggtatctcgttgttgcggggttgactgtcttctttcgtttcacggcgagtgtttgtatgctgatttgggtagtactagtagtagtagtagtagtagtagtgaggatgtttcgaatccattttgtccttattgctggctcaagattgttgcactgaaatccaaaacattgagagaaaagaccgttgaggcggaaaaggcggtctgcaagtatctagataaagagatgaaaagcagggatgaggatataaccttatctggtgatgaaattggaaaccaagagcagagtacagacattgtaagtgatcatgagttacaaggagagaaggatggctgttcatcaaaaccagatgcggatcaagggaaagtgggtactggtaaagtgattgacgaagttggagcatcagagaaggtagctacagaaaaatttcaagacgctgaagatgatgaaacagctaaagatcaaggtacaagaatcctgaatacaggtgcagggaaaaagagagaggtttcttcgtttttgtctatgcaagaatcgttttcagcaaaagaacaggaccaggtccagcagaatgagaagcgaagaaggagaggattgaaaattatcgatagtgacatctcatcaaagggatcaagtaacgaacgaaatggagaagatgtaactgagcaggtaacttcatcggttcaagtaacctccccgtcagggagaatgaggaaccagcaggcaacaaccaaagttgtggctaagtcaaagacagtgaggttgttcctttttcttcactcactggaacatcaagagttcatttccacattaaatttagaaagttacctcacggatttgcagggacatttctttctttaagatggatcaaagaaggaggctactttggacgtacgaagaagaagagatgctaaaggtatataccaaacctacactagctgtattttcatgaattgaataagaattgttgttgatatatgtgttggttggttggttcaggtgggagtggagaaatttgcagcagaagcaaacaagaacatgccatggaggaaaattctggaaatgggagagaaggtgttccacgaaacacgtactccagctgatctcaaggacaaatggaggagcatggtcaagattatgaacaaaaacgaacaaggcagcacactaacccctactgctatgtaaggcgcgcc

SEQ ID NO: 274 - DNA, 1018 bp, Arabidopsis thaliana
ttaattaagcaaaatcacgatgaagcaagcttcttcttcttcgtcatgtaatccaacaagtttaacaaacagacttaaaacaatctttaagaaagcagaagagctttcgattctctgtgctattgacgtttgcgtcatctattacggaccagacggtgatctgagaacatggcctaaggatagagagacagtgaaaaatatggctttgaggtataaagaggacagaaaacgcaagaagtgcctcaatcttcatgagttcctcgagaaagagaaggtgaaggacaaagacaagtataaggggaagacgaattatgtgaagaaccctaattggtatccaaactttgatcattactctcctcaacaactctctcaattgattcagtccttagaacgaacactttctactctccaaaaaaggcttcgtattgttgagtcgcagaaaaaacagaacacaaacttggtgcatcagagtttaacaccatcgtatctgaaccagacacaacacttggatcctagcaagttctcgctgtatatgtacaaccatggagatgctactctctcacaactcccactgtctgcttcacaatccaatcaactcatcaattaccagatgcagcatggttttggtcagaacatgtgtttggacaacatcaccaacaacaacaactttcaacatcctggcgtgtcaaacacacaagactactcaccgttactttcggcgaataactacgggttgaataatcacttgatgcagcaacaggatcagcttcatggttttgatcagaacttgtgtatgatgagtgaaatcatcaataacaacaacggtttacaacatcctaatctctcaaacactgttccacatgaattcccttatggtaacactagcttctctcaagatatgttttcgagctatgatgggagcagtttgctacagacatcttctctgccacctctccacaacattcctaacagctattgtttttctgacaactcaagacttctctgctaacggcgcgcc

SEQ ID NO: 275 - DNA, 910 bp, Arabidopsis thaliana
ttaattaaatctctgaatctgcgtgacaaaagcaacaaattacatatctctctctctgcgcgacttcgaagatcaacatccatggcgtcacaggtaaggtcagtaaaagttggcaatctctcttcaggagcaactgagcatgatattaaagagtttttctctttctctggtgaagttgaaagcatcgatatccaaagcagtaacgagcatagtgcttatgtcacatttaaagaaactcaaggagcagagactgctgtgctcttatctggagcgagtattgccgatcaatcagtcatcattgagttggctcccaactacagtccaccagcagcccctcatgctgaaacacagagcagcggtgcagaatctgttgtccagaaggcagaagatgttgtgagcagcatgttagcaaagggtttcattcttgggaaagatgctgtcggcaaagcaaaagcttttgatgagaaacatggtttcacctcaaccgccaccgcaggagttgcttcactagaccaaaaaatcggtcttagccagaaacttacagctggaacaagcttggtgaacgaaaaaatcaaggcggtggaccaaaactttcaggtaacagagaggaccaagtctgtgtatgcagctgcggagcagactgtgagcagtgcaggaagcgctgtgatgaagaaccgttacgtgttaactggtgtgagctgggccgcaggagcattcaatagagtggctcaagcagctggagaggttggacagaaaacaaaagagaaggttgaagctgagcaaccatcgcaaccagcacagtcgcagcagcaactgccagaagggtattctccgattcattcgtccgaatactcgaagaactaatatcatcaagttaaacagtttcctttgtttctccttgtgggccgcc

SEQ ID NO: 276 - DNA, 913 bp, Arabidopsis thaliana
ttaattaagagaatggcagagcatttagcttcaatctttggtactgaaaaggatagagtgaattgtccgttttactttaagattggtgcttgtcgtcacggtgaccggtgctcacggcttcataaccgtcccaccatctcgccgacgcttctcctctcgaacatgtaccagagacctgacatgataactccaggtgtggatcctcagggacagccgttagacccgagtaagatccaagaccactttgaggatttctacgaagatattttcgaagaactcaacaagtttggtgaagtggagagtctcaatgtttgtgacaatcttgctgatcatatgattgggaatgtgtatgttctgtttaaggaggaggatcacgcagctgctgcgttgcaggctttgcaggggagattttattccggtcgtcctatcattgctgatttctctcctgtgacggattttagggaagctacttgtaggcagtatgaagaaaacagctgtaaccgtggtgggtactgtaatttcatgcatgtgaagcagatttcgagggagcttaggaggaaattgtttgggaggtatcgtcgttcataccgtcggggaagcagaagtcgaagcaggagtataagccctcgacgtaagagagagcattcgcgagagcgagagagaggggacgttagggaccgtgaccggcatggaaatgggaaaaggagcagtgatagatcagagaggcatgatcgggatggtggtggaaggaggagacatggaagcccgaaacggagcagaagcccacgaaatgtgagagaaggaagcgaggaaaggagggcgagaattgagcaatggaaccgagaacgtgatgagggagtttaagggtatcgtttgggctgattacttcataaaaatcggtaaaaggcgcgcc

SEQ ID NO: 277 - DNA, 2020 bp, Arabidopsis thaliana
ttaattaaatggactctgatggagtgtcagtaccgttgatccacgagcatcttatgatgccttgtaatgatttgaggagaggtgattgttgtgagcgtttggaagctatcagtgatggctactattgcacaacctgcgatttcttcgtccacaagaaatgtggtgacgaggcctctgaatgcattgaaaatccatttcattccaatcaccctcttcggcttggttttctttctcgtcttcagcgccaacattggcttaaagtagttcgcagttgtgatttatgtggaaagaacatcggggatctattctatcgttgtgagatctgtgacttcgacatggatttacactgtgccaagtatccaccactagaggttattgacattcccgagatgcatagccacaagctcaaccttctcaaagatcgggtcgagtttgattgtgatgctaaatgtgggaagattggttatgggtttccttacgaatgtcatgaatgtgattcaaagttccatgtggattgcgtaaggtactcctcatcggaggaagtaaaacatcctttagaggtaaaccactcttaccactccttgcaccctcttaagctcctcatgggtcaaccaccagactactctgatggaaaatgtcgtctttgcggaagaaagattgatgataaattgttttatcactgctcttcttgtaactttaccttggatatgcgttgtgttttaaatccaccaccaaaatctgttttggatttgaaaactcatgatcatcaactcaatcttctcccaaggctcattttttttacatgtaatgcttgcgggctgaatggagatcgaagcccttacgcatgttttcaatgtgatttcttgatccacaaagattgttttggtcttccacgcctcattaacatcaatcggcatgatcatcgtatttctagaacttctcttattggtattgtgaattctgtatgtggagtttgtcgccagaaggtggactggacttgtgggggttattcttgtcaacggtgttcgacctatatcgctcattcaaaatgtgctactagagaagatgtgtggaatgggaaggaacttgaaggagtacctgaagaaatagaagatatagagccatatgtggtaatagatgacaacacaatacaacatttcagccacaaagagcattacatgaggctcaatgttaatggccttatgtgtgaggtgaacaagcggtgcaatgcatgcaaccaccccatctctcctcaatccttctatggctgtatggattgcgatttcatcctccaccaaaattgcgctggatttcctagaaggaaatggcatgtgctacacaatgaacggcttgctttagtcactagcgaggttaatattttcgggtgtagtgcttgtcacaaaattttcaatggttttagatacgagcatgaggatacaaaattagatgtcctttgtggttcattttctgagccatttatccatccaagtcatcctcatcatccgttatattgcatttcacctgaggatgatgaagtatgcagtggctgtaacgagaggagctatcatgtgcttagatgcattgaagacaattgtgggtttatcttggattttggttgcgccacttttccacaagtggtaaagcatagaattgaagaccaacctctttctctatgctatggtgaaaaggcaagtggaaaatattggtgtgacatttgtgaaaaggaaaccaatccaaacacatggttctacacatgtaaagatcatcgggcaagtttgcatacatggtgtgtgcttggagactttatggggctcataccaaaaagcacaatagagctatggaacatatcatatgaagtggtgctcaataatagtatttctcgcccaatttgcaggcactgtaagtcgcattgcattccccctattatcttaaagaagattggaacctcagatccatacttttgttctctggactgcatagagagtttcaaaaggctttggcgagcaaagtgaggcgcgcc

SEQ ID NO: 278 - DNA, 1858 bp, Saccharomyces cerevisiae
ttaattaaattacacgtcgctcttaacaatccaggctgaacaaaactaggaataatgttacacaggcacggttctaagcagaagaacttcgagaatatcgctggaaaagttgtccacgaccttgcaggtctgcaattgctttctaacgacgttcaaaaatccgctgtccaaagtggtcatcaaggatcgaacaatatgagagatacttcgtctcagggcatggctaataagtattcagttccaaaaaagggactacctgctgatttgtcttaccaactgattcataatgaattaacacttgatggtaatccgcatttgaaccttgccagtttcgtgaacacttttaccactgatcaggcaaggaaattgattgatgaaaatttgaccaaaaatcttgctgacaatgatgaatatccgcaattaattgagctaactcagcgttgtatttctatgctagctcaattatggcacgctaatcccgatgaagaaccaataggctgtgccaccacaggttctagtgaggcaatcatgttgggtggactcgccatgaaaaaaagatgggaacacagaatgaagaatgctggtaaagatgcttccaagccgaacattataatgtcttctgcgtgccaagtggcattagagaagtttacgagatattttgaagtggaatgccgattggttccggtatcccacagaagccatcatatgcttgacccagagtcgttatgggattatgtagatgagaacactattggctgttttgtaattttaggaaccacctacactggccatttggaaaatgtagagaaagttgcagatgtcttgtcccaaattgaggccaagcatcctgattggagcaatactgatattccaatccatgcggatggcgcttcaggtgggtttattatcccatttggctttgaaaaagagcacatgaaagcttatggcatggaacgttgggggttcaaccatccgcgtgtggttagtatgaacactagtggtcataagtttggcttaaccactcccggtctgggttgggtgctatggagagatgaatccttactggctgatgaattgagattcaaactaaagtacctcggtggcgtggaagaaactttcggtttgaatttttcaagacctggatttcaagttgtccatcaatacttcaattttgtttctctaggccattcagggtatagaacacaattccaaaattctctatttgttgcaagagcgttttctttcgaattattgaattcgtcaaaattgcccggatgctttgaaattgttagcagtatccatgaaagcattgagaacgattccgcccctaagtcagttaaagactattgggaacacccccaggcttacaaaccaggtgtaccgctggtagccttcaaattgtccaagaaattccacgaagaatatccagaagtgccacaagcaatcctttcctctttactgagaggtaggggttggataataccaaattacccactaccaaaggcaacggatggatccgatgagaaggaggtattaagagtggttttcagatcggagatgaagttggatttagcacagttgttgatcgttgacatcgagagtatcttgacaaagttgattcatagttacgaaaaggtttgtcatcatatagaacttgcctctgagcaaactccagagcgcaagagttcgttcatctacgaaatgttgctggcattggcatctccacaagatgacatcccaacgccggatgaaatcgaaaagaaaaataagctaaaggaaacaacaacgagaaactatagaggaacatgttgagttgaagaggtcatccaatataccgccccctatatgtatgtaaaat

SEQ ID NO: 279 - DNA, 1811 bp, Glycine max
taacccttaattaagctgcaaaggttctctcttagcttagtaacaatgggtttgaaagcactttttgtttggtgcattatatggttaggtttagcacatttgtcccttggaggaagagtgaggcactacaagtttgatgtggagtacatgatcagaaagccagattgcttggaacacgttgtgatgggaatcaacggccagtttccaggcccaactattagggctgaagttggtgacattcttgacattgctctcaccaacaagcttttcactgagggaactgttattcactggcatggaatcagacaggttggaactccttgggctgatggaactgctgccatctcacagtgtgctataaacccaggagaggcttttcattacaggtttacagttgacaggcctggtacatatttctatcatggacaccatggtatgcaaagatcagctgggttgtatggttcattgatagtagatttgccaaagggacaaaacgaaccgtttcattacgatggtgaattcaaccttcttcttagtgatttgtggcacaccagttcacatgaacaggaagttggcctctcttccaaaccattcaaatggattggtgaacctcagactctactcatcaatggaaaaggacaattcaattgttcccttgcatctaaattcatcaacacaaccctaccccaatgccaacttaaaggtggtgaagaatgtgcccctcagattcttcatgtggagccaaacaagacctatagaatcaggattgccagcaccactgccctagcttcactcaacttagccatttcgaatcacaaacttgtagtggtggaagctgatggaaattacgtttcaccttttgcggttgatgatattgacatctattctggggaaagttattcagtgctccttcgcacagaccaagatccaaacaaaaattattggctatcaatcggggtgagaggaagaagggcacccaacaccccacaaggcctaaccattctaaactataagcccatttctgcctcaattttcccaatttctccaccacccatcactcccatttggaatgattttgagcgcagcaaagcgttcaccaagaaaatcattgcgaaaatggggaccccacaacctccaaaacgctctgatcgtacaattttcctcctcaacacccaaaatttgcttgatggattcaccaaatgggccattaacaatgtgtccctaacattgccgccaaccccttacttgggttccatcaaattcaaaataaataatgcctttgacaaaactcccccaccagttaccttcccacaagattatgacatcttcaaccctcctgtgaaccctaatacaactattggcaatggggtatacatgttcaaccttaacgaagttgttgatgttatcttgcagaatgcaaaccaattatctgggagtggtagtgagattcacccttggcacttgcatggacatgacttttgggttttggggtatggagaagggaaattcaaaccaagtgatgagaagaaattcaatttgacacatgcaccgttgaggaacactgctgtgatatttccatatggttggactgctttgaggtttaaggctgataacccaggagtttgggccttccattgtcacattgaaccccatttgcacatgggaatgggtgtgatttttgctgagggtgttcacaaagttggaaaaatcccaagagatgcactaacttgtgggcttactgggaataagctagtaggaaatagacactattgaaactagctagccacatatcaacatcaaaagatttaaat

SEQ ID NO: 280 - DNA, 1880 bp, Glycine max
ttaattaaataacacagaacacagtgcagacagcaagtgatgacgtcgaaacagacatacagcgtgtgcttctgctggcggcggcggttcaagctggcgctggcggaggcgccgtcggaaatcaagaccctattcaatgagtactccgagaatgagctcatgacaccttcgcatcttaagagattcctggtcgatgtgcagaggcaagagaaggccactgaagaagacgcgcaagccatcatcgatagcttcaggcatttccatcgcagaggcgctggcctcaatctcgaaactttcttcaagtacctcttcagtgacgataatcctcctcttcttccttctcatggggtgcaccatgatatgactttacccttgtcacattatttcatatatactggccataattcctatttaactgggaatcagctgagcagcgactgcagtgacgtccccatcataaatgcactgaagaaaggtgtgcgggtgattgaattagacatatggcctaatgcatcaaaggatagtatagatgttcttcatggaaggacattgactactcctgtagagcttatcagatgtttgaggtctattaaggatcatgcctttgtggcatcagaatatccagttgtaataaccctagaagaccaccttacaccagatcttcaggctaaagtggctgagatggttacccaaacatttggagacatactatttactcctaactcagaaagtgtgaaggaattcccttctcctgaatcacttaagaagagaattattatatcaaccaaaccacctaaggagtaccttgaggcaaaagaaaaggaaaaaggggatgattcacagcacgaaaaggagaaaggggatgattcagagcatggaaaggcatcaggtgaagatgaagcttgggggaaggaagtcccaagcttgaaaggtggtactatagaggattacaaggacaacaacgtggatgaagatcttaatgatgaggaagaatttgatgaatcagacaagtcacatcataatgaagctccagaatatagacacctaattgccattcatgctgggaagcctaaaggtggattagtggaatgcctcaaagtggatcctgaaaaagtgagacgtctaagtttaagtgagcaacagcttgaaaaggctgctataaattatggacaacaaattgtcaggtttactcagcggaatatactgagggtgtatccaaaaggtactcgcattgactcatcaaattataacccattaattgggtggatgcatggagctcagatggttgcatttaatatgcaggggtatgggagatctctttggttgatgcatggaatgttcagagccaatggagggtgcggttatgttaaaaaaccaaattttctattggagactggtccagatgacgaggtcttcaatcctaaagctaagttacctgtgaagactactttgaaggtgactgtatatatgggggaaggatggtactatgatttcaagcatacacactttgatcaatattcacctccagacttctacacaagagtggggattgctggagtccctaatgatactataatgaagagaactaaggcaatagaggataattggttacctacatggaatgaggcatttgagttccctctcactgttccggagttggccttgcttcgcgtagaagttcacgagtatgacatgtctgagaaagatgactttggtggacaaacatgcctacctatctgggagcttagaagtggcattcgagcaattccactgcatagccaaaagggagataaatacaacactgtaaagcttctcatgcgctttgagtttattaataattgattctgtgcaatgtgcatccttctgctccccatttaaat

SEQ ID NO: 281 - DNA, 1056 bp, Glycine max
ttaattaaattcagccacagaatatcaaagggagcgaagatgagtcaggagcagccaaggcgcccccaaggccaagaccccatcaaatacggcgacgtttttgacgtctacggtgaccttgcacagatgcccattgcaccggaagatgctgccatgatgcaaagcgcggaagctcgagtactcggaaaaacccaacccggcggagcttcttccgtcatgcaatccgccgccacaaggaatgaacaggctggtcttgtcggtcaccaggacgtcaccgacatcaccggcgaccatggcgtcacagtcacagaaactacattccatggaagacgcataataaccgaggctgttggtggccaggttatatttttttcctttttctattttatttttttttgttaaagatgatacatgaaccgatgaacatcactactttacaaatcattattttttttattatattgtatgatgtgcaatagagagtttaaatatccgtacaacacattaaactcaaaactcaaaacattaagcttcacttctactgctggatgttgttgtatatttgaaggtagtggaacagtatgtggagccaaatccagttgaggctggacgaaccagtgcaattaaggagagtgctataacaataggagaggcattggaggccacggcacagacggtgggtcacaagccggtggatcagagtgatgcctcagcgattcaggcggcggaggttagagcaacgggaagtaacgttataacgccgggaggacttgcggctatggctcaatcagctgctgcttataatgctgactgcaagcatgaccaggacaaggtcaagcttgccgacgttctgaccggagcaaccgccaaattgcccgcggacaaggccgcgacgctgcaagatgctgaaggggtggcgagtgctgaggccaggaacaaccccgatgccaccgccactcccggtggggtagccgcttctgttgcggctgctgctaggctcaatgaaaatgttaagtaaaaagtagtgttatgtatgttgataatcataatttaaat

SEQ ID NO: 282 - DNA, 923 bp, Glycine max
ttaattaaattgattgtggtgtggtgtgtgtcggtggcaatggaggcaagtttggtggagaggggtagagagagagctggacatgttaacaaggttggttatgttagaagggtcattgcaaagaagaagaaacagctttatcgaagggttaggagacctgagttgagtgtttcaaagacacttcaccaattatttgattcatgcagagaagctttcaaaggccctggcactgttccttcgccacaagatgttcagagattgactcacatacttgataacatgaagccagaagatgtggggctaagtagagatctgcagttcttcaagcctggaaatattgtcaaagagaaccaaagggtcacttatacaaccgtgtacaagtgtgacaatttctcactctgcatcttttttatacctgaaggaggagtcattcctctccacaaccacccggacatgactgttttcagcaagcttttattaggactaatgcacattaagtcctatgattgggttgaccctgaggcctctgatgataacatgttgcaaccacaatctcaattgagattggcaatgttaaaagttgataaggtgttcacatcttcatgtgacacttctgtgctgtatccaacaacaggaggcaacatccatgaattcacagccataaccccatgtgctgtgcttgatgtcattggccctccttattccaaagaagatggaagggactgttcctactacagagatcacccttatacttgttttcctaacgaaaggattattggtgaggcaaaagaggaaaatgatagttacacgtggctggaagaaattgagatgccagagaactctgaaatgaatggtgttgagtacctgggtccaacaccctcttagtgtatgtttgggaatcacttgaatccaactatttaaat

SEQ ID NO: 283 - DNA, 1133 bp, Glycine max
ttaattaaaagttacaggtattattaggggaatcgcgtggaagcgttgaggagagtgtttgatctgaggaaggaaaaaaatggtgggaggtggaaacaggagggaggaagggtcgttggtgttgaacaacacgaacgtgtttgcggcgctggatactctgaagaagaagaagaagtccgataaggagaagagcaagggttcgtcgacaaaatcgcaggcccagtccgcgaaggccgaggcccaagtgttttgggccccggcgccgctgaacgccaagtcttgggccgacgtcgacgacgaggacgacgacgattactacgccaccacggcgccgccccaatcggtgtggggcgtttccgaacctcatcacagtaaggaggacaaacatgggaattttgaggatagtgagagtgaggaagatattttggatgaaggggatgatgaggtggaggaagagcatgatcatgaacccgaagaatctttgaaacccgaacctgaggttaagaaggatgctgaagtccctttgccaccaccaaaagagacagaaaggcagctctctaaaaaggaaaggaagaagaaggaacttgcagagcttgaggctcttctagctgattttggagtggcaccaaaacaaagtaaagatggtcaagatgagtctcaaggtgctcaggataagacaggtgttgagactgatggagatggagaaaagaaagaaaatgtccctgcagaatccaaaacttccaagaagaagaaaaagaaggataaagcttccaaggaggtgaaagaatctcaagatcaacccaacagttctgacacaaacaatgggcccgatttggccacaggcaccgaaaatgtggaggaggatacatctactgttgatgtgaaagagcgtctcaagaaagttgcttctacaaagaagaagaagtctagtaaagaaatggatgctgctgcaagagctgctgctcaagaggctgctgcaaggagtgcaaggcttgctgctgcaaagaaaaaagagaagaaccattataaccagcaacccatccggtaaaagaaccctgctccttgacatcaatacaggaatttgtatttcttgttcatatgatgatgccaaataaacagtgggctatttaaat

SEQ ID NO: 284 - DNA, 1103 bp, Glycine max
ttaattaagattcccaattccgcctcttgttcagaaattgattctgtgtcgttacaggggaaaatttctctgcacgacatgtctgatgaacgagcagtgcatcctgattgccggaatgctagtaacccttatcatgaatgtagtgattactgttttagagtaatagctgaagccaaaattaggtcacaacaacaggaatcagaagttggacaagctagtggtggaaacaactctaagcaagccatcccagatgaatcctatgtggaaaaggaaatacacaatggcagacccgatcttgaagaaaactctgatagtgatcctgaccagcctgctgtgcaggaagcagagcaagaggttgactacacaaaactttctgcgagacagaaaaagtggatggagttgagatccaagatgcaagaagcaaaaaagcgtaatcaaattgaaatagctgctgagaaaaagaggatggaagctccgaccgagtctaggggtgtttctaaacagaagtggctcgaggataggaagaaaaagattggaaaacttcttgatgcaaatggattggatatgacaaaggcatatatgcttgacacacaggaggcagcagaagaaaaatacaagaaatgggagaaggatcctgctccatttgggtgggacgtctttaatcagaagacattatacaatgcatacaaaaagcggaccaagaatgttgaagtcgatgtagaagaatataatagaatgaaagaagctgatccagagttttaccgtgatgcttcaagtctccagtatggaaaggcaccaaaaatctcagaggagaagattgataggatggtacgggagctaaaggatagggatgagaagcgcaactcttttagcaggagaagacgcttccatgaagagaaagatattgactcaatcaatgaccgtaatgagcatttcaacaagaagattgagcgagcctttggtaaatacacgctggagattaaaaataatcttgagcgaggaactgcattgcctgactaaggtacttatgtagtgatgtgttttatttcacactgtcctgatagtgataagtttcagtggtggattgcactttttatttaaat

SEQ ID NO: 285 - DNA, 2214 bp, Arabidopsis thaliana
ttaattaatctctgatttagatccaaagatggatgggatgaagctttcgttcccaccggaaagtccaccactttcagtcatcgttgctctttctctctcagcttctccggtgacgattgattcttccgccgctgcaacaaccgtcccttcttttgtcttctccgacgggaggaaattgaatggagccaccgttcttcttcgctatgttggtcgatcagcgaaaaagcttcctgatttctatggcaacaatgcttttgattcttctcagattgatgagtgggtagattacgcatctgtcttctcttctggttcagagtttgagaatgcttgtggtcgtgttgataagtatctcgagagtagcacgtttcttgttggccattctctttccattgctgatgtcgctatttggtcagctcttgctggaactggtcaaagatgggaaagtttgaggaaatctaaaaagtatcagagtcttgttagatggttcaattcgatattagacgagtacagtgaggtgcttaacaaggttctagcaacttatgttaagaaaggatcagggaagcctgttgctgcacctaagtctaaagatagccaacaagctgtgaaaggagatggtcaggataaaggtaagcctgaagtggacttgccggaagcggagattggaaaggttaaactccggtttgctccagagccaagtggttatcttcacataggacatgctaaggctgcgttgctgaacaagtatttcgctgagcgttaccaaggggaagtgattgtgcgttttgatgatactaaccctgctaaagaaagcaatgagtttgtggataatcttgtgaaggatattgggaccttggggatcaagtatgagaaagtgacatacacttcggactattttcctgaattgatggatatggcggaaaaactgatgcgtgagggtaaggcatatgttgatgacacaccgagggagcagatgcagaaagagaggatggatgggattgattcgaaatgtaggaatcatagcgtcgaggagaatttgaagctatggaaggaaatgattgcaggaagtgagagaggattacagtgctgtgttcgtgggaaattcaacatgcaagatcccaacaaagccatgcgtgacccggtttattaccgatgcaatcctatgtctcaccaccgtatcggggataagtataagatatatccaacatatgactttgcttgcccgtttgttgattcccttgaaggtataacgcatgctcttcggtctagtgagtatcatgaccgaaatgctcagtactttaaagttctggaggatatgggactgcgacaggttcagctttacgaattcagccggttaaacctagtttttacacttctcagtaagcgcaagcttctctggtttgtccaaactggattggttgacgggtgggatgatccacgtttcccgacagtccaaggaattgttcgtagaggtttgaaaatcgaggctctgattcaattcattctcgagcagggggcttcgaagaatctaaatttgatggaatgggacaaactttggtctataaataagagaataattgatcctgtgtgccctagacacactgctgtggttgcagaacgtcgtgtactatttaccttaacggatggtcctgatgagccgtttgttcgcatgataccaaagcacaagaaattcgaaggtgctggagaaaaggcgaccactttcactaagagcatttggctcgaggaagctgatgcgagtgccatatccgttggtgaggaagtaactttgatggattggggaaatgctatcgtaaaggaaatcacaaaggacgaggagggtcgtgtcactgccttatctggtgtcttgaatctccaaggttctgtaaagactacaaagctgaagctgacatggcttcctgatactaatgaattggtcaatctcacattaacagagtttgattatctaatcaccaagaagaagctggaagatgatgatgaagttgctgattttgtgaatcctaacacaaagaaggaaacattggcacttggtgattcgaatatgaggaatctgaaatgtggagatgtgattcagcttgagaggaaaggctatttcagatgtgatgtgccttttgtcaaatcttcaaagcccattgtcttattctccattccagatggaagagccgctaagtgatcaatgaactatttttgagtttccca

SEQ ID NO: 286 - DNA, 1984 bp, Arabidopsis thaliana
tgtttgttgattaacccttaattaagatgagcagcaaaagggcatcacaatatcaccaagtagaaatccctccaccacaacctttcttgaaatcactaaagaacactctcaatgagatccttttcgccgacgatccgttccgtagaatcaggaacgaatcgaaaacgtcgaaaaagatcgagttagggttgagacacgtgttccctatcttggaatgggctcgtggttacagtttggagtatttgaaatcagatgttatctcagggataacaattgcaagtcttgctattcctcaagggattagctatgctcagctcgctaatctccctccaatccttggtctttactcgagcttggtgccgccgttggtatacgcgatcatgggaagttcaagagatttagcggtgggaacagtggcggtggcctcgctgttgacggctgcgatgttggggaaagaggtaaacgcagtggtgaatccaaagctttaccttcacttagctttcaccgccactttcttcgccggactcatgcaaacctgccttggcctcttacggttagggttcgtggtggagatattgtcgcacgcggcgattgtagggttcatgggaggagccgcaacagtggtgtgtctgcagcaactgaaaggattacttggcctccatcatttcactcattccaccgatatcgtcactgttctccgctccattttttctcaatctcatatgtggagatgggaaagtggagtgctagggtgttgcttcctaatcttccttcttacaactaaatacattagcaagaagagaccaaagctgttctggatatctgcaatgtctccacttgtttctgtcatttttggaaccattttcctttacttcctccatgaccaattccatggtatccaatttatcggagaactaaagaaagggataaatccaccgtcaatcacacatttggttttcacgccaccttatgtcatgttggctctcaaagttggcattatcactggagtcatagctctcgctgaaggtatagcagtggggagaagctttgcaatgtacaagaattacaatatagatgggaacaaagagatgatagcctttgggatgatgaacattcttggttccttctcctcttgctatctcactaccgggccattttcacgttcggcggtgaactacaacgcgggttgcaaaacggcgttatcaaacgtggtgatggcggttgcagtggcggtgacgttactgttcttaacgccgttattcttctacacgccattagtagttctgtcgtcgatcataatcgctgccatgctaggcctagtcgactacgaagcagccattcatctttggaaactcgacaagttcgatttcttcgtttgtctctctgcttacttgggcgttgtttttggtaccatcgaaattggtctcatcctctccgtgggaatatcagtgatgaggttagtgttgttcgtgggaagaccaaagatttatgtaatgggaaacattcaaaactcagaaatatataggaacattgagcattaccctcaagccatcactcgctcttctcttctcattctccacatcgatggtcctatttacttcgccaactctacctacttgcgagacagaattggaaggtggatcgatgaagaggaagataaattgagaactagcggagatatcagtctacaatatattgtactcgacatgagtgctgtggggaacatcgacacgagcggtataagcatgcttgaggaactcaacaaaatcctgggacgtagagagcttaagctagtgatagcgaacccgggagcagaggtgatgaagaagctaagcaagtccaccttcattgagagcattggtaaagaacggatttatctcacggtggcagaagccgtcgcagcttgcgatttcatgctccacacggctaaacccgactcgccggtaccggaatttaacaacgtttaaattaaattggagctctg

SEQ ID NO: 287 - DNA, 1817 bp, Arabidopsis thaliana
tcatttatttgtcagctttcaaactctttgtttcttgtttgttgattaacccttaattaagagaaaaagatgataacgggaaacgaattctacacggtgatgtgtgccatggcaccactctacttcgccatgttcgtggcttatggatcggtaaagtggtgcaagatcttcacgccggcgcaatgttccggaatcaaccgttttgtctccgttttcgccgtcccagtcctctctttccacttcatctcacaaaacaacccttacaaaatggacacaatgttcatcctcgccgacactttgtccaaaatcttcgtcttcgttttgctctctctatgggccgttttcttcaaagccggtggtctcgattggctcatcactctattctcaatcgctactctccctaacactctcgttatgggcatacctttgcttcaggccatgtatggagattacactcaaaccctcatggtccaactcgttgttcttcaatgcatcatttggtatactctgctactattcctctttgaactccgagcagcgaggttgcttatccgagcagagtttccgggtcaagcagccggatcaatcgccaagatccaagtcgacgatgacgtcatttccttagacggcatggatccgctccgtacagaaactgaaaccgatgttaacggtcggatcaggctcaggatccgacggtccgtatcatccgtacctgattctgttatgtcctcctccttgtgcttaacccctagagcctctaatctttctaacgccgagattttctccgtcaacactcctaataaccgtttcttccacggcggaggaggaagcggtacccttcagttttataacggtagtaacgagatcatgttttgtaacggagatttaggcgggttcggatttactcgacccggattaggtgcaagtcctagaaggctctcgggttatgcttcctccgatgcttactcgttgcagccaacaccacgtgcctcgaactttaacgagcttgacgttaacggaaacggtacgccggtttggatgaaatctcctgccgccgggagaatataccggcaatcttcgccgaagatgatgtgggagtctgggcaaagacatgcagccaaagatatcaatggatcagtgccagagaaggagattagcttcagagacgcacttaaggctgcaccacaggctacggcagccggtggtggtgcttccatggaggaaggagccgccggaaaagacacaactccggtggctgcgattggcaagcaagaaatgccaagtgcaattgtaatgatgcgcctcatactaacagtcgtgggccgcaagctttctcgaaaccctaacacttattccagcctcttaggtcttgtctggtcacttatatccttcaaatggaatataccgatgccaaatatagtggatttctcgataaagatcatttcagatgcaggtcttgggatggctatgtttagtttaggcctgtttatggcgctgcagccaaagatgatcccttgtggggcgaaaaaggcaacaatggggatgttgatcaggttcatctcaggtcctcttttcatggctggtgcttcccttcttgtcggattaagaggttctaggttacatgctgctatcgtacaggctgctctaccgcaagggatagtaccatttgtgtttgcgagggagtacaatttgcatccagacctactcagtacattggttatctttgggatgatagtatctttaccagtaactattttgtactacgtcctcttgggcctatgattcacaatttaaatacccagcaaattggagctctg

SEQ ID NO: 288 - DNA, 1710 bp, Arabidopsis thaliana
actctttgtttcttgtttgttgattaacccttaattaagatgaagcaaactgacggcagagaaaggaaagcttacctttctctgctatactttgcagtcattcttcttcccgtattccttctcggatgctatctgtacaacgagaagcagctgagggttggccagtttcaggaattcaatacacataacctgcaagaacacatcactccactacaacaaagcaaagaagataaagacaagaagactgatcttgttccattagaattctgtgatgttttcacaggaaaatgggttcttgataacgtcacacatcctttatacaaagaagatgaatgtgagtttctatcagagtgggtggcttgtacaagaaacgggaggccagactctaagtaccagaaatggagatggcaacctcaagattgctctttgccaaggtcagtcccagctttctgagaacaaaaataagcaaaatgaataacactttcttcttctctcaatattctttcttttttcgggttctaggttcgacagtaagctgctgctagagaaactcaggggaaagaaactaatgttcattggtgattcaatacattacaatcagtggcaatccatggtttgtatggttcaatccgtgattccctcaggcaaaaagaccttaaaacacacagcacaaatgtccatcttcaacatagaggtattaaagactatcttctatgcaaaaagacaataatccaagaagcaaaagaactccaaatcttaccttctctactattctgaatgtgtaggagtacaatgcaaccatatcattttactgggcacctttcctagtcgaatcaaatgctgatcctccagacaagagagacgggaagaccgatccagtaatcattcctaattcaatctcgaaacacggcgagaactggaaagacgcagactacctcatattcaacacctacatatggtggactagacattccacgatcaaagttctgtaagtgataaacgatctctctaccaagttccaaactttcaaatttgccaatcttgatgaagttttctactttgatgcatgaagaaaacaagaatctttcaacaaaggagactcaaaagagtacaatgaaatcggaatctatatagtatacaaacaagtgttatcaacatggacaaaatggctagaacaaaacatcaacccaagtcaaacatctatcttcttcagcagcatgtcaccaactcatatcaggtactaaatcatcaaacacccataaaaatcaaaactttacagagactgatccttttcagttgcaaacagaagttcagattggggattcaatgaaggaagcaaatgtgaaaaagagacagaaccaatactaaacatgtcaaaaccaataaatgttggaacaaatcgaagactttacgaaatcgcactgaatgcgaccaaatctacaaaagtgccgattcatttcctcaacataacgactatgtcagagtatagaaaagatgggcatacctcattttacggttcgataaatgggaaactcatgacgccggagcagaagttagatccgagaacttttgctgattgttatcattggtgtcttccgggattgcctgattcatggaacgagttgctctctctgtatatcatctacaaaatttaaatttaaatacccagcaaattggagctctgcagagctttcgttcgtatcatcggtt

SEQ ID NO: 289 - DNA, 1477 bp, Arabidopsis thaliana
tttcttgtttgttgattaacccttaattaagatgggggagattgtggttttaagtagtgatgatggtatggagactataaagaacagagtaaagtcatcggaagttgttcagtgggagaagtatttgcctaaaactgtacttagggttttgttagttgaatctgattactcaactcgtcaaatcatcactgcccttcttcgtaaatgctgttacaaagttgtagctgtttctgatggtttagctgcgtgggaggttctaaaggagaagtcacataacattgatcttatactaacagagctggatttgccatctatatctggttttgctctgcttgctttggtaatggagcatgaagcttgcaagaacattcctgtcataatgatgtcttctcaagattcgataaaaatggtgttgaagtgtatgctgagaggtgctgctgattatctaatcaaaccaatgaggaaaaacgagttgaaaaatctatggcaacatgtttggagaagactgactttgcgtgatgatcctactgctcatgcccaaagcttaccagcttcacagcacaaccttgaagatactgatgaaacttgtgaagattccagatatcattcagatcaaggaagtggtgctcaggctatcaattacaatggtcacaataagctgatggagaatggcaaatcagtggatgaaagagacgagtttaaggaaacttttgatgtgacaatggatttgattggtggaattgacaagcgtcctgatagtatttataaagacaagagtcgagatgagtgtgttggtcctgagcttggactttctctgaaaagatcttgctctgtaagttttgagaaccaagatgaaagcaagcatcaaaagcttagcctctctgatgcgtcggccttctcaagatttgaggaaagcaagtcagcagaaaaagccgtcgttgctttagaggagagtacttcaggtgagccaaagacaccaaccgaatcacatgaaaagttaagaaaagtaacatctgatcaaggaagcgccacaacgagcagcaaccaggagaatatcggatcatcaagcgtaagcttccgtaaccaagttcttcagtccacagtaacgaatcagaagcaagattcacccataccggtagaatcaaatcgcgagaaagcagctagcaaggaagtagaagctggttctcaaagcaccaatgaggggattgctggacaaagcagtagcacagagaaaccaaaggaagaagaaagtgcgaaacaacgttggagtagaagccagagagaagctgcattgatgaagttccggttgaagaggaaagatcgatgctttgacaaaaaggttcggtaccagagcaggaagaagctagcagaacaacgtcctcgagtgaaaggccagttcgtgcgaaccgtgaattcagacgcgtctacaaaatcatgaaaaattggagctctgcagagctttcgttcgtatcatcgg

SEQ ID NO: 290 - DNA, 1565 bp, Arabidopsis thaliana
ttaattaatttagggttacccaatcttcgccatgtatcgcacggcagcttcacgagccagggctcttaagggagttcttactcgtagtttgagaccagcgcgttatgctagttctagtgctgttgcggagacgagttcgtcaacgccggcttacttgagctggttgagtggtgggtctcgtgctgcgcttacttcattggatatgcctctacaaggtgtttctcttcctccgccgcttgctgataaagtcgagccgagcaaacttcagatcactactcttccaaatggtcttaagatagcctcagagacgactccgaatccggcagcttcgattggtttatatgttgattgcggttctatttatgaggcgccttatttccatggagctacacatttgcttgaaagaatggctttcaagagcacgttgaacagaactcattttcgtcttgtgagggaaattgaggctattggaggcaacacatccgcttctgcgtctcgagagcaaatgagttacactattgatgctcttaagacctatgtccctgaaatggttgaagttcttattgacagtgttagaaaccctgctttcttggactgggaagtgaatgaagagctacggaagatgaaggtagagatagcggaacttgcaaagaaccctatgggtttcctcttggaggccattcattctgctggttactctggtccattggcaagtcctctgtacgcaccggagtctgctttagatagattgaatggggagctcttggaagagtttatgactgagaatttcactgctgcacggatggtattggcggcaagtggagtagaacatgaggaacttttaaaagttgctgagccattaacttctgaccttcctaatgtaccaccccaattggctccaaaatctcagtatgtcggtggagattttcgccaacatactggtggagaggctacacactttgcggttgctttcgaggtgcctggctggaataacgagaaagaagcagtcaccgccactgttctccagatgcttatgggaggaggtggctcattctctgcgggaggtcctggaaaaggaatgcactcgtggctttatcgccgtgttctaaacgaatatcaggaggttcagtcatgcactgcattcactagcatctttaacgacaccgggttgtttggaatctatggttgctcgagtcctcaattcgctgcaaaagcaattgaattagcagctaaagaactcaaagatgttgcaggaggaaaagttaaccaggcacatcttgatcgtgccaaggcagccacaaaatctgcagttctgatgaatttggaatctcggatgattgcagcagaagacattggtagacagatacttacatacggagagaggaaaccagttgatcaattcttgaagtcagtagaccaactaaccttgaaagacattgcagacttcaccagcaaggttatttcaaagcctttgacaatgggttcctttggagatgtgttggctgttccgagctatgacacaataagcagcaaatttcgttgaagcaaaacaaacaatttgccaa

SEQ ID NO: 291 - DNA, 568 bp, Arabidopsis thaliana
ttaattaaatgaagaatccgatattgaagacatggagaaaagtgaagtcttttgggcatacgagctcttcgaccacaccctcgttcacgaagagcaagtcttgccatggctcttttcgtctcgaggatgctaagagcaacgaatcaaaaggaaagccgaagaaagagtcgccgtcacatggatttttcacggtttacgttggtcccacgaaacaaagaattgttgtgaagacaaaacttctgaaccatcctttgttcaagaacttgttagaagatgctgagactgagtatggatatagacgcgatggacccattgttcttccttgtgaggttgacttcttcttcaaggctttggcggatatgaagtctaatcctggtcatcatgatcatgatgatgattatgatgatgatgatggtttcacgaattccccgatttgcggatttgtctgtagtccctatagatcatacggtggtggtgttacggatcctctggccatgaaacggaacggctcatacaagcttcttcgatctccatctttgttcaagttgactagattttgaggcgcgcc

SEQ ID NO: 292 - DNA, 1278 bp, Arabidopsis thaliana
ttaattaattccaggtgtttccgacgtatatatttacatatggcgtcgttggctctgacttctcctccctccgttaagattccttcgtatctctcctcgtcgtcttcgtctctcttctcccgttcctcgatttctttcaggaccactgagtctcgctctcgaatctgcgtttctggttacgcgaaatgcaatttgcctaaggcactaaacgggaacgctcgtgttccaattattaatgagacgacaattcctaagttctttgattcttcacggttggagaaatcggttagtagaaacaatactaagctcaagttgttctctggtactgctaatccagctttatctcaggaaattgcttggtatatgggtctggagcttgggaaggttagcataaagagatttgctgatggagagatctatgttcagctcaaagaaagtgttagaggttgcgatgtctttttggtgcagcctacttgcactccaactaatgagaatctcatggagctattgatcatggtggatgcttgccgaagagcatcagctaagaaagtcacagctgtgattccgtattttggatacgcaagagctgatagaaagacacaagggcgtgaatctattgctgccaaattggtagcaaaccttataacagaagccggtgcagatagggttctggcttgtgatcttcattcaggacaatccatgggttattttgacataccagtggatcatgtctattgccagcctgtgatacttgattatcttgctagcaagtcaatttcctctgaggatttggtagtggtttctcctgatgttggtggagtagccagggcacgtgcatttgctaagaaattatctgatgcaccacttgccattgtcgataaaaggcgtcacggccacaatgtcgctgaggtcatgaacctaatcggtgatgttaaagggaaggtggcagtaatggtggatgatattattgatacagctggaaccattgtgaaaggagcagctcttttacacgaggagggtgcacgtgaggtttacgcttgctgtacacacgctgttttcagtcctcctgcgatagagcggttatcaagcggtttgctgcaagaagtgatagtgacgaatactttaccagtagcggagaagaattacttcccgcagttaacgatattatcggtggctaatcttctgggtgagaccatttggcgtgtccatgatgatagctccgttagtagtattttcctttgatacttgttggtttttgttaatcggtttaggcgcgcc

SEQ ID NO: 293 - DNA, 525 bp, Arabidopsis thaliana
atggcgtcgcatcctaaagttttcttcgacatgaccatcggcggtgcaccagcggggaagatcgtgatggagctttacaccgacaagacaccaaagacggcggagaatttcagagctctatgcaccggagagaaaggcgtcggacgtagcggaaagccacttcacttcaaaggatcttcgtttcaccgcgtgatcccaaatttcatgtgccaaggaggagatttcaccaaaggtaacggaactggtggcgaatcgatctacggagccaaatttgaggatgagaatttcgagaggaagcacacaggacctgggattttgtcgatggctaacgctggtgctaacactaatggatctcagtttttcatctgtacggtgaagactgattggcttgatggtaagcatgtggtgtttggtcaggtggttgaaggcttggacgttgttaaggctattgagaagatcggatcttcttctggaaagccgacgaagcctgttgtgatcgctgattgtggtgagatctcttcttag

SEQ ID NO: 294 - DNA, 1225 bp, Arabidopsis thaliana
ttaattaaatgatgcgttccgttgacgtctacgtgaaaactctaggccctcccgtccgttcaattctctactcgatctttacctctcagcaaaaaccttcgtcgctgccttcgcttccatttcacttttcgttgcgttcgtcgtcgaatattcccactcgttgtttctccaatgtcgttgcgaaatccaattctccgatttacgattttcaaggattccgaaatctcttcactgagagggctatctcttcgtctacgacgacccccgtcgcttctgctcagccgcagcagcttcagaatcagaatcagcatccagctgaggttgatgaagagatttctatgggcttagaggacgaagccaagctttctattcctgtgcgagcttatttcttctccactagcgttgatttgagaagcttaatagagcagaacaagcagaacttcatcccacctacttcgcgtatgactaactatgttgttcttaagtttggcaatcattctgatcccactgatactactcgaggacgcataagtgggagtgagtctatttacatggtagtatttcattatggatcgattgtcttgtttaatgtaagggaacatgaggttgatgaatatcttaaagtagtggagaggcatgcctctgggttgcttccagaaatgagaaaagatgaatatgaagtaagagagaatccaaatctggacacatggatggaggtaggacgggattttatcaggttgcagttcttgaatactgatgggatcagaaccataggatgtgttctgggccagagtattgctctggattactatggccggcaggttgatggtatggtagcagaatttactgagataaaccgtcagttggagataacaggaacgtttacaatgaaaaggaaaaagctgttccagttggttggaaaggctaatgtgattctggctgatgtgattctgaagcttggtctttttgagaggtcagatatagcttggaaggatgcgaaatatggtcagatatgggagtttctgagagatgaatttgaactgacacagagttttgcaaaccttgattataagctcaagtttgtagagcacaacgttcgtttccttcaagaaatacttcagaacaggaaatcagctactctggagtggctaatcattatcctgattagtatggagatcgcgatttctttctataatatgtctcgggcatccttgtgaggcgcgcc

SEQ ID NO: 295 - DNA, 883 bp, Arabidopsis thaliana
ttaattaaatggagatcaaagtcaaagcaaaagatgtagagtcgacaatgatgtcaactaaagaggaggatgagatcaagaagatgaaagagtgtgtggtgattcagaaggcagatgaggaggttactaaaggacaagaaactatgaagattttggatggttcaagacaaaaccaagatgaaacaagacaagctgattctaagaatattgactcaccatcatcatcatcacttgagatgaagaagaagttggaaattgaccaaaaatttacgagtcaaaacgaagaaaacaccaaaaaggaagaggagaagaagaaagagaccaacaataacaatctttctaacatgaagcataagaagacgagttcacacgtatgggactgtgggagcactctctacgactcgttcgagctcaactcgttcaaacgtcaactcgactcagccatctctgcttcctccgccagaactatgtccatgtctcacctccctgaccgccgtatcccttctctcagctcactttcgccggagtactctcctcctcttcctcctccaccgacaacttcttcttcctcctcctccggtggaaagaaacactcgaacaagatctctcgttctctacagagattcttgaagtcaatgttcaaacctaaacagcaccaaagcttaaccactccttcttcgccggtctacaaggcggtgggtcacggcggtggcgataaagatcgatactacgtcgtttacgacaaatcgggttcgttgacaactattccagagtcaacggagaaagaagtgagccccgagatcaactctcttgttaggaagaccgtgtccgagagattcccggcgagtagagtcgttggtatttcatgtgcatgaggcgcgcc

SEQ ID NO: 296 - DNA, 446 bp, Arabidopsis thaliana
ttaattaaattttggatcgaaacctgaaaagagcgaaaatggctggaagattgagcggtgttgcgtcacgaatcatgggtggaaacggcgtcgttgcccgatccgtcggttcttctctccgtcaacgcgccggaatgggtctccccgtcggcaaacacatcgtccccgataagccgctatcggtaaacgacgagctgatgtgggacaacgggactgcgtttccagagccttgcatagatcggattgctgataccgtcggaaagtatgaagcattggcatggttgagtggcggattagggttctttgttggtctcggtctgctcgctgttttgaacgacaaagcttctaaggttccatttacaccgagagtgtatccatatgacaacctgagagttgagcttggaggagagccatagagacccatctaagtgatctgctggcgcgcc

SEQ ID NO: 297 - DNA, 584 bp, Arabidopsis thaliana
ttaattaacaaacgcatacttccaatttcgccggcgaagatgcagcagaggaagccgacggcgggtagacccagtggtaccgatggatccgatttctcataccgcatggtcgttgactctcgttacacgaaggtcactaaagaaaaagctcgtctccgtcctttgatctttgttcaggctgcgatttatgtaatcggattatcgtgtgcgtttctaacaacaactaaaaaggatgagaagaacacccttgctattgcagctgctgttgctggcttagtgtgttcattgataggagaattaggttgcagacgtagcagagtaaaccttttgaggctctacacggctgcatcaaccattgttatggttctttctgtgttttgtgctgttaggagcagattaaccatggaggaacgcaatagctctggaacaaccgcgaagcttgagctcgcaggtttcatttgtgctcaattaggagcggtggtgcagatattagcgatcatcgttacagggtcccttgtcaataatatgtctccacctacgaaagcagcatagaggaacataaaatttgggcactgtggcgcgcc

SEQ ID NO: 298 - DNA, 691 bp, Arabidopsis thaliana
ttaattaaatggcggactctgttttgaaggaggttaactgtggccggcctgaaaagatcccgaagttggacaaagcttgcgaaggatcgaaatcgtcctggaaacatctcaagctaggaaacgtggaagatgatgagtatcttcgacagtattgtttgtttcactacgaattccataaatccgagggtttcacggttgattgggagaaatatgactacatgttccatataaggccgttggaaaattcaccacctatcagcgatatacgaaccaatgctgatgtgatccgtgatgtgacactctttgccattgagaaacacaatgaagctcatggatctaaacttgtgtttgtcgagcatgtctcagctaatttcaaatttgccaatggtctcctctgctggttaacattctgggctaccgatatggcctcatccgctcctacatcgcagatctatcaagtcgaactttggcgtcgcggaaaacagtttgaaattcccatcttcagggtcaagcctaaggacgaagagatggatgatgttgaagtgaaaccaccctctcccatgccttatgatgactatgataaaccaccggttgtctttgttcgagctgctcctgaagatggtgtccctttcgtctttgatcgaactggagctctttatgatctctatcggtctggtttgtaaggcgcgcc

SEQ ID NO: 299 - DNA, 625 bp, Arabidopsis thaliana
ttaattaactatctctccgtaaacagttgctcaaaaccttcttcctgaaatggcttcttctctcatcttcctcctcctcgttaccctaaccttttcagcatcaaccctaatctcagccaaatccaacacaacaacaataatcgaatcaacttgcaaaaccacaaactactacaaattctgcgtctcagctctcaaatccgacccaagaagtcccacagccgacacaaaaggtctcgcctccattatggtcggcgttggtatgacaaacgccacctccaccgcaaattacatcgctggaaacctatccgccaccgtaaaagacaccgttctcaaaaaggtcttacaagattgctccgagaagtatgctctcgccgctgattctctccggctgacgattcaagatcttgatgatgaagcttatgactatgcctccatgcatgtgttggcggcgcaggattatcctaatgtttgccggaatatttttaggcgggttaaagggttggcttatccggtggagattcgccggcgtgaagctagtctgagacgtatttgtggtgttgtctccgggattcttgatcgccttgttgaatgatttacatttgcattaactactttcgggcgcgcc

SEQ ID NO: 300 - DNA, 475 bp, Arabidopsis thaliana
ttaattaaagtcgttaggggaagcaaatagagaaatggctagctttactgcctccgcttccaccgtctccgccgctcgtccggctctccttctcaagcctaccgtcgccatctctgctcctgttcttggtttgcctccaatgggtaagaagaagggaggagtgagatgttcaatggagacaaagcaaggaaacgtctcagtcatgggggctggagtttcagctgcagcaacagctgctttgacggcggtgatgagcaatcccgcgatggctttggttgatgagaggatgtcaacagaaggaacaggattaccctttggtctaagcaacaacctcttgggttggattctgtttggagtctttggtttgatctggactttcttcttcgtctacacttcatctctcgaggaggatgaagaatctggtctttcactctgaaggaagaatcaatctttcgtcttctcatttcggcgcgcc

SEQ ID NO: 301 - DNA, 473 bp, Arabidopsis thaliana
ttaattaaatcccaaaacattacaaaacgttacaatggcttctaaggctcttgcagttacagctcttcttattacacttaatcttcttttcttcacctttgtaacctccacaaaatgtccaccaactactcctaaacccccaaaaaccccgaaatcgcctaagaaggctcctgccgtgaaacccacttgtcctaccgacacacttaagcttggtgtttgcgcagacttattgggcctagttaacgttgttgttggttctccaccaaagactccttgttgtacacttcttcaaggtcttgctaatcttgaagctgcggtttgtctctgcaccgctcttaaagccaatgtcttggggattaatctcaatgttcctattgatctaaccttgctgttgaactattgtggcaagaaagttcctcatggtttccaatgttcttgaagatttgagactttaaaagagaaaaaggcgcgcc

SEQ ID NO: 302 - DNA, 415 bp, Arabidopsis thaliana
ttaattaaatggcgggtcgcggcaaaactctcggatctggcgttgctaagaaatcaacatcgagaagcagcaaagccggtctccaattccccgttggtcgtatcgctcgttttctaaagaacggcaagtacgcaacacgtgttggtgccggagctccggtttacttagccgccgttctcgaatacctcgccgctgaggtattggaattggctggaaacgcagctagggataacaagaagactaggattgtgccacgtcacattcagctcgcggtgagaaacgatgaggagctgagtaaactgcttggagatgtgacgattgctaatggaggtgtgatgcctaacattcacagtcttcttcttcccaagaaagctggtgcttcaaaaccttccgctgatgaagattagggcgcgcc

SEQ ID NO: 303 - DNA, 860 bp, Arabidopsis thaliana
ttaattaaatgtctacttccggtgataaagccacctctagcaccaataaccctaacaactcctacgaggtaacctttcttttctctgttttctcccaagttttgtgttggaaactttaccgatttacttgagatcactaccggatgttcaggctatagttaatcttgattgaatcttttcgttaatcaaagagatttccattattagggtttaggtttgagtggttccgatgattgatccgggaatcctctaaggagaatttcaatatgaatttcatttacttgcagattactccaccagccaccgactctatttcgagcttaagttttagtccaaaggccgatatacttgtggcaacttcatgggattgtcaggttctctcttctttcttctttactctgctttaagaatttaacatgttcggtgtaatacaccaattcataatgcactcagatcaaatcttggctctgttgtgacactctgattgcaggtgagatgttgggaaataacccgtagtgacggctctatagccagtgaaccaaaggtatcaatgtctcatgatcagccggtaatatgcaactgctttctgagtttatgtgtcctcctgctttctctttgctcaaattctaatgaaagatttttcttgtggttaaggttttgtgttctgcttggaaagatgatggaaccacagtctttaccggaggatgtgataagcaggcaaaaatgtggccattgttgtctggtgctcaaccatctactgttgctatgcacgatgctcctttcaatcagatagcttggatccctggaatgaatctccttgttactggaagctgggataaaactttgaagtaaggcgcgcc

SEQ ID NO: 304 - DNA, 1426 bp, Arabidopsis thaliana
ttaattaaatgcctcgagtcatccctccggagaatctcggttgcccaccattccgtgctttaacttttgactctctcggcttaataaaagtgactgaagctcgtggtcaagagagagggattccgactgtagtgaacacatggggagagatgaatgcatctagaagtgttcttgctgcttccattgatgaccggttaaggaatccgcttttggctgttgcaagaaaagatggcaatgttgaggttattaacccttgtaatggtgatcttcacttctcatactctgtatttggtgatgatggttgttcccctgaggataacgaaatttctgccctgcacttattcaggaaaaagatagatgatcagacagaaagatcttgcacattgcttacatgtacgaaaaagggagatgtgagtctcagatcagttaaatttccagatgcacatggtaattccacggatgatgcttctcctaaaacatggaaagcatgtggttctggtgaaatattggttggtaaagtggatgggagcgaaaacttcagcttatttggagggaaacgggttgaggccaatatatgggatcttgaacaatgtacaaagatctggagcgcgaaatgccctcctaagaacaatcttggaatcttcacgcctacctggttcactagtgctacgttcttgagcaaggatgatcaccgtaaatttgtcacaggaaccaagtctcaccaggtccgtctttatgacatttctactcaacgtagaccggtcctgtcctttgatttccgtgagaccgctattacatcaattgcggaagacccagacggtcatactatctatgtcgggaatgcttctgctgacctagcttcctttgatatacgaacaggaaagctgttgggaagctttttaggaaaatgctctggaagcataagatctgtggttagacatccacagcatcaagtgatagcttcttgcgggctggaccgatatttacgtgtttatgacgttaagacacgccagctcatttctgcggttttcttgaagcagcatcttacaggtcttgtattcgactcgggcttttctggagaagcagagacagctgtagcaaacacagtggctgaggctgccacagaggagaagatgacgatcatggaccaggaagatgatgaaacagagaaggctcctgtgaaaagaaagaagtcaaagaaagagaaacgcagtagagaaatagtctttgagggtgaagacgatgaggagaatgaagacgagattgagaaggctccggtcaaaacaaaaaagtcaaagaaagagaaacgcagtagagaaaaagtctctgaaggtgaagagaaagacgagctaagaagcaagaagacacgagagcacaagaagaagaccaagatagtgaaacacaatcaagaagactagggcgcgcc

SEQ ID NO: 305 - DNA, 1598 bp, Arabidopsis thaliana
ttaattaaaaaacccactacgactgagtatggcgctcgaaatcgaagctcgagatgtaataaagattatgcttcagttctgcaaagaaaattccttgaatcagacattccagacattacaaagcgagtgtcaggtttccttgaatacagtagacagcgtcgagacgtttatttctgatattaatagtggaagatgggactcggtactacctcaagtttcccagcttaaacttcccaggaataaacttgaagacctttatgaacagattgtattggagatgatagaacttcgagagttggacactgcccgagctattttgagacaaactcaggtgatgggtgtcatgaagcaggagcaagcagaaagatatttgcggatggagcatcttctagtcagaagctattttgatccgcatgaggcttatggagactcaactaaagaaagaaaacgggcacagattgctcaagctgtggctgccgaggttaccgtggtaccaccttcacggttaatggctttgataggtcaggctttaaagtggcaacaacatcaaggcctgctccctccaggaacacagtttgacctctttcgtgggacggcagctatgaagcaagatgtagaagacacacatcctaatgttcttactcataccataaagtttggtaaaaagagtcatgcagaatgcgctagattctcaccagatggacagtttcttgcatcttcttctgtggatggttttatcgaggtatgggattacataagtggaaagctcaagaaggatttgcaatatcaagctgatgaatctttcatgatgcatgatgatcctgtcctctgcatagactttagcagagattcagagatgcttgcatctgggtcacaagatggaaagattaaaatctggcgtataaggactggtgtatgcatacgtcgttttgatgcacattcccaaggagttacaagtctttccttctctcgggatggaagccaattactgagtacctcctttgaccaaactgcaagaatccatggtttgaaatctgggaaattgttgaaagaatttcgtggtcacacatcttatgtaaatcatgccatctttacaagtgatggaagccgtattatcactgcctccagtgattgtacagtaaaggtctgggattctaagacgacagattgtctacaaacattcaagccgccacctccgttaaggggaactgatgcatcagtcaactctattcacttgttccccaaaaacacagaacacattgttgtgtgcaacaagacatcatctatatacattatgacactccaaggacaggttgtgaagagtttctcatccggtaatagggaaggaggagattttgtagcagcatgtgtatctacaaaaggagattggatatactgcatcggcgaagacaagaaactgtactgcttcaactatcaatctggtggacttgagcatttcatgatggtgcatgagaaggatgtgattggtataacacaccacccgcatagaaacctccttgctacctatagtgaagattgcactatgaagttatggaagccctgagttttctcatcatcaagtcttgttttggcgcgcc

SEQ ID NO: 306 - DNA, 1684 bp, Arabidopsis thaliana
ttaattaaatgagttccgatcaacggtggagattgctccgaccagcattcttcatcttcttcttcctcttctttcttcctcacaatctcacctttggtctctgtttcaacaccgaagcattggccttgatgaaattcaaagagagaatagagatagacccatttggagctctggttaattggggagagctttctcattgttcttggtctggtgttgtctgttcacatgatggaagagttgtcatcttaaatctaagagatctctccctacaaggaacacttgcacctgaactaggaaacctaactcatttgaaatctcttattctcagaaacaattcattttccgggaaagtacctgaagaggtaacagaattgcaggagcttgagatcttggatttgtgtgacaacaactttggccaaccatttcccttcgctcgcaggctgcttcagatatctccccctccttctcaaccttctcctccatcgcctatggaggaagtccccattgattttcctttcttctttgcccctcctccgcagaatataggtgcaagccctcctactgaaacccaagttatcccaaacccgtctccagttccccctccaccagctcagcctccaccagctcagactccaccacctcagctttctgaagtgcctcatgctgtcaacaaaaagaaatctcataagagtaagatgtacataatagtcggagtgctagtaggtgtattaggcgtcatggccgcattggtggccttcttttttctctggaaccaaaaggtaaaattgataaagccatggggggaaactgggagcagtggccagcttcaagatgttgttactacaggtgttcccaagctgaagctagcagaactagaaactgcctgtgaagatttcagtaacatcataggctccacatcctcagacgccaccatttacaaaggaactctctccaccggctctgaaattgccgttctagcagttgcatctggatccctccaagactggtcagaggatcacgaaacacagttccaagaaaagatacagaggttatctcaagtgaaccacaagaacttcctcaatgtaatcggatattgccatgaagacgaaccattcaaccgaatgctagttttcgaatacgctcctaatggatccctcttcgagcatctgcacgaccaagacgcagagcatttggactggccaatgagactgagaatcgtaatgggaatagcttactgtatggaacatatgcacaatctaaaccctaaacccatctctcacaccaacctcaactcttcttcagtctacttggcaacagattacgcagccaaagtctcagactttacgttcctcagctccacaccacttgaccccatgaccaacgtatccagctttggcgcccttctacaagagatcatcaccggaaagatcccggatccagattctctgctccaggaagaaaccaaacccgttgcagacccgactctgaaaagctttcaagaggaggtcatggagagagtgtgggaagtggttaaagagtgtttgagtcagaaggtggaaatgaaggaagtggtggttaagctgagagagatcaccggaataacgccggaagcagcgttgcctagtcggtctccggcgtggtgggcggagctggagattatatccaccgaaatgtagggcgcgcc

SEQ ID NO: 307 - DNA, 1474 bp, Arabidopsis thaliana
ttaattaaatggtaggaagaagaaaagctttactcttttctctctgtttcttcttcctctctcttccttccttctcttcccttccatccttccaaaccctattccccaattctcattcccttccttgtgcttctcccgtctcattccaacccgactccgactccgagtcactgctagaatccgaatttgaatccggatccgactccgagtcttcttcttccattactctaaacctcgaccacatcgatgctctctcctccaacaaaacacccgacgagctattcagctcccgtctccaacgtgactcccggcgcgtgaaatctatcgccacactcgccgctcaaatccccggaagaaacgtgactcacgcgccacgacccggtggattcagcagctcagtcgtctctggtctctctcaaggaagcggtgaatacttcacgcgcctcggtgtcggcactccggcgagatatgtttacatggtgctcgacaccggcagcgacatcgtctggctacaatgcgctccttgtcggagatgctactctcaatccgacccgatattcgacccgagaaaatccaagacctatgccacaatcccctgttcttcacctcactgccgccgattagactccgccggatgcaacacccgtcgtaagacttgtctctaccaagtctcttacggagatggttctttcaccgtcggcgatttctccaccgaaacgctaactttccggcgaaatcgcgttaaaggcgttgctctcggatgtggccacgacaacgaaggtctcttcgtcggagccgccggtttattaggactcggtaaaggtaaattatcgttccccggtcaaaccggtcaccggtttaatcagaaattctcttactgtttagtcgacagatccgcttcttcgaaaccttcctcggtcgtcttcggaaacgccgccgtatcacgaatcgcgagattcacgccacttttgtcaaacccaaaactcgacactttctactacgtcgggcttctgggaattagcgtcggagggacacgtgtccccggcgtaacggcttctctttttaaacttgaccagatcggtaacggtggagttattatcgattcgggtacgtctgtgacccggttgatccgaccagcttatattgctatgagagacgcgttccgggtcggagctaagacattgaaaagagctccggatttctcactcttcgacacgtgtttcgatctctccaatatgaacgaggttaaagtaccgacggtggttttacatttccgtggagctgacgtatcacttccggcgacgaattacctgatccctgtggataccaacggcaagttctgttttgcgtttgccggtacgatgggcggactatccataattgggaatatccagcaacagggtttccgggttgtatacgacttagcgagttcccgggtcgggtttgctccaggaggatgcgcttaaggcgcgcc

SEQ ID NO: 308 - DNA, 848 bp, Arabidopsis thaliana
ttaattaaaagagagaaatggctggagcagagcaaagccagagatggagccttaaggccaagaccgtacttgtaaccggtggaacaaaaggcatcgggcatgctatagtagaggaatttgcaggatttggagcagtaatacatacttgtgctagaaacgaatatgagcttaacgagtgtttaagcaaatggcaaaagaagggttttcaagtcactggttcggtctgtgacgcatctttgagaccagagagagaaaagctaatgcagactgtgtcttcaatgtttggtggaaagctcgatatcctcataaacaatttgggagcgattcggtcaaaaccaacgctggattacacagcagaagatttctcgtttcatatttcgacaaacttagaatctgcttatcatctgagccagcttgcgcatcctctgcttaaggcttcaggatgtgggaacataattttcatgtcctctattgctggagttgtatctgctagtgtcggctccatctactctgcaacgaaaggggcattgaatcagctagcaaggaacttggcatgtgagtgggctagtgatggcattagggctaatgctgtggctcctgcagtcatcgcaactcctttggctgaagctgtgtatgatgatgagttcaagaaagtggtgatatcaagaaagccgttggggcgtttcggggagcctgaagaagtgtcctcgcttgtggcttttctatgtatgcctgcagcttcttatataactggtcaaaccatttgtgtcgatggaggtctcactgtcaatggcttctcctatcagccacaaggttaaaatccaatatccaaaaacaaacggcgcgcc

SEQ ID NO: 309 - DNA, 569 bp, Arabidopsis thaliana
ttaattaaaaatggaccacgacaagacaggatgccaaagcccacctgaaggtcccaagctatgtactaacaactgcggtttctttggaagcgctgccacaatgaacatgtgttctaagtgtcacaaggatatgttgttccaacaggagcagggcgctaagtttgcatctgcagtgtctggaacatcgtcatccagcaacatcataaaggaaacctttaccgctgcgttggtcgatattgaaaccaaatccgttgagccgatgactgtttctgtacagccatcctctgtccaagtcgttgcagaggtagtagcaccagaagaagctgcgaaaccaaagggaccaagccgatgtactacttgcaataagcgggttggcctgactggattcaaatgtcgctgtgggagcctcttctgcggaacacaccgctatgcagacgtacatgactgctccttcaattaccatgctgctgcgcaagaggcgatagctaaggcaaacccggttgtgaaagcagagaagcttgacaaaatctgaaaatctaagtaacttctctggtttcatcaggcgcgcc

SEQ ID NO: 310 - DNA, 378 bp, Arabidopsis thaliana
ttaattaaccaaagaaaacatgaaaataatagtctccatcttagtgttagcctctcttcttctaatcagttcatctcttgcttcggctactatatcagatgcttttggtagtggcgcggtagctccggcaccgcagagcaaagatggaccggcgttagagaaatggtgtggacagaaatgtgaagggagatgcaaagaagcggggatgaaagatcggtgtttgaagtattgtgggatatgttgcaaagactgtcagtgtgttccttcaggcacttatgggaataagcatgaatgtgcttgctatcgtgacaagctcagtagcaaaggcactcctaaatgtccttgattctatttctatccaaccaaaaattggcgcgc

SEQ ID NO: 311 - DNA, 1454 bp, Arabidopsis thaliana
ttaattaaaataccggcgggtggaaccgacggcgatggcgaagaccggtgttttcgattcggatccgacggcgattgctaaagccaaggaactgaagcgtgagatgaagaagttgctgattaagatcgatgacgaagatgatttgggtgttcagacgattgatcagttacaggacgctttgtctgcgttgagagaagcgacgatgaggaagatggcgaaatcttcctcgttagagatgctcgagactgtgtcttgtcctgaggagtttcgttgtcctctctctaatgagcttatgagggatcccgtcgttttggcttctggtcagacatacgacaagttatttatccagaaatggttgagctcagggaacagaacatgtcccaagactcagcaagttctgcctcacacggctttaacacctaatctcttaatccgtgaaatgatctcgaaatggtgcaagaagaacgggcttgagacgaagagccaatatcatcccaaccttgtaaatgaagatgaaactgtgacaagatcagatcgtgagattttcaattccttgctctgtaaagtctcttcttcgaaccttcaagatcaaaaatcagctgccaaggagctaagacttctgaccaggaaaggcactgagttccgagctctttttggcgaatctccggatgagatcaccaggttggtgaatcccttgttacacgggtcaaacccagatgagaagcttcaagaagatgtggttacaacattgttgaacatatcaatacatgatgacagcaacaagaagctcgtctgcgaaaatcctaatgtgattcctctccttatcgatgcattgaggcgtggaacagtcgccacgagaagcaatgcagctgcagcgatcttcactctgtcagctctcgattcaaacaaagtacttatagggaagtccggaatcctgaaaccgcttatcgatctcctagaagaagggaatccattagctatcaaagacgtagctgcagcgatcttcactctttgtatagcccatgagaacaggagtagagctgtgagagacggagctgttagggttttaggtaagaaaatctcgaatgggttgtacgttgatgagcttttagctatattggcaatgcttgttactcactggaaggctgtggaggaattgggtgagctcggtggggtttcatggttgctgaagataactcgagagagcgagtgcaagcgaaacaaagagaatgcgatagtgatactgcatactatatgtttcagcgacaggacaaagtggaaggagatcaaagaagaggagaatgctcatggaacgataacaaagctttcgcgtgaaggaacttcaagggcgcagaggaaagcaaacgggatattggacagactgagaaaagctatgaatctcactcatacagcctgagaaaagccttgaaatctgcaatgtaaattggcgcgcc

SEQ ID NO: 312 - DNA, 1192 bp, Arabidopsis thaliana
ttaattaaatggttcagatttccgatcttccacgggatttgacagaggaggtgctctctaggattccggtgacatctatgagagcagtgagatttacttgcaaaaagtggaacaccttatcgaaagatcggagctttacaaagaagcacctgcgtggagcaagagcagcagcaaagaagaagcagacgaaggagtttcaggtgatcatgatgattcaatttagggtttatttatacagcgtcaacctccttaatccatcaatagagcgtataggtaaacttattagcctagacgttgaagatcatgtcgacatatctaaaatctttcactgcggcggtttattgttatgtatcaccaaagacatatctaggcttgtggtttggaacccttattctgggcaaacaaggtggatcaaacctagaaattcttaccacagattggacaggtacgctttaggatacgaagagaagaacaagtcgtgtcgttgctacaaaatcttgagatttatggatgattacgaggatgacagggcactgcgcctaattcgtgagtttgaaatctacgacttaaactctgattcatggaaggttgttaatgtcactcccgactgggatgtagagttttatcaccgtggcctgtctctcaaggggaatacttactggtttgctcaagagaagcttccaccattaccacgcggaagagtgataacaatatcagatatggctgatttcttactctgttttgattttacaagggagagatttggaccgcgcctgcctctgcctttccactcttttgttgaagatactgtgactctatccagtgttagagataagaaacttgcagtgttatttcagccatgtagtgcatctaccgtgaagatatggattagtcgcaagattgagcccaatgcagtgtcgtggaggaaggttttcttagcggttgatatgaaatcactcactggttttcagtttgacattaacgctgcaagtttctttgttgacgagaagaaaaaggtcgccatggttctggataaagacaggttcagttataaatttactcgcaacatagcttacatcattgggaagaaggggtacttcgaaaaagtggatcttggagaatctacagtttcaagttgtgcctcacttgtgtgctcttacgttccaagctcagtgcaaatctagggcgcgcc

SEQ ID NO: 313 - DNA, 1309 bp, Arabidopsis thaliana
ttaattaaatggccatggcaacaaggactctaggctttgttttgcctacgagcttatcttcccagccttccttcgaccgtcgcggcggtggatttagggtttctgtcatccgttgctccacttctccactcacttttcccacttctggtgttgtggagaaaccttggacttcgtacaatgctaggcttgtgttagaagatggttctatctggcctgctaagtcttttggtgctcctggaacccgtattgctgaattggtgtttaacacttccttgacagggtatcaagaaattttaactgatcctagttatgctgggcagtttgtgctaatgacaaacccacaaattggtaatactggtgtcaatcctgatgatgaagaatctgggcaatgctttcttactggtttggtgataagaaacctaagcattagtacctcaaactggagatgcacgaagacacttgctgattatctaaccgaaagggacatcatgggagtttatgatcttgacactcgagcaataacccgtcggttaagagaagatggtagtcttatcggggtgttgagcacagaacagtccaaaacagatgatgaacttctgcaaatgtctcgttcatgggatatcgtaggtattgatctaataagtgatgtttcatgtaaatctccctatgaatgggttgacaaaacaaacgctgaatgggatttcaacacgaattcacgagatgggaaatcctacaaagttattgcttacgattttggaatcaagcaaaacatcctaagacgcctttcatcttacggatgtcaaatcactgttgttccgtccacatttccagctgccgaggcgctgaaaatgaatccagatgggattttgttcagcaacggtcctggagacccttctgctgtgccatatgctgttgagacagttaaagagcttctcggtaaagtccctgtttacggaatctgtatgggccatcagttgcttggtcaagctttggggggtaaaaccttcaagatgaagtttggtcatcatggaggaaaccacccagttcgtaacaacagaactggtcaggtggagatcagtgctcagaatcacaactatgcggttgatccagcttcacttcccggaggcgtagaagtaacacatgtcaatctcaatgatggaagctgtgcgggtctatctttcccggaaatgaatgttatgtcactccagtaccaccctgaagcctcccctggacctcacgactctgataacgcatttagagagttcatagagcttatgaagagatcgaaacaaagctcctgaggcgcgcc

SEQ ID NO: 314 - DNA, 1264 bp, Arabidopsis thaliana
ttaattaaatgtctaagaagaagaaaggcagcaacaactttaagcttctctgtttcttcctgtttttgggtggtttggttcagacagatgcttcttttggagtaggaggcggcgttggagtaggaatcggcggcggcggcggtggcggtggcggtggtgtttgggttggcggtggatacaacaacggtggaaatcgtaatgctgttccaggatcatcagctccaaacagggtagcttacaatgctcttcaagtttggaaatcagccatgagagaggatccatcaaatgttctcaaaacatgggttggatcagatgtttgttcttacaaaggtgtgttctgttctggtcaatctataacctctatagatcttaaccatgcaaatctcaaaggcacacttgtcaaagacctagctttactctcagacctcaatattctccatctcaacagtaacagattctcagggcaaatcccagattctttcaaatctttagcttctcttcaagaacttgatctaagcaacaataaactctcaggtcctttccctttagtcacactctacataccaaatctggtttacctcgatctccggtttaatagtttaaccggtttcatccctgaagagcttttcaacaaacggttagacgcgattctcctcaataacaatcaattcgtcggagaaatcccaagaaacctcggaaattctccggcttcggttattaatctcgcgaataacagattttccggcgaaattccgacgagttttggtctgacgggatcgagggttaaggaagttttgcttttgaataaccagttaaccggttgtataccggaatctgttggtatgttctctgaaattgaagtctttgacgttagctacaatgcattgatgggtcatgttccagatacgatctcttgcttgtcggcgattgaaattttgaatcttgctcacaataaattctctggggaggttcctgatttggtttgttcgttgaggaatcttattaatctcactgttgcgttcaatttcttctctgggtttagctctgaatgttcttccagggttagtttcgggtttgatttcgttgggaattgtattcccgggaggaattcgcagcggccgcagccggattgttccggttattccggcggagctatgagctgttttaggattccgacgcagcctttggcttgtgctgcgataagtgttggattgagagagagtaataatcaatactacacttcatctcctccatgaggcgcgcc

SEQ ID NO: 315 - DNA, 1657 bp, Arabidopsis thaliana
ttaattaaccgcatctcacttctcattctctagaaaaaatggcttcgtcttgtctcttcaatgcctctgtatcgtccttaaaccctaaacaagaccccatccgccgccaccggtcaacctctctcctccgccaccgccccgtcgtcatctcctgtaccgccgatggcaacaacatcaaagccccgatcgagacagcggtcaagcctcctcaccgtaccgaggataacattcgagatgaggctcgtcgtaatcgttccaacgccgtgaatccattttcagctaaatacgttccgtttaatgcagctcctggatccacggagtcttactctctcgacgagatcgtgtaccgtagccgctccggtggtttgcttgatgtcgaacacgatatggaggctttgaagcgattcgatggcgcgtattggcgtgatctcttcgattcgcgtgttggtaaaagcacatggccttatggatcgggtgtttggtcgaagaaagagtgggttcttcctgagatcgatgacgacgacatcgtttcagcttttgaaggaaactcgaatctgttctgggcagagagatttggtaagcagtttctaggtatgaatgatctgtgggtgaaacactgtgggattagtcatacaggaagtttcaaggatcttggaatgactgttttggttagtcaagttaatcgtctgagaaagatgaaacgacctgtggttggtgtcggatgtgcttccaccggagatacttctgctgctctatctgcttactgcgcctccgctggaatcccatcgattgtgtttttaccggcgaacaagatctctatggctcagctggttcagccgatagctaatggtgcgtttgttttgagtattgacactgattttgatgggtgtatgaagctgattagagagataactgcggaattgccgatttatttggcgaattcgttgaatagtttgaggttagaagggcagaaaactgcagctattgagattttgcagcagtttgattggcaagttcctgattgggtgattgttcctggaggtaacctaggaaacatctatgccttttacaaagggtttaagatgtgtcaagaactgggacttgtcgataggatcccgaggatggtctgtgcacaagcagctaatgctaatcctctttacttgcactacaagtctggttggaaggacttcaagcccatgactgcaagtaccactttcgcctctgcgattcagatcggtgaccctgtctccatcgatagagctgtgtacgctctcaagaagtgcaatggtattgtagaagaagccacagaggaggagctgatggatgcgatggctcaagcggattcgacaggaatgtttatctgtcctcatacaggtgttgctctaactgctctgttcaagctgaggaatcaaggagtgattgcaccgactgatcgaactgtggtagtgagtactgctcatgggttgaagtttactcagtctaagatagattatcactccaatgccatccctgacatggcttgcagattctccaatcctcctgttgatgtgaaagcagatttcggagctgtcatggatgttctcaagagttacttaggaagtaatacacttacgtcataagagacaagaccataatctttagctgttttgggcgcgcc

SEQ ID NO: 316 - DNA, 907 bp, Arabidopsis thaliana
ttaattaagatctaaggagctaaagctattatgtcaacgaacactgaatcttcttcttattcttctcttcctagtcaaaggcttttgggtaaagtggcattgatcactggaggagccacagggataggtgagagcattgttcgtctgttccacaagcacggtgccaaagtctgcattgttgatctgcaagatgatctcggaggtgaggtgtgtaaaagtctgcttcgtggtgagtccaaggagacggcttttttcatccatggcgatgttagagtggaagatgacattagcaatgcggttgactttgcagtcaaaaattttgggacgcttgatatacttatcaacaatgcaggattatgtggagcaccgtgccctgatattcgtaattatagtttgagtgagttcgagatgacctttgatgtgaatgtgaaaggagcttttctaagcatgaaacatgcagctcgtgtaatgataccggagaagaaagggtcgatagtttccttatgtagtgtgggaggtgttgtgggaggcgttggtccacattcttatgttggttccaagcatgctgttctaggcttgactaggagtgttgcagcggagcttggacagcacgggatacgtgtgaactgtgtttcgccttacgcggttgcaactaaactcgctttggctcatttgccggaggaagaaagaacggaggatgcatttgttggtttcaggaattttgctgctgcaaacgcgaatctaaaaggggtggaactgacggttgatgatgtagcgaacgctgttctgtttttggctagcgatgactcgcggtacataagcggagataatttgatgattgatggaggattcacttgcactaaccactcctttaaagtcttcagatgatgcattttgctggcgcgcc

SEQ ID NO: 317 - DNA, 465 bp, Arabidopsis thaliana
ttaattaaatggactctccgttcaaacctgatgtcgtcagaggtcaagtggctctcatcaccggtggtggatccggtatcggttttgagatctcttctcagtttggcaaacatggagcttctatcgctatcatgggacgacgaaaacaagtcctcgatgacgccgtctctgctcttcgatctcttggaatccaggtaatcagcgatttttgttttgaggactttgtttgttggatatgtgtttgaatctgtctgatttctgtttcgtttgaaggctattggattggaaggtgatgttcgtaagcaagaagatgcgagaagagttgtggaagcaacttttcagcattttggtaaacttgatattcttgttaacgccgctgctggcaattttctggctgctgctgaggatttgtctcctaatggcttcagaacaggttcctttttcgttttctcattaaggcgcgcc

SEQ ID NO: 318 - DNA, 1111 bp, Arabidopsis thaliana
ttaattaaatgaagaagaagaaggaaggtttgggatggatagagtcaattaaaggatggagttgtgtgttccacgagtttctcttccagagattcatggcttctcatctacagaatccacttcctctaccttcactgaatcacctcacctgcattgtcactggctccactagtggcattggtcgcgaaaccgctaggcagcttgcagaagctggtgctcgtgttgttatggcggtgaggaatactaaagcagctcatgagctgattcagcaatggcagaaggagtggtctggtaaaggcatccctcttaatctcgaggctatggaacttgatcttctctctctggattctgtcgtcggattttgcaatctgtggaacgcgcgattatcccctttgcatgttctgattaacaatgccggcatattttccatgggagaggaacagaagttctcaaaggatggatatgagcaacacatgcaagtgaaccatttagctccagctctgctttcactactccttttgccctcacttatccgaggctccccaagcaggatcattaatgtgaattctgttatgcactatgttggtttcgttgacccggatgacatgaatgttgtttctgggaaacgaaagtttacaagcctcgttggatattctggcagcaagcttgcacaggttatgtttagcaatgtacttttgaaaaggctgcctctagaaactcgcattagcgttgtttgtttatcccccgggattgtcctaacaaatgttgcgagagatctgccgagatatgttcaagttcaatacgcgttgataccttatttcatcttttcgcctcaagaaggctctagaagcacacttttctcagctacagacgctcagattccagagcattgtgaaaagctaaaaaccgaagataagcccgtttgtacattcatatctcaaaattgcaagcacacaaagccttcagaagaagcacacaacgtagaaacagcagaaagagtatgggaaaagacgataaagctgatcggtcttcctcttgatgctgtagagaggcttatagaaggagaagaggtccaatgccggtatgggactcatcaacaataaggcgcgcc

SEQ ID NO: 319 - DNA, 1063 bp, Arabidopsis thaliana
  misc_feature (851)..(851): n is a, c, g, or t
ttaattaaatggctacttggagtggtttcaacgtctcttcttctccgttgcttaggcttcggtcttcctccgtctcaaatgtcactaagcttccgtttctctctcctatttgccggcgtcggttactggcagaacgctttggtctcgcaactgtcgttgttacgcgccaaaacctcacggttactccgtcgtctgcggcggtggaagctcgtatctcagggaaaagagaacctatgacgcctccgtataacatattgatcactggctcaaccaaaggtataggatatgcattagctagagagtttctgaaagcaggcgacaatgttgtgatttgctctagatcagctgaacgagttgagactgctgttcagagtcttaaggaagaatttggggagcatgtgtggggaactaagtgtgatgttacggaagggaaggatgtgagggaacttgtagcttatagtcagaagaatcttaaatacattgacatttggataaataatgcgggatctaatgcatatagctttaaacctttggcagaggcctcagatgaggatcttattgaagttgtgaaaaccaacactctaggtctcatgttatgttgccgagaggcaatgaatatgatgttgacccaatctcgaggtggtcatatcttcaatattgatggagctggttcagatgggagaccaacacccagatttgctgcatatggtgcaactaaacggagtgtcgttcacctgacaaagtcattacaggcagagttgcagatgcaagatgtcaaaaatgtcgtggtgcataatctatcgcctggaatggtcacaactgatctgctcatgtccggagcaactacaaancaagccaagttcttcattaatgttttggcagagccagccgaagtggtggctgagtaccttgtcccaaacataagggcaataccggctagcggatctatgaagccgacttacatccgtttcctaactggaatcaaagcctacaccaaaatattctcaagagttgcgttgggagcaaggaagaacaggtatgttactgaagagtagggcgcgcc

SEQ ID NO: 320 - DNA, 1842 bp, Arabidopsis thaliana
ttaattaattatattatgcttggacagtgccatgatgggcatctgtgagatgaaaagctgctgctcatggcttcttttgatctcgttgctttgctcactatctaatgaaagtcaagcgattagtcctgacggcgaggcgcttctgagcttcagaaatgcagttactagatcagatagtttcatccatcagtggagaccggaagatccagatccatgtaactggaacggagtgacatgtgatgcaaaaacgaaaagagttataaccttgaatcttacttatcacaaaataatgggacctttacctcctgatattggaaagttggaccatttaaggcttttaatgcttcacaacaatgctttatatggagcaatacctacagcattgggaaattgcacagcattggaggaaattcacttgcagagtaactacttcactggaccaatcccagctgaaatgggagacctgcctggccttcaaaagctggacatgtcaagcaacactctcagtggacctatccctgcttcgcttgggcagttaaaaaagcttagtaacttcaatgtctcgaacaacttcctggtggggcaaataccttcagacggagtgctctctggattttctaagaactccttcattggaaatcttaacttgtgtggaaagcatgttgatgtcgtgtgccaagatgatagtggaaacccttcatcacattctcaatcaggtcaaaatcaaaagaaaaactctggtaagctgctgattagcgcatcagcaactgtaggtgcgctactcctagttgcactcatgtgtttctggggatgctttctatataaaaagctcggtaaagtcgagattaaaagccttgcaaaggatgttggtggaggtgcgtctattgtgatgttccacggagatttaccttactcttccaaagatatcattaagaagctggaaatgttgaatgaagagcacataattggatgtggaggctttggaacggtgtataagctggccatggatgatggcaaagtctttgcattgaagagaattctaaagttaaacgaagggtttgatcggttttttgagcgggagcttgagattcttgggagcatcaaacaccgatacctcgtgaatctacgtggatattgcaattcaccaacatcaaagctactgttatatgattacttgcccggtggtagccttgatgaagcacttcatgagagaggcgagcaattggactgggattcacgcgtaaatatcatcataggagctgcgaaagggttatcatatttgcatcatgattgttctcctcggattatacatcgtgatataaagtcgagcaacattttgcttgatggcaatctcgaggcacgggtatcggattttggtctagccaagttgttggaagacgaagaatctcatatcacaaccattgttgcaggcacatttgggtacctagctccagaatatatgcaaagtggtagagcaactgagaaaaccgatgtatacagttttggggttttggttcttgaagtcttgagtgggaaaagaccaaccgatgcttccttcatcgagaaaggccttaacgttgttggttggctaaagttcttaatcagcgaaaaacggccaagggatattgttgatccaaactgtgaaggaatgcagatggagagccttgacgctctactatcaatagcaacacagtgtgtgtctccgagtccagaagagcgtccaacgatgcatcgggttgtccagttacttgaatcagaggtcatgactccttgtcccagcgaattttatgattccagctctgattaattgcataaacccaccagtcgaaacctcggcgcgcc

SEQ ID NO: 321 - DNA, 1692 bp, Arabidopsis thaliana
atggagagtttcgctcttcactctctctccaccaccgccacttccaccttactctcccatcatcatcatcaccatccctcacgtctctctcttctccgtcgtacctcttcgagatctccgccttcaacaatctccctccgatctctctccgttcaacctctctccttccctcttctcaaaccaattcctcgattctccacacgaatcgccgccgcaccgcaagacaacgctcctcctcctcctcccccatctccgtctccgtctccgtctcctcaaggagcgaaactcatccctctgattctctcaatctccgtcggcctaatcctccgattcgctgttcctgtaccagaaggagtcacaccacaaggctggcaattactctcaatcttcctctcaacaatcgctggtctcgtccttagtcctctcccagtcggagcttgggctttcattggtctcaccgcttcaatcgtcaccaaaacgctttctttctccgccgctttctcagctttcacaagcgaggttatctggttgatcgttatctctttcttcttcgctcgtggattcgtcaaaacaggtcttggtgatagaatcgctacttactttgtcaaatggcttgggaagagtactttaggtctatcttatggtctcacgcttagtgaggctttaattgctcctgcgatgcctagtactactgctagagctggtggcattttcttgcccatcatcaagtctctatcgctctcggctggaagtaaaccgaatgattcttcttcgaggaaactaggctcttacttgattcaatctcaattccagtgcgccggaaactctagtgcgcttttcttgactgctgcagctcaaaatttgctgtgtctcaagttagcagaggagcttggagtagtgatctcaaacccgtgggtttcttggtttaaggctgctagtctacctgcaatcatatcacttctttgtactccacttatcctctataagctttatcctccagaaacaaaggacacacctgaggctccaggtattgctgcaacgaaactcaagcaaatgggccctgtcactaaaaacgaatggatcatggtcggtacaatgcttcttgctgtcactctttggatctgcggagagactctgggaataccaagtgttgtagctgccatgatcggtctctccatacttcttgtgctaggtgtccttaattgggacgattgcctaagcgaaaaatcggcatgggacacattagcttggtttgctgtcttggtgggaatggcaggacagcttacaaacctcggtgttgtaacgtggatgtctgattgtgtagctaaagttctacaatctctctccttgagttggcctgctgcgtttggacttcttcaagcagcctacttcttcattcactaccttttcgcaagccaaaccggtcatgttggagctctcttctcagctttccttgctatgcatatagcagcaggtgttccaggaattctagctgcacttgctttagcatacaacaccaatctttttggtgctttgactcattacagtagcggtcaagccgctgtctactatggagcgggttatgttgatctgcctgatgtattcaagattggattcgtgatggcgacgattaatgcgataatctggggagtagttgggactttctggtggaaatttttgggtctctactaa

SEQ ID NO: 322 - DNA, 1124 bp, Arabidopsis thaliana
ttaattaacgtcttgaaacgcaccgtattcatgacttcgtcggagccactcgacctggttgtcaccgtcgtctctgccaagcacctgaagaatgtcaactggcgtaacggtgacctgaaaccctacgttgttctgtatcttgaccaagaccaccctctctccacccgctccgatgattcctcctccatcaaaccggtgtggaacgagcggattactcttcctctcacccgatctgtccacgaatcggtcctcaacatcgaggtttttcattccaattcttcggatctggcgaaaaccctcgtcggatcggttaggtttcctctagctcgtttgattgactcggacgggtcaatgattccggaattgatcaactcgctcgagctggttcgtccatcgggtcgaccacaggggaagattcgtttgaagctcgcgatcaaagacagaccaatccctccaccgcagcatcctccgccacgtcctcaatctcaaccactagattactattctgcccctcaaggaaaccattattactcccctagccctcctcctcctcctcctcctcaagcaccgatcaccgctccatctcctcagcgtgactacagagaattctcacagtcaccgtctccgtctccttacgcattcactgatcactactattccgggtattattatccgcctcctccaccacgttcaatgtacgatcgtgcctccaattacggcctcccaagtggcccatctgctcccgttgatgccttctcatcgattgatcacaagcagcctcctttagctcctcctcggttttctaactacggtccaccgcctagtgggccctcagcacccgttgatgcctttctggttaccgagtacaagccacaagctccacctatgggctcgcgattgtctagctacggagtgcctaatggtccatcggcaccagtcgattactctccttatgatcacaggcagttgcagaagacgatgggtggattgagcttagaggaagagagagctgctgcagagaggtctgagagtgatttcggagctaggccaaactacagctatggccgtgattatcgccgtgaatgttgaggatggcaaaaagttgttgaatttcacggcgcgcc

SEQ ID NO: 323 - DNA, 688 bp, Arabidopsis thaliana
ttaattaaatggttttgaacgatgaggagatgaaagctggagagtcttcagaagagccaaagggacaagggctaagcaggaaaaatagccatagctctatgtgtccgacagatgatgatgaagaagaagaagacaagaaactcgaacttggtcccatgattgctcttaaagaacagctcgagaaagacaaggatgatgaaagcttgaggagatggaaggagcaacttctaggcagcgtggatcttgaggaggtcggagagactccggatccactggtaaagatactaaccttaacaattaggtcaccggatagagaagacatggtattaacgatccctgaaaacggaaaaccggcttcgaaaggaccatggttcactctcaaagaaggctctaagtacactctcatatttactttccgtgtcaccaacaacattgtgtccggcctccaatacagcaatacagtttggaagaccggaatcaaggtgtatagtagaaaggagatgttaggaacgtttagtccacaggcggaaccgtacactcatgttatgtttgaagagacggcaccctctggtctactcgttagaggctcttattctgttaaatctaagttcgtcgatgatgataatcagtgctacttggagaacaactacaccttcgacattcgcaaaaattggctgtgaatttaaat

SEQ ID NO: 324 - DNA, 1856 bp, Arabidopsis thaliana
ttaattaagatacatacacaaacatggaaggaaaaaaagagatgggtagttacaaattctgtctgatcttcacaaggaagttcaggatgacggagtctggtcctgtcgaagacgtcagagatcttttcgagaaatacaccgaaggcgatgctcatatgtcgccggagcagctacagaagctcatgacggaggaaggaggagaaggagaaacaagtctagaggaagcagagagaatcgttgacgaggttcttcgccggaaacatcacattgcaaagttcaccagacgaaaccttactcttgatgatttcaattattacctcttttctactgatcttaatcctcctatcgccgatcaggtccatcaaaacatggatgctccattgtcacattactttatattcacaggccacaattcctatttaactggaaatcagctaagtagcaactgcagtgaacttcctattgcagatgcattgagacgaggcgtgagagttgttgagttggatctttggccacgtggtaccgatgatgtctgcgttaaacatggaaggacattgacaaaggaagtgaagttgggaaaatgtttggaatctattaaagctaatgcctttgctatttcaaagtatcctgttattattactcttgaagaccatctcacgccaaaacttcagtttaaagttgctaagatgataactcagacatttggagatatgttgtattaccatgattctcaaggttgtcaagaatttccttcaccggaagagttgaaggaaaagattctaatttcaacaaaacctccaaaagagtacttagaagctaacgatactaaggagaaagataatggagaaaaaggtaaggattcggatgaggatgtatggggcaaagagccagaagaccttatttctacgcaatctgatcttgacaaggtgacaagcagtgtaaatgatctcaatcaagatgatgaagaaagggggtcttgtgagtctgatacgtcatgccaattacaagcaccagaatacaagcgtcttatcgctatccatgccgggaagccaaaaggcggtttacggatggctttaaaggttgatccaaataaaatcaggcgacttagtctgagtgagcaattacttgagaaagctgtagcatcatatggtgcagatgttatcagattcactcagaagaattttctgaggatatatcccaaaggcacaaggtttaactcttcaaactataaacctcagatcggttggatgagcggagctcaaatgattgcattcaacatgcaggggtatggcagagcattgtggctgatggaaggaatgtttcgagcaaatggagggtgcggttatgtcaagaagccagattttcttatggatgcaagtcctaatggacaagatttttaccccaaagataattcgtctccaaagaaaactttaaaggtgaaagtctgtatgggagatggatggctcctagacttcaaaaaaactcactttgattcttattctcctccagatttcttcgttagagtgggtattgctggagcacctgttgatgaggtgatggagaaaacaaaaatagagtatgatacatggacacctatttggaataaggagttcacattccctttagcagttcctgaacttgctctgctccgtgttgaagttcatgagcacgacgtgaatgaaaaagatgattttggaggtcaaacttgtttaccagtttcagagataagacaaggcatacgcgctgttccactctttaatcgcaagggagtgaaatacagctccacacggcttcttatgcgcttcgagtttgtctgagacgccatttttggtgcgtgtatccatctagggcgcgcc

SEQ ID NO: 325 - DNA, 1036 bp, Arabidopsis thaliana
ttaattaaatgaaaccaaagagcaaagttgcagaatctacagctgcatcatgttttctcgtcatgagcttgttatgcagctgcattattggtgaccaaatggagactaataatgaaggcttgtcttacagttactacgagaaaacttgtcccaaagtcgaagagatagtgagatcttcactttcatcaatgtttatacttgatcctacttctcctgcagccttgctaaggcttatgtttcatgactgccaagttcagggatgtgacgcatcaatcctactcgagccaattagagaccaacagttcaccgagcttgattcagccaagaacttcggaatcagaaagagggacctggttggctctatcaaaacctcactagagcttgagtgtcccaagcaagtctcatgctctgacgtcatcatcctcgccgccagagacgccgtggctctcacgggaggcccactcatctccgtgccattaggacgaaaagactccctctccactccaagcaaacacgtggcagactctgagcttcctccctccactgctgacgttgacactaccttaagcctattcgctaacaaaggcatgaccatcgaagagtccgtggccatcatgggtgcacatacgataggagtcacacattgcaacaacgtattatcgcgtttcgataacgcaaacgcgacaagcgagaacatggatccacgttttcaaacgttcttgcgtgttgcttgtccagagttttctccaacttctcaagctgcggaagccacatttgtccccaacgatcaaacttcggtgatcttcgatacagcttattacgatgatgccatcgcgggacgtggcaatcttaggattgactcggagattggagctgatccacgtacacgtccatttgtggaagcgtttgcagctgatcaagaccgtttcttcaacgccttctcttccgcgtttgtaaaattgtcgtcttacaaagtgttaaccgggaatgaaggagtaattagaagcgtgtgtgacaaggttgattgaggcgcgcc

SEQ ID NO: 326 - DNA, 1537 bp, Arabidopsis thaliana
ttaattaaatggcttcaataagcttacttcaagtttccgtagctatcctttgctttctcatccttcattactttctcttcaagaaacctcatggccggtaccctaggaactggccggttctccggatgctacccgctatgctcaaggcgcttcaccgaatctacgactacagcgtgaagattctcgaaacctctgacttgacctttccattcaaaggaccgcggttcacaggaatggatatgttgctcacggttgatccagctaacattcatcatataatgagctcaaatttctcaaactacatcaaaggaccggagttccaagatgtttttgatgtgttaggagacagtttcatcaccacggactcggagctatggaagaatatgaggaaatcttatcaagccatgctccatagtcaagagtttcaaaggttttcaatgagtaccatgacaagtaaactcaagtacggtcttgttccccttcttaatcattttgctgaggaaggaacaactcttgacttgcaaagcgtcttcgggaggttcactttcgatacaattttcatccttgtaactggttctgatcctagatctctctccattgaaatgcctgaagacgaatttgctaaagctctcgacgatgttggagaagggattctttataggcattttaaaccaaggttcttgtggaagctgcaaaactggataggattcggacaagagaagaagctcactgaagctaatgcaacttttgaccgcgtgtgtgccaaatacatatcagccaagagagaagagattaaaagatcacaagggacttccaatggaggaagtcaggatcttttaacttccttcataaagctagacacgaccaagtacaagctcttgaatccgagtgacgataagttccttagagacaacatcttagctttcattctagcgggaagagacacaacagccaccgctctctcttggttcttctggcttctctctgaaaatccacatgtggtagccaagattcatcaagagatcaacatcaacactgatctatcaagaacaggaaatagccaagagaatgtagacaagttggtgtatttacatggtgcgttgtgtgaagcaatgagactctacccaccagtttccttcggacgcaagtctccaatcaaatcagatgtgcttccaagtggccataaagttgatgcaaactctaagattattatctgtctttatgcattggggaggatgcgagcggtttggggagaagatgcatcgcagttcaagccagagagatggatttcggagaatggaggcataaaacatgagccttccttcaagtttttgtcgtttaatgccggtccaagaacttgtctaggtaaacatctagctatgactcaaatgaagatagtggcagtggagatattacgaaactacgacattaaggttctccaaggacagaagattgtgccagctcttggttttatattgtcaatgaaacatggtcttcaaatcactgttactaagagatgttctgcttgaggcgcgcc

SEQ ID NO: 327 - DNA, 1546 bp, Arabidopsis thaliana
ttaattaaatggccttcttctccatgatctccattctccttggctttgttatctcctccttcatcttcatcttcttcttcaagaaacttctctccttctccagaaagaacatgtctgaagtctccactctcccctctgttccagtggtaccagggtttcctgttattgggaacttgctgcaactaaaagagaagaaacctcacaagactttcactagatggtcagagatttatggtcctatttactctataaagatgggttcttcttctcttattgtcctcaattctactgagactgccaaagaggccatggtgacgcggttttcgtctatctcaacgaggaagttgtcaaatgcgttgacagtccttacttgtgacaaatctatggttgctactagtgattatgatgatttccacaagttggtgaaacggtgtctcttgaacggtcttttgggtgctaatgcacagaaacgaaaaagacattacagagatgcactcattgaaaatgtgtcttccaagttgcatgcccatgctagggaccatccacaagaacctgtaaacttcagagctatatttgagcatgagcttttcggtgtagcattgaagcaagcttttgggaaagatgtggaatccatttatgttaaagaactcggtgtgactttgtcgaaagacgagatcttcaaggttttagtacatgacatgatggaaggtgcaattgatgttgattggagagacttcttcccatacttgaaatggattccaaataaaagttttgaagcaagaatccagcaaaagcataaacgtagactcgcagtgatgaatgctctgattcaagatcgactgaagcagaatggttcagaatcggatgatgattgctatctcaacttcttgatgtcggaagcgaaaacactaaccaaggagcaaattgctatcttggtttgggagacgattatcgagacagctgacactactttggttacaactgaatgggccatctatgagctcgctaagcatccaagtgtccaagatcgtctgtgcaaagaaatccaaaatgtctgcggaggagaaaagttcaaagaagagcaattgtctcaagttccttatctcaatggagtctttcatgaaacgcttaggaaatacagtcctgctcctctagttcccattcgctacgcccacgaggatacgcaaatcggaggctatcatgtccctgcaggaagtgagattgcaataaacatatatggatgcaacatggataagaagcgttgggagagaccagaggactggtggccggagcggtttcttgatgatggcaaatatgaaacgtcagatcttcacaagacaatggcgtttggagcgggaaagagggtttgtgctggtgctcttcaagcatctctcatggcaggcattgctattggaagattagtgcaagaattcgagtggaagcttagagatggcgaagaagagaatgtggatacatatggcttgacctctcagaagctttatcctcttatggctattatcaatccaaggcgttcttaaggcgcgcc

SEQ ID NO: 328 - DNA, 1492 bp, Arabidopsis thaliana
ttaattaaatggattacgttttgattgttttgccacttgcattgtttctcatagcttacaaattcttattctcatccaaaacgcagggcttcaatctcccaccaggaccaactccgtttcctatcgtcggccatctccacctagtgaaaccaccggtccaccgtctcttccgccgcttcgctgaaaaatacggcgacatcttctccctccgttacggctctcgccaagtcgtagtgatctcttcattgcctctcgtaagagaatccttcaccggtcaaaacgacgtcattttaacaaacagaccgcattttctgaccgcgaaatacgtcgcttacgattacaccactataggaaccgccgcttacggtgaccattggcgtaatctccgccgtatttgctctctagaaatcctctcctctaaccgtctcaccggattcctctccgtacgtaaagacgagattcgtcggctgctcacaaaactctcacgtgaatatgacggccgtgttgtcgagcttgaacctcttcttgcagatttgacgttcaataatattgtccgcatggtcacagggagacgctactacggagaccaggttcataacaaggaagaagcgaatctattcaagaaactagtgacggacatcaatgacaacagtggtgcgagccatccaggagattatctaccgattcttaaagtgttcggacacggctacgagaaaaaagtgaaagcactaggcgaagccatggacgctttcttacaacgactgctcgatgaatgtcgaataaatggagagagcaacacaatggttagtcacttgttgtctttacaactagaccaacccaagtattacagtgacgtcatcatcaaagggctcatgctcagtatgatgctagctggaacggatactgcggccgtaacattggaatgggcgatggcaaatttattaaaaaaacctgaagtgttgaaaaaggcaaaagctgagatagacgagaagattggagaagagagattggtcgatgaacctgacattgcgaatctaccttatctccaaaacatagtttccgagacttttcggttgtgtccagctgcaccacttcttgttccacgttctccatctgaagatctcaagattggtggatacgacataccacgtggcactatcgtgctagtgaacgcttgggccatccatagagacccaagactttgggatgagcccgagaagtttatgcctgagcggttcgaagaccaagaagcttcaaagaaactaatggtgtttggtaacggacgaagaacgtgtcctggtgcgactttaggccagaggatggtattgttggctttaggttcgttgattcaatgctttgactgggaaaaagtcaacggtgaagatgttgacatgacagagaatcctggaatggctatgcgtaaactcgtgcaattacgagccgtttgccataaacgtcccattatgactaatctcttggcttaaggcgcgcc

SEQ ID NO: 329 - DNA, 2099 bp, Arabidopsis thaliana
ttaattaaacacacctcatggattctttatcatccatgggatttcaaacagctagtttttttctgatcttgttattcttgttttatcatcttccttgtgttccaagccagcaagaacgaagtaggttatgtaaaccttttcagtgtggcgacatcaccgtcggttttcccttctggggagagaatcgccaaagtgattgcggtcacttttctctgaaactaaactgcaacaaaccctcaaacacaacctctcttacaatctcaggccacaactacagtgtcctccatatagacaacaaatccaacattcttagcctatccagacaagatttctcaggtcctttctgttctgcttcattctcttccacacctttgcgttcagatctcttccagaatttgcaaccttacagaaacctcactgtgttctatatgtgtgaccctcgtcgccatttctttgggaatttcacatgtccagtgaaaggtcttggctctgtggttcagaactctacgtatcgtaaactttgtgataaaagttttagcgtcacagttcctacgagttatgttccagaggaagaagctctgaatttgacacatttggaaagtgttttgaggaaagggttagaggtgaagctgaagataagtgagatgtctggtcaagaatgtgtaaccactgatggaaactctggcttcacacggttttgctgcacgaacgtatcaggaccagaaatcagttgccttacttcaataactactatgaataatggttatcacttgatcttgaatttcatctaatccatagatcataagcatcactaattttacattctcaatgttagaatccatcattttttggatgcaatcttgctcaaaaagacattaaattttgcaggaacttacagcgataatcgccctttcctggtaacaattggaacaggttagagttactgcttcaacttcagcttgtattgaacttttgcgggactgaaactaaggttgttttcaatttttttagttctagggtcaatactatgtgtatgtgtggtgctgtttctagcattttatcttaacgagagaagaatagcaaaggctgcgagaattcagcacctcgaggcgcttggaaccctgagagggtacaattataaacaaatcaagaaaattacaaaatcatttacagaagtagttggacgaggaggatttggaactgtatatagagggagattacgcgatggtcgaaaggttgccgtgaaggtcttgaaagattcaaagggaaactgtgaagatttcatcaacgaagtcgcaagcatgagccaaacatctcatgttaacattgtaactctgcttggtttctgctatgaaggatccaaaagggcgatcatatatgaatttctagagaatggatctctggatcagtcgttgaatcttgatgtgagtacactttatggaatcgcgctaggcgtggcacggggacttgagtacctgcactatggctgcaaaaccaggattgtgcattttgacattaaacctcagaatgtactgttagatgaaaatctcagacccaaagttgctgattttggactcgctaagctctgtgagaagcaagaaagcatcttatcattgcttgataccagaggaacaataggatacattgctccagagttgttttcaagaatgtacggaagcgtgtctcacaagtcagatgtgtacagctatgggatgttggttcttgagatgatcggagcaaggaacaaagaaagagtccaaaatgctgatccgaacaatagctcggcttactttccggattggatctacaaggatcttgaaaattttgataacacaaggcttcttggcgatggactaacccgagaggaagaaaaaaatgcgaaaaagatgatcttggtgggtctatggtgtattcagttccgtccatcagaccgtccatcaatgaacaaagttgtagagatgatggaaggaagtttggattctcttgatccccctcctaagcctcttttgcatatgccaatgcaaaacaataatgcagaatcatctcagctatcagtggaaagctcaatttactccgaagtatgattccatgggcgcgcc

SEQ ID NO: 330 - DNA, 1569 bp, Arabidopsis thaliana
ttaattaatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattgaattaaatacccagcttaagggcg

SEQ ID NO: 331 - DNA, 1517 bp, Arabidopsis thaliana
ttaattaagaagtgaaagatggtgaagatatgttgtattggagctgggtatgttggtggaccaacaatggcagtgattgcattgaaatgtccagacgttgaagtagcggttgttgatatctctgtaccacgtatcaacgcttggaacagtgacacgcttccgatttacgagcctggtcttgatgatgttgtgaagcaatgccgtggcaagaaccttttctttagtactgatgttgagaaacatgttagggaagctgatattgtgtttgtttctgtcaacacaccgactaagactagaggtcttggtgctggtaaagctgcggatcttacgtactgggagagcgctgcgcgtatgatcgctgatgtttcggtatcggataagattgtcgttgagaaatcgactgttccggttaaaacagctgaagctattgagaagattttgacacataacagtaaagggattaagtttcagattctttcgaatcccgagtttttggcggaaggaaccgcgattaaggacctatttaatccggaccgtgttcttatcggagggcgggaaaccccagaagggtttaaagcggtgcagactctcaagaatgtgtatgcacactgggttcctgaaggccaaatcataacaaccaatctctggtctgctgagctgtccaagcttgcggcaaacgctttcttggctcaaaggatttcatcagtgaatgctatgtcggctctgtgtgaagccacaggcgcagatgtcacgcaagtgtcttacgcggttggtacagactcaaggattggtcccaagttcttgaactcgagtgttggattcggtggttcgtgtttccagaaggacattctgaatcttgtctacatctgtgagtgcaacggactcccggaagtggcagagtactggaagcaagtcatcaagatcaatgactaccagaagagccggttcgtgaaccgtgttgtttcctccatgttcaactctgtatcaaacaagaagattgcggttctcggtttcgcattcaagaaagacaccggtgacacaagggagactccagccatcgatgtgtgcaagggtcttttagaagacaaagcaaggctaagcatttacgacccacaagtgactgaggatcagatccagagggatttatccatgaacaagttcgactgggaccatcctctacatttgcagccaatgagcccaacaacagtgaaacaagtgaccgttacttgggacgcatacgaagcaactaaggacgctcacggtatctgcatcatgaccgagtgggatgagttcaagaaccttgatttccagaagatctttgacaacatgcagaaaccagctttcgtgttcgatggaagaaacattatgaatctgcaaaagctaagggagattggtttcattgtttactccattggtaagcctctcgacgactggctcaaggacatgcctgccgttgcctaatgatgttcattgctgactctttcgtcctccatcatttgtgcttttcttggcgcgcc

SEQ ID NO: 332 - DNA, 564 bp, Arabidopsis thaliana
ttaattaaatggctgaacaacaagatcatcacaaagagcttcagcttttaccttctccaccgtctaccgaatctccggtaaggaaacaccgaccaacagttataacaaccgaccatcacaacaatcaccaccgttcctcctccatgatccaccacgatcttgacctcaaactctccatcagcctcagctcgatctcaacagcggaggagcttccaaacggtggtgtggaggcgttgaagtggcaagccgcggagcagataaggcttgcggctatagagaaggcttacgccgagagggttagagagttgactcgccgtgagatggagatggctcagtctgagtttgctcgtgcaaggtagttaaagctagctcgatcaagtaataattctggttttggtttggttaacggttttgaattgtaaccagggtgatgtggcagaaggcaagggaagaagtggagagagctgagagattgaaggagagatcaatgacgaagatcgatacggcttgcttggagatcacttgccactcttgcagacaaaggtttaggccataaggcgcgcc

SEQ ID NO: 333 - DNA, 1852 bp, Arabidopsis thaliana
actctttgtttcttgtttgttgattaacccttaattaaatgggtctctgtttctcgtctcctaaagccaccagacgtggcaccggtagtcggaaccctaatcctgattctccgacgcaggggaaggcgagtgagaaggttagtaataaaaacaagaagaatacgaagaagatccaattgaggcaccaaggagggatcccgtacggtaaacgcatcgattttgggtacgctaaggatttcgataaccgatacaccattgggaaattgctcggacatggccagtttggctttacctacgtcgccaccgataacaacaatggcaatcgcgttgcagtcaagagaatcgacaaggccaaggtaaaaatatcatctattgttgttatttgcttttagctaaagatccttaattactatttggaaacctaaaaatccaacctgttacgaatgtgattgcttgaaaaccaagtaagctccctctctagtttttcgcttgttcccttagagtgtctcccaaatcgtacagtttcttagcgcgaaagcggtacgagtaacacctaactccatggcgtttttggtgtggtacagatgactcaaccgattgaagtggaagatgtgaagcgagaggttaagatactacaagctttaggtgggcatgagaatgtggtaggctttcacaatgcatttgaggacaagacctatatttacattgtcatggagtaagtctcaagtttgtctctgtttttactatcattctttttcttgtgatacaagaaaaatgaatttactctggttttgatgagtttttcttttcccaggttatgtgacggtggtgaattgctagatcgaatactagctaagtaagattaacaaaactttgtattaacatagaagtaatgctaaaattctgtaagaaaagatgggaagttacatcaagtcaacttatgtgtatatattttccaggaaagatagccgttacaccgagaaagatgcagcggttgtggtgagacaaatgctgaaagttgcagctgaatgtcatttacgaggtctagttcaccgcgacatgaagccagaggtaggtacgattcagtttgattcaatgcttggaaattgcaaatccatatgtgaaagcatcttcatcactttaagaagagttatgatcccttaccctctcagaattttctgttcaaatcaaccgaagaaggttcatctctaaaggctacggattttggtctgtcggacttcataaagccaggtaaaagtttcacttgtcaagtcttgtccctgagagcagaatggtagataatggaggtgattttgtgaaaatggcaggagtgaaatttcaggatatagtaggaagcgcatactacgttgcacctgaagtgttgaaacgtaggtcaggacctgaatcagacgtttggagtattggtgtcatcacttacattctgctctgcgggagaagacccttctgggataagactcaagacggaatattcaatgaggtctagtactcatcttcttgagaaaacaatccaatctatataatctgtttgttcatggatactattgacatgaaaaaacaggtcatgaggaaaaaacctgatttcagagaagtcccatggccaaccattagcaacggtgccaaagatttcgtgaagaagttgttagttaaggagcctcgggcacggttaacagcagctcaagcgctatgtatgttatgcacaagcaaatgccatatatttccattatttttggttaacttataagttactcaacttatggatttggtttgtagcacattcatgggtgaaagaaggaggtgagtagatttaaatacccagcaaattggagctctg

SEQ ID NO: 334 - DNA, 1741 bp, Arabidopsis thaliana
caaactctttgtttcttgtttgttgattaacccttaattaaatgcaataatcctcctgaaagcgacttactgatatatattagtttattaggcaatgaatgtgaaatttaccgagtcaaacgtgtttaaacaatgtaaaaggtgaagactttgatgaaaaaatccaaactttggatctgtttcagagtcaataagctctctcatatttatatatgcgtgtttgattttgataagaagggaactttgttgttggcttaatctgattttttgacatatgcttgaagtgttgcaggcgattgttttgtttatcttgttttgggtttggttgtcttggatgggaggaagtagctctaaagagtcacctagaggaggtggaagtggtcgtaggtatgaacgtagtgtgtctgggagctcatcttattcgtctgcttgggaccagagcagctattatcagacaccaaaccatccatctgcgtctcctgtttcatcctataattctgggagacaaacaccgaagaatcttgagaggaagtattcacggattgctgataactaccgttccattgatgaggttaccgctgctctctcacatgccggtttggagtcctcgaatctcattgttggtatagatgtcaccaagagcaacgagtggacaggggcgagatcatttggtaggaagagtctgcatttcattggaactactccaaacccttatcaacaagctatttccatcattggaaagactttatcggtttttgatgaggataatttgatcccctgttatggatttggagatgctacaactcatgatcaggatgtcttcagtttcaatcccaatgatacatattgtaacgggtttgaagaagttctcatgtgttacagagagattgttccccagcttcgtctctcaggtccgacatcttttgcacctatcatcgaaagggccatgacaattgtggaagaaagtggtggccagtaccatgttcttctcattatcgctgatggacaggtgacaagaagtgttgatacagataacggtggattcagtccacaagagcagcagactattgatgccattgttagagcaagtgaatatcctttgtctatagttcttgttggtgttggagatggtccctgggacaccatgagacagtttgatgacaacatccccgctcgtgcctttgacaatttccagtttgtgaatttcacggatataatgtcaaagaacattgatccagcaagaaaagaggcagaattcgcgctttctgccttgatggagatcccgtctcagtataaagccaccctcgaactaggcttacttggacaaagaaccggacattgtccagacaggattgcgcttccaccaccaacttatgctactcaatctatgcgcaacagcccaagaacttcccgatcaaccagttttcaaaacaaaccatatgataatggtgtttcctctacaccaccttcaactactcataacgagagccagcaacagttttgccccgtatgtctagtgagtgcaaagaacatggctttcaattgtggtcatcagacttgcgctggatgtggggaagacctccatgtgtgtcccatttgccggagctcaatctcggttcgtatcaagctttattaagataagtctctcaagaactgaaggaacccgaggtggtctgagatatttaaatacccagcaaattggagctctgcagagctttcgttcgtatcatcggtttcgaca

SEQ ID NO: 335 - DNA, 1888 bp, Arabidopsis thaliana
tttgtcagctttcaaactctttgtttcttgtttgttgattaacccttaattaaggaagatggtgtctgacgctagcaagaagaaggcagctcagaagaaagctgctgccgccgctaaaagaggtggtaaagctgctgctccatccaaatccgccgctacttcttccaacggtgttgatagcttgtcaagcggtgtcgatgctcttcaaatttctgatcggacttgtaccggagttctctgttctcatcctcaatctagagatatccgaatagaatctctgtctgtgacgtttcatggttatgaccttattgttgattcaatgttggagcttaactatggaaggcgttatggtctccttgggttgaatggttgtggaaagtccactcttttaactgcaatcggacgcagagagataccgattccggatcaaatggatatctaccatttgtctcacgagattgaagctactgacatgtcttccctggaggctgttgttagctgtgatgaggagaggttgaggttagagaaagaagttgaaattcttgtacagcaggatgatggaggcggagagcgtcttcaatctatctatgagaggttagacgccatggatgcagaaaccgctgagaaacgtgctgctgaaattctgtttggacttggtttcgacaaggaaatgcaggcgaagaagacaaaagatttctctggtggttggaggatgagaattgcattggcaagagcactcttcattatgccgacaatccttttgcttgatgagccgactaatcatttagatttggaagcttgtgtgtggctagaagagagcctgaagaattttgatcgcatccttgttgtggtatcccactcacaggatttcttgaatggagtgtgtacaaacatcatccacatgcagagcaaacagctcaagtactacactggtaactttgatcagtattgccagactcgttctgaacttgaagagaaccagatgaaacaatacagatgggagcaggagcagatttctcacatgaaggagtacattgctcggtttggtcacggttcagccaaacttgctcgtcaagcacagagtaaggagaaaacattggcaaagatggagagaggtgggctcactgaaaaggttgctagagacagtgttctcgttttccgttttgctgatgttgggaagcttccaccgccagtgcttcagtttgttgaagtgtcttttggttacacaccggactatcttatttacaagaacattgactttggtgtcgacttggactcgagggttgcccttgtgggacctaatggagctggaaagagtacacttttgaagctcatgactggtgaattgcacccaactgaaggaatggtgcgacgtcacaaccacttgaagattgctcagtaccatcagcatctggctgagaagctagacttggaattgcctgcacttctctacatgatgagggagttcccgggtactgaagaggagaaaatgagagctgcgattggtaggtttggtctaactggtaaggctcaagtgatgccaatgaagaatctatctgacggacaaaggagcagagtgatctttgcgtggttagcttataagcagcctaacatgcttcttcttgatgagcctactaaccatttggatatcgagacaatcgactcgcttgctgaggcattgaatgagtgggatggtggtttggttctggttagtcacgacttcaggttgatcaaccaagtggctcatgagatatgggtttgcgagaaacaatgcatcactaaatggaatggtgacattatggacttcaagaggcaccttaaggctaaagccggacttgaagattgaagatagagagtcgaatttaaatacccagcaaattggagctct

SEQ ID NO: 336 - DNA, 971 bp, Arabidopsis thaliana
ttaattaattagtaagctcgcccatgctcagatccggtctggcttcgttaatcgtcgatgtcaatttgcggcgcacgttacgtccatccccaaccttttcttttccggcgcatcttagccgttgcattatcacttcccgttactcctcccgtacatctctaaggtttccgattcaaatatctcgccaccaacaccgtctatcctacttttcttcatcctcttcgtcggagcaaagcagaccaacttcctcttcccgaaacagtttcagtggtcacggtcagcttgatagtgatgataattcttcaccgcctccgtcgcaatcatcttccaaagttcttacattgcctaccgtattaacacttggtcgtgtcgccgccgtcccgcttctcgtcgcaaccttttacgttgatagttggtggggaacaactgctacaacaagcattttcattgcagcagccattacagactggcttgacggctatcttgcccgcaagatgaggttaggttctgcgtttggtgcctttttggatccagttgctgataagcttatggttgcagctacattgattttactgtgtacaaaacctatccaagttgctgaattaggaccacttccatggttattgaccgtaccttctattgcaatcattggtagggagattactatgtccgcagtaagagaatgggctgcatctcaaaatggaaagcttttagaggcagttgctgtaaataacttgggcaagtggaaaaccgccacgcagatgacagcactaaccatacttcttgcaagccgagatagcaatgttggatggctcgtagcttcaggtgctggcttgctttatgtatcagcaggactatctgtttggtctttagccgtttatatgaggaagatatggaaagtactaatgaagtagtattagtagtagtaattcatctattggttttgttttgctttgacctgcaatttaaat

SEQ ID NO: 337 - DNA, 1340 bp, Saccharomyces cerevisiae
aactctttgtttcttgtttgttgattaacccttaattaagacatctagaataaagtgctggaacttagattttttgtgcaatatgggactgatattaaggtggaaagagaaaaaacagttgtctagtaagcaaaatgctcaaaaatccaggaaaccggcaaacacatcgtttagacaacagcgcctcaaagcctggcagcccatcttgtcgccacagagcgtactgccgttgcttattttgatggcatgcgtcttcgcacccattggtatagggctggtggtcagcacgataagtgtccaaagactagtggtaaactacacagaatgtgatgcattggcaccgtcgaagcattttgaaacgattccctctgagtacgtggactaccacttcagtaagaaagtcacagtccaacctcaatggatggtacttacggatcctgaattgggcaatcaaacttgtcgaatacagttcgaagttccaaatcatatcaagaaatctacttatgtttattaccgcctaacaaatttcaatcaaaactatagagaatatgtgcaatctcttgacctagaccaattaaaaggaaaagcattgatcggaaatgatctggatccaaactgtgaccctttaaggacggtagaaaataagaccatattcccctgtgggttgatagcaaattcgatgttcaatgatacattcggcacaacgcttactggtgtaaacgatactgcagattatttgcttaccacgaaaggcattgcgtgggacaccgacagccatagatatggaaagaccgaatacaatgcatccgatattgtaccgcccccaaattgggccaagttatttcccaatggctacactgacgataacattccagacctacaaaactgggaacagttcaaaatatggatgagaactgctgcattgcccaacttctataagctagcaatgaaaaatgagaccaatgggttaggtaagggtatttacattgctgatatagaactcaactacccagtaagatctttctatggaacaaaatcttttgtattaaccacaaacagtattatcggtgctggaaacgaggcattagggattgtttacttgattgttgctgggattgcaactcttttcgccatactattcctgataaaagtcatcttcaaaccaagacctatgcatgatcatagctacctaaattttgagaacagcgataccccattcgatgagagtagtgtcgttagtattccattgagagaaattttatgattgattatcatttaccataaaatccctgcgtttgattcatttaaatacccagcaaattggagctctgcagagcttt

SEQ ID NO: 338 - DNA, 2111 bp, Saccharomyces cerevisiae
tattcatttatttgtcagctttcaaactctttgtttcttgtttgttgattaacccttaattaagatgacgcttggtaatagacgccatgggcggaataatgagggaagctctaatatgaatatgaatcgtaacgaccttgacgatgtttcccattacgagatgaaggaaatacaaccaaaggaaaaacaaattggctctatagaaccggaaaatgaagtagaatattttgaaaaaacagtggaaaaaaccattgaaaatatggaatatgaaggtgaacatcatgcatcttacttacggaggttcattgactcgtttagaagagcggaaggctcgcatgcaaattccccagactcgagcaactctaatgggactactcctatatccacaaaagattccagctctcaattggacaatgagttgaatcggaagagctcatacatcactgttgatggtattaaacagtcaccacaagaacaagaacagaaacaagaaaatttgaaaaagagtataaagccccgtcatacggtgatgatgtccctagggactggtattggtactggtttgctggtcggtaactccaaagttttgaacaatgcaggtccgggtggtttgatcattggttatgctattatgggtagttgtgtttactgtattattcaagcttgtggtgaattagcggttatatacagtgatttgattggtggatttaatacatatcctttgtttttggtcgaccctgcacttggcttttctgttgcttggcttttttgcttacaatggctatgtgtttgtcctctagaattggtcactgcatccatgactatcaaatattggacgacatctgtgaacccggatgttttcgttgttatcttctacgtactaatcgttgttatcaacgtttttggagctaagggttatgcagaggcagatttcttcttcaattgttgtaaaattctgatgatagttggatttttcattctcgccattattattgattgtggtggtgcaggtaccgatggttacataggtagcaaatattggcgtgatcccggagccttccgtggtgatacacccatccagaggttcaaaggtgtcgttgccacatttgtcacagcagcgttcgcctttggtatgagtgaacagctggctatgactgccagtgagcaatccaatccaagaaaggctattccatcggcggcaaagaaaatgatttatagaattctgtttgtgttcttggcgtctttaacgttagttggtttccttgtaccttacacctcagatcaattgctaggggccgcaggttcagccactaaagcgtcgccctacgtcatcgctgtctcctctcatggtgttcgtgtggttcctcatttcataaacgctgtcatcctgttgtctgttctttccgttgctaacggtgccttctataccagttctcgtattttgatgtcgttggccaaacaaggtaatgcacccaaatgtttcgattacatcgatagggaaggtagacctgctgctgctatgcttgtcagtgcattatttggtgtcattgcattctgtgcctcatctaaaaaggaagaggacgttttcacctggttgttagcaatctccggtttgtctcaattattcacgtggattaccatttgtttgtctcacattaggtttagaagagctatgaaagtgcaaggaaggtccttaggagaggttggttataaatctcaagtcggtgtctgggggtcggcttacgctgtccttatgatggtgttagctttaatcgcccaattttgggttgccattgccccaattggtggaggaggtaagttaagtgcccaatcattttttgagaattatttggctatgccaatctggattgctttatacatcttttacaaagtttggaaaaaagattggagtttattcattcccgctgataaagtagacttagtttctcatagaaacatctttgatgaagaattattaaaacaagaagatgaagaatataaagagagattaagaaacggaccatactggaaaagagttcttgatttctggtgttaaatttaaatacccagcaaattggagctctgcagagctttcgttcgtatcatcggtt

SEQ ID NO: 339 - DNA, 1733 bp, Glycine max
agctttcaaactctttgtttcttgtttgttgattaacccttaattaaaaaaatctctatcttctcctcatccaaatggccgactccacccctctcctctcccaacccaacccatcatcatcatcgtctcccgacacacaagaagcaccgccatcgaaccaacaccatccctctctggggtccacagtagaactctgcataggcgagttcaactggtcccagttcctccagtcgattctggtctccctcgcatggatattcgacgcccagcagaccttcatctccgtcttcaccgacgccctgcccgagtggcactgcaccgagcggggcgccaatgcatgcaagactgccaccacagtctgcagcctcccaaagggctcgtgggcctgggacgtgcccacgcaggcctccatcgtgtcggagtggggcctggaatgcgccaactccgcgatcacgggcctccccgcttcgatgttcttcttggggtgtttgattggcgggttcgtactggcctcgctagcggactcgtcgctcgggcgcaagaacatgctcttcttctcgtgcctcgtgatggccatcacttccttgctcgtcactctctcgcccaacgtttggatctattccgctctcaagtttctctgtgggtttgctcgtgctaccattgggacctctgcgctcgtgctggcctctgagctcgttgggaaacggtggcgcggccagattagcgtcattggcttcttttgttttactatagggttcttgtccctgccagccatggcttacataaacaggagttcttcatggaggaacctttatctgtggacatccatttcaaccatgttctactgcatactggtgaagttgttcgttacggagtcccctagatggcttctagtgcgaggtaaaacagaagaagcggtggaaacactaaagtgcatcacatcaatcacccaaagcaacctcaatttggccataaataacatgtcccacaaggaagaaacatggaacgtggacatattctcagccctcaaaatcttgctacaaaaaaaatggtcttcgagaaggctgtcattaattatggcaatgggaataggcattggattggtgtattacggaatgccactgggcctccaaaatctatccttcaacctctacttgagtgtcacattcaacgccttatcggagttaccatcagcattgattgtgctcttcttcgtagacaagttcaataggagagttgcactcctcctcttcacaatcctaagtggtgttttcagtgtgatgtcaatcatggaaatgaagacatcatcgtggaccaacaacatccaaatagtgtttgagttagtatcgttcttcagcgcttgttcttcgttcaacgtgtacctaatttacaccacggagctgttcccgacctgcgtgaggaactcggcgctgtcgatggcgaggctggcagtggtgctcggtggcacgttcagcccgttgctggtgagtgctgcaagagggaacaagtttatgtgttatggggtttttgggttggtgatagggtttagcggggtcttcggaatattcttgcctgagacaaaaggaagggcactgtgtgatacaatggatgaagaagaaaacaaagagaaaaacatgacttgtgacatgttcctggcttgaattcagcggattttgaaaaggaaaaaaaaaatttaaattggagctctgcagagctttcgttcgtatcatcgg

SEQ ID NO: 340 - DNA, 1656 bp, Glycine max
tcagctttcaaactctttgtttcttgtttgttgattaacccttaattaaatcgaatttggtataacccacttcgtatctgattgaagcaccaactgggttctgtctgagattcaacataagatggagtcggatcttggcaagctcttcattgggggaatttcctgggacaccgatgacgaacgtctcaaagaatattttgggaaatatggagaggtgatagaggctgtgatcatgagagatcggacaacaggccgcgctcgtggtttcggttttgttgtctttgctgatccttctgctgcagagagagtcattatggataagcacataattgatggccgcacagttgaagctaagaaagctgttcctagggatgatcagcaaactataaacagacagtctggtagcatccatggatctccgagtcctggacgcaccaaaaagatttttgttggaggtttaccatcaacaatcacagagagtgactttaagaagtactttgatcagtttggtacaattgctgatgttgttgtaatgtatgatcacaatacccagaggccaagaggttttggcttcatcacttatgattcagaagaagctgtggacagagttctttataagacatttcatgaactcaatgggaagatggttgaggtcaagagggcagttcctaaagagctttcccctggacctacccgaagcccattgataggatataactatggtttgaataggaccagtggcttcctaaatagttatgctcagggtttcaatatgaatccaattggaggttatggagtcaggatggatggaaggtttagtcctcttactagtgccagaagtgggtttagcccatttggctccagtggttatggaatgggagtgaatttggatctaggattgaacccaagctatggagggacttccagttatggtggcagtctgggatacgctcggatgagtcctttcaacaatggcaactctaacagatataccactcctattggcaatagcgggggcaatgggagaagcgattctcttatgaactcagcttcccggagtgtttggggaaatgggggccagaacaatgctgccaatagtccagtcagccctggcgcttacttgggatctggaaatggggcttttggtgtttcaattggaaatggtggcaccaattggggtccatcagttccaacccagggtggaggggctgccactgggtatagtacttggggtaactcttatgatggtggagataacaacatcagtttaggaggtggagggtatggaaggaacagcagcccaagtgtgcctcaatcctcaacatttactgcaccaactggtgattatgaaggatcctatgggaacttgtaccgcaatggttcagtttacagtgactcaacttggcggtctgctgcttctgagatagatgcttctggttcgtttggttacggtggacttggtggtatagcttcagatgatccagtaaagagttctgatggttttattggaaactacaatgtaataagtagacaaactaatagaggaattgctgcttaggagatatgttaattggatatgttatggtaacagtagatcaagggaaactggttaaagaaaacgaggtatttaaattggagctctgcagagctttcgtt

SEQ ID NO: 341 - DNA, 1751 bp, Glycine max
ctttcaaactctttgtttcttgtttgttgattaacccttaattaaccttctctatgggacagtcaccgtccaccaccgccgcgcctccgccagacctcaaccgccaccaaattcctcagatacatccaaacaccgattccgatttcaccgattacaccctccgtctctccgacgattgcctggccgcaatctttcatttcctgagcaccgccgatcggaaacgttgctctctggtctgccgccggtggctccgcgtcgacggccagaggcggcaccgtctctccctcaacgcacagccggaattactagacttcgtcccttccctattcaaccgcttcgactcggtgacgaaactcgctctacgatgcgaccgaaagtgcgcgagcataaacgacgacgctttggttctgatctctctgcggtgcaggaatctcacgcgcctgaagctgcgcggctgccgcgacataactgaactcggaatggccggcgtaggcgaaaactgcaaggccttgaagaagctatcgtgcgcgtcgtgcatgttcggagcgaagggaatcgcggcggtgctcgatcgatgcgttactttggaggatctcacgctgaagcggctccgtggggtccaccacatcaccgacgtggaggttggtgccgcggcttcgttgaaatctatatgccttaaggaactcgtcaacggtcaaagcttcgcgccgcttgtgattgattcgaagaagcttcgaacgttgaagattattgggtgcacgggggattgggatgagactctggttagggttgggtgtttcaacaatgggttggttgaggttcacttggagaagcttcaggttaccgatgtgggacttgttgccgtgtctaaatgttttggtttggacactttgcacgttgtgaaaaccgctgagtgctccgatgtggggctttgtgcggttgctgataggtgtaggttgttgaggaaggttcacattgatgggtggaggactaataggattggtgatgatgggttgcatgcgattgccaaacactgtcttaatttgcaggagctcgtgttgattggtgtttatcccactttttcgagcctagcggcgattgcgtccaattgcaggaatttggagaggttggctctttgtgggattggaaccgttggggatgcggagattgagtgcattgctgataagtgtgttgcactcaggaagctttgcattaaagggtgccctgtgtctaatgctgggattggagctctggcttctgggtgtcccaatttggttaaggttaaggtgaagaagtgcaaaaggattactggtaaaggggtggagtgggtgcgagaacagagggtttctttggcgtttaattatgatgatagtgaagttgaagctttggatgggagtgcaagtgatgggattggcggagctcgggataatactgtagagtttctaccaaccattaaccaaacaaccgtggctgtggctgaggctgatgctgaagcttcttcaagtaataataacaaccgattgacaatgttaagatcaaggtttgggtttttggctggtagaaatttagtaccgggtgccttcagaagatggtctaacggtgataatgtctccagtagcagcagttttggatgatgttagtaaaaaagcagcaagccagcaaccacattcttgccaagtttgcattcctccatatctataaatttaaattggagctctgcagagctttcgttcgtatcatcggtttcgaca

SEQ ID NO: 342 - DNA, 1696 bp, Arabidopsis thaliana
ttaattaaatggcggcttcaatgcagttctacggagttaaaacaccagaacttgccttaaactcaaaaaggattgagtttagctcaaaggggctcaacttctcagcactcgtgtcctctgctcgtgtattctctagaaacgtagatcgttcttgtaagaacatcgctctgagagttacttgtgaagcgggaagagtggagctgctagagagaaaagcctcagagactttcaagttaaacaaaactgagaaaaaattgacctgtgtaatgaaattcggtggctcatcagtggcatcagcagaaaggatgatacaagttgccaaactcatactcagcttcccagatgagaagcctgttgttgtgctatcagcaatggcaaagaccaccaataagcttttgatggctggggagaaggctgtttgctgcggtgtcaccaacgtcgacactatcgaagagttgagctatataaaggaactccatataaggactgctcatgagcttggagtggaaacagcagttattgcagaacatctagaaggactggaacagcttcttaaaggcgtcgcaatgatgaaggaattaactttacgctcaagagactacttggtttcatttggagaatgcatgtccactaggctatttgctgcgtacctgaacaaaattgggcacaaagcacgacagtatgatgcatttgagatcgggattatcaccacagatgacttcactaatgctgatattcttgaggcaacatacccggcggtttcgaaaaagttacttggtgactggagcaaggaaaatgcactccccgttgtcacaggcttccttggaaagggatggagatcttgtgctgtaactacgcttggtagaggaggtagcgatttgactgcaacaacgatcgggaaggctttaggtttgcgggagatccaggtttggaaagatgtggatggagttttgacttgtgatcctaacatttactgcggagctcaacctgttccacacttgacatttgatgaggctgctgaacttgcttactttggtgcccaggtgttgcatccactttccatgcgcccagcgcgagaaggtaacattcctgtaagggttaagaactcttacaatcccactgctccaggaactgtcatcaccagatcaagagacatgagcaaggctgtattgaccagcatcgttctgaaacgtaatgtcaccatgttggacatcactagcacccgtatgctcggccaatatggtttccttgccaaggtgttttccacatttgaaaagttgggcatatctgtggatgttgttgcaaccagcgaagttagcatttctttgacattggatccttcaaagttctgtagcagagagttaattcaacacgagcttgatcaggtggtggaggaacttgagaagattgctgttgtaaatctgcttcgacacagatcaattatctctctcatcggaaatgttcagagatcatcattcatattagagaagggcttccgagtacttcgaaccaatgggattaatgtccagatgatctcccaaggtgcatctaaggtaaacatctcactgatagtgaatgatgatgaggcggagcattgtgtgaaggctctccactcggccttctttgagacagacacttgtgaagcagtctcagaatgcccgaccggctacatcgctgcctcttcgtgaggcgcgcc

SEQ ID NO: 343 - DNA, 1369 bp, Arabidopsis thaliana
ttaattaaaaaaatccaatctttacaaaatccagaccaatatagaaatgactttaatcgcttctctgtctctcccaccaccagctatacaaagacaatcactttctgaatttcataatcttcccgctaaatctcaatccttcaattgtcaattccggtcttctagttcacctttatcttctctccattcttcatcgcttagtaactttctagattttagactaaggcggagaaacagcggattggttccagtggtggcgtgttcaacgacgccgtttatgggcagagttggattacattggagagatgggaatatgtctctgttatcgttttgtggtggaactgatgttacagagaaagctgattcgtctcagttttggtctgctttgcttccatttgttgttgctctcactgccgttgctgctctctcttacccacctagtttcacttgggtatctaaagacctctatgctcctgctcttggagggattatgttatctattggaattcagctttcagttgacgattttgctcttgcattcaaaagaccagtgccgttatctgttgggtttgttgctcagtacgttttgaaaccgcttctcggggttttagttgctaatgcatttgggatgccgaggaccttctacgctggttttatactcacgtgttgtgtggctggggctcagttgtctagttacgcgagttctctgagtaaagctgatgtggccatgagcattcttctcactagttctacaactattgcttctgtaatctttacacctttgcttagtggtcttctaattggatcagtagttcctgttgatgcagttgccatgtcgaagtctatacttcaggtggtacttgttccaatcactcttggccttgtgttaaatacttatgcgaagcctgtggtcactcttcttcaacctgtgatgccgtttgttgctatggtatgcacttcgttgtgcattggaagcccactttcgattaatcgcagtcagattctgtcagctgaaggtcttggattgattgttccaattgttacattccatgccgtagcatttgccttaggatattggttctctaagatcccaggcttacgacaagaggaagaagtaagccggactatctccctttgcacgggaatgcaaagctccacattagccgggcttcttgcaagccagttccttggtagcagccaagccgtgccagcagcttgctctgtagttgtaatggccataatgggtctatgccttgcctctttctggggcaatgggtttcgaatcagggacgttctatcgctatcaacaccgcaaagcactggctacaccgctgaatcatgagcaagaattcagcagcaacggcgcgcc

SEQ ID NO: 344 - DNA, 3248 bp, Arabidopsis thaliana
gcccattattctccattgaaacatcccaaaattttcgctagttagttcactgaaacgcagcgttttgcatcttcttcttcttccttggttcaattcaacctcagacacttgtcttccttaatggctcactctcaggtaattcaaaacaaaaccctaatttccgtttcttccaattacagaaaattcgatgtcttgctctgatttatgtatctgttgcaggttgcttatttgattccattgaaagcagatttaaaggaagacaattcatctccaaggataactttatccgaaggtccaaacatcattggccgtggcaacgtttcaatcgtcgataagcgtctcagtcgcaaacacatcaccattatcgtttccacttctggctcagcttcgttgtcagtggtaataactataacaacattaaaaattataactttggcttcttatcgaattgaatcatgtcaagtttgtgtcttttgggtaggacggaacaaatccggttgttattaggtcttccggtgacggagagagaaagaaagtgaaacctagtgaagaggtttcagtatgtaatgatgatcttattgaattgatccctggtcaccatttcttcaagctagttttgctcaatggaagagctgctaagaaagctcgaaaggtaacttatttggcttaaccaaagaatgttgctttttttgttgtttctttgaggctttgtttgatgtgatggaactgttttaggctgaagacgatgtagaggccattcgtcgtttttgtccacctaatgagaaactaccttcaacatttcggcttttgagtgttgatgcattgcctgattgggctaatacttcttgtgtttccattaatgatgtcattgaggttagtctcatgctaagcatattatttcatttgttttgttcagatatcattgctaaagattgtatttgtaaatgacagggagacgttgttgctgcgatcttatcgaattatatggttgatatagactggttgatgtcaggtgagttttctcataatcttctgtgttgagtttgtccaaatgattagttcttttgtttacattcatgggggtgttgtttttcgattttctcgagtctgttagctgaagttggtaatttgcatatatccttttgtagcttgcccaaaactggccaacattccccaggttatggttattcatggagaaggtgatggtaggcaagagtatattcaggtttgttatgacagtttttgctcatttcttttgattgatgtttatggtagactaaaaatctccaatatttgttttgtttaacagaggaagaagccagctaattggattcttcataagcctcggttacctatttcattcgggacacaccattcgaaggctatatttcttgtctatcctcgaggggtgagagttgtagtacacaccgcgaatctgatccatgttgattggaataacaaaagccaaggtttgtggatgcaagattttccttggaaagatgatgacaaagatccacctaaaggttgtggattcgaaggtgatctcattgattacctcaatgttcttaagtggcctgagtttactgcaaacttacctggccgtggtaatgtcaagatcaatgcagccttcttcaaaaagtttgattattctgatgctacggtactttctatttctctaaactcttttggttgatttatatacttatttgtgtactaataatatgcaacaaattttaaggttcgactaattgcttcagtccctggataccacactggttttaacttgaacaaatggggacacatgaagctacggactattcttcaagaatgcattttcgatagagagttccgcagatccccgctaatctatcaggtaatgttccattccaagttctctttttgcaattgtattacttgtaaaaaagtcttcttctataattattccgtattgcagttttcttcacttggttctttagacgagaagtggttggctgagtttggaaattctttgtcttctggtataacagaggacaaaactcctctcggtcccggggattcgttgataatatggcctacagtagaagacgtcagatgttctttagaggttatccgcacaatgattacatcttttcttatatagattattgatttttcttctgaaccgtgaaatcttcaaaccaaagggttatgctgctggcaatgcaattccgagcccattgaagaacgtggagaaaccattcttgaaaaagtattgggctagatggaaagcggatcatagcgctcgcgggtaatttagaaaaaccaaacctttacaaatccaacttatgagtactactcaattctgatcctttttaatgtaacagtcgtgccatgccacatataaagacgttcacacgttacaacgaccagaagattgcgtaaagttcatcaagtctcaatctgtagttgctctgttagtaccttttgtgattaatgttcttgttttgcttccacagatggttcttactaacctcatcgaatcttagcaaagcggcctggggagcacttcagaagaacaattcacagttgatgattcgttcctacgaggtaaaattccaaaacctgtgttttcatgtatcaaagtctgatctttgtaaccactaactacattccattgactgtaatattgttagttgggcgtcttgtttttaccatctccaataaaaacacagggttgtgtattttcgtgcactgagagcaacccgagtgttatgaaggtaagaagatctaaaattccaaaacctgtaaacccggacacaaactgtgatctttccctcttaattgtgctttgtcaacaggcaaaacaagagacgaaagacgaggtagagaagaggagtaagctagtgacaatgacctggcaaggagaccgagatttgcctgagataatctcattaccagttccttatcaactacctcctaagccatactcacccgaaggtattttccctattcattatccagcaaatataacttctttctttctcaagttattaacgtttttactggcattgtgattttcagatgttccatggtcatgggaccgaggctactcgaagaaagatgtgtatggacaagtctggccaagatagttgatgatagctttagtagctctatgacttgagacttgagagagtggctttatgggttttactcactcagatattgaagactttataatctttaatttaatgctaagcgatgaacaacca

SEQ ID NO: 345 - DNA, 1023 bp, Arabidopsis thaliana
ttaattaaaaaggattcattagcaagtgtttgtgaaagggagagagaaatggaggaaggtctaaagattcaatctttggtcatttatccgatcaaatcttgccgtggaatctctgttcctcaggctaccgttactcatactggttttcagtgggaccggtattggttagttgttaactataaaggaagagcatacactcaaagagttgagccaacccttgctcttgttgaatcggagttgcctaaggaagccttcttggaagattgggagccaacaaatgactcattgttggtgataagagctcctggtatgagtccgttaaagataccgttgactaggccaagctcggtagcagaaggtgtgtcgatgtgggaatggtctggctctgcttttgatgaaggagaagaagctgcgaaatggttttcagattatcttggaaaacaaagccgtttggttcggtttaataaagatactgaaactagaccttcacctcctgagtttgcagcgggttactctacaacattcatggatatgtttccgtttttggttgcatctcagggttctttagaccatttgaatacccttctgccagaaccggtgcctataaaccgttttagacccaacattcttgttgataattgtgatcctttcggtgaagatctttgggatgaaatcaaaataaacgatttagtcttccaaggagttaggctatgtagccgctgcaaggtaccaactgtgaatcaagaaaccggggttatgggtaaagcagaaccaactgaaactctgatgaaattcagatcagacaatgtcttaatgcctgacaagaaaccgcgtggaaaggttttctttggcaaggagatggtttggaattggaacttaaccaacactgaaggcgaaggaaagaaaacaatcaaagttggtgataccatctcagtcataaggaagatcccttccagagctgaagcagctgtttaagtcaatacataaacatgttgcttcttcttcttctgttgtgggcgcgcc

SEQ ID NO: 346 - DNA, 1040 bp, Arabidopsis thaliana
ttaattaacttgaatcatggcctcgagaattgctaaagatgtgactgaattgattgggaacactccattggtgtatttgaacaatgttgctgaaggatgtgttggtcgtgttgctgctaagcttgagatgatggaaccgtgctctagcgtcaaagacaggattggttttagcatgatttctgatgcagaaaagaagggtcttatcaaaccaggagagagtgtgctgattgagccaacaagtggaaacactggagttgggttagcattcacggcagctgccaaaggctacaagcttattattacaatgccagcttctatgagtactgagagaagaatcattctcttagcttttggagttgagttggttttaactgacccagctaagggcatgaaaggagctatcgcaaaggcggaagagattttggcgaaaacacccaatggttacatgcttcagcagtttgagaaccctgccaaccctaagatccactatgagactacgggacctgagatatggaaaggcactggtggcaaaatcgatggctttgtttctgggattggtactggtggtaccattacaggtgctgggaagtatcttaaagaacagaacgcaaacgtcaagctgtatggagtggagccagttgaaagtgctattctatccggtgggaagccaggtcctcacaagattcaagggataggagctggttttataccaagtgtattgaatgttgatcttattgacgaagttgttcaggtttcaagtgatgaatccattgacatggcaaggcagcttgctcttaaagaaggtcttcttgtgggaatatcatccggtgcagcagctgctgcagcaattaaacttgcacagaggccagaaaacgctgggaagctatttgtggcgatattcccgagtttcggggagaggtatctatcaacggtacttttcgatgcgacaaggaaagaagcggaagccatgaccttcgaggcttgaacattctccatttcttcttaagagacgccaaaataaaagagatgttcggcgcgcc

SEQ ID NO: 347 - DNA, 1294 bp, Arabidopsis thaliana
ttaattaaatgcaaaccatttcgcctgcgttctcgtgcgatctcaaatccgtaattcaaccgaatctaacggctaagaaagcgcgttactctcacgtaaatggaaagcgcgtgtctgttcgttgcagttacaggtctgagtcgtttagcttccctaacggtgttggctcaagccgagccgattggcaaagctcatgcgccatcttagccagtaaagtagtttcggctgagaattcaagctccgtcgccgtcgttaacggacacagtaacggctccgttgatttaagccttgttccgtcaaagtcgcagcacaacggaaagcctggattgattcagccgttaacgataacagatctatctcccgcgccgtctcatggatctactcttcgtgtcgcgtatcaaggagttccgggagcgtactccgaagcggccgccggaaaagcttacccaaactccgaagctattccttgtgatcaattcgacgttgcgtttcaggcggtggagctttggatcgccgatcgtgctgttctcccagttgagaactctctcggtggttcgattcatagaaattacgatcttctcctccgtcaccgtctccacatcgtcggagaagttcagatcccggttcaccactgtctcttagctcttcccggagttcgtacggattgcatcacgcgagtgatttcgcatcctcaagctctggctcagacggaaggatcgctcaacaaactcactccaaaagcagcgattgaagcgtttcacgacacagccgcggcggcggaatacatcgctgctaacaacctccacgacacggcggcggtagcgagcgcaagagcagctgagctctacggacttcagattctcgccgacgggatccaagacgacgcaggaaacgtcacgcgcttccttatgttggcgcgtgatccgatcattccccgtaccgatcgtccgtttaaaacgagtatcgttttcgcagctcaagaacataaaggaactagcgttttattcaaagtgctttccgcgtttgcgtttcgaaacattagtttgacgaaaatcgaatcgcggccgcatcagaattgtcccgttagagtcgtaggcgacgaaaacgttggaacatcgaagcactttgagtacacattctacgtcgacttcgaagcgtcgatggcggaggcgcgtgcacaaaacgcgttagcggaggtgcaagagtacacgtcattcctcagggtgctgggaagttacccaatggatatgacgccatggtccacgttacctagcgaagacgtatgaggcgcgcc

SEQ ID NO: 348 - DNA, 1414 bp, Arabidopsis thaliana
ttaattaaatgatcagtctctccggactaaccagttctgttgaaagtgatctcgatatgcaacaagcgatgctcaccaataaagacgagaaggtactcaaagctttagagagaacaaggcaattggatattcccgatgaaaagacaatgccagtgcttatgaagctcctagaagaggctggtggcaattggtcgtatataaagttggataactatactgcactggtcgacgctatttattctgttgaggatgagaataagcaaagtgaaggttcatctaatggttcctccattcaggtagtccagaagcagccacagcttagtaatggtgatcgcaagaggaaatataaaagcagaattgctgacataactaaaggttcagagagcgttaaaatccctcttgtcgatgatgttgggagtgaagctgtgccaaagtttacttacatccctcacaacattgtttaccaaagtgcttatctccacgtgtctctggctcgaatctctgatgaagattgctgcgcaaactgcaaagggaactgtctttcagctgactttccttgcacttgtgctcgtgaaaccagtggagaatatgcttataccaaagaagggctgctaaaggaaaagtttctggacacctgtcttaagatgaaaaaggaaccagattcgttccctaaagtttactgcaaagactgccctttggagagagatcacgataagggcacatatggaaaatgtgatggacacttaatccgaaagttcatcaaggaatgctggagaaagtgtggatgtgatatgcagtgtggaaatcgagtagtacagagagggataaggtgccaactgcaggtttactttactcaagaagggaaaggatggggtcttagaacactgcaagacttgcccaaaggaacctttatctgtgaatacattggtgaaatattgaccaacacggagttatacgatcggaatgttaggtctagtagtgaacgacatacatatcctgtaactctggatgcagactggggttctgaaaaggatctaaaagatgaagaagctctctgcctggatgccacaatctgtggaaatgtcgcaaggtttatcaatcacagatgcgaggatgcaaacatgattgatattccgatagagatagagacgcctgacagacattattatcatattgctttttttaccctacgagacgtgaaggccatggatgagttgacatgggattacatgatagacttcaatgataaaagtcatcctgtaaaggcatttagatgttgctgcggaagcgaatcatgcagagacagaaaaataaaaggatctcaaggcaagtctatagagagaagaaagattgtttctgctaaaaaacaacaaggttccaaagaggtgtctaaaaagcgcaaatgaggcgcgcc

SEQ ID NO: 349 - DNA, 862 bp, Arabidopsis thaliana
ttaattaaatggttctcactcacaacgtattggcagttacatttggagtcctgggtaacatcatatcgttcatcgttttcttggcaccagtgccaacttttgtaagaatctgcaagaaaaaatcgatagaaggttttgaatcacttccctacgtgtcagccctctttagcgcgatgctatggatttactatgctctgcaaaaagatggagcaggcttccttctcattaccataaacgctgtgggatgcttcatcgaaaccatctacatcatcctcttcatcacctatgctaacaagaaagctagaatatcaactttgaaggttcttgggctcttgaatttcttgggttttgctgctattattctcgtctgcgagctcctaaccaaaggatcgaaccgtgagaaagtccttggagggatttgcgtcggattttctgtttgtgttttcgcagctcctttgagcatcatgagagtggtgatacgaacaaagagtgtggagtttatgcctttctctctatcattgtttcttacaatcagcgccattacgtggctcttctacggtcttgctattaaagacttctacgttgcgcttccaaatatattgggtgcgtttctcggagcagtccaaatgattctatacgtcatattcaagtactacaaaactccactagtggttgatgagacagagaagcccaaaacggtgtcggatcattccatcaacatggtcaagctttcatctactccggcttctggtgatcttacggttcagccgcagactaatcctgacgtgagtcatcctattaaaactcatggtggtgacttagaggaccagatggacaagaaaatgccaaactaaggcgcgcc

SEQ ID NO: 350 - DNA, 1249 bp, Arabidopsis thaliana
ttaattaaatgggagaacggtttttccgaaatgagatgccggagtttgtaccggaagatttatccggagaagaagaaactgttaccgaatgtaaagattcgttgacgaaactgctatcacttccgtacaaatcattctcagagaagcttcacagatatgctctaagcatcaaagataaagtagtctgggagacatgggaacgatctggaaaacgtgttcgagattataacttgtatactggagttcttgggacagcttatctcttgttcaaatcttatcaggttactagaaatgaagatgatcttaagctatgcttagagaatgttgaagcttgtgatgtagcttcaagagattctgagcgagtgacatttatatgtggctatgctggtgtatgtgctcttggtgctgttgcagcgaagtgtttaggtgatgaccagttatatgatcgttacttagcccgtttccgagggattaggcttcctagtgacttgccatatgagttgctatatggtagagcaggatacttgtgggcgtgtttgttcttgaataagcatattggtcaggagagtatatcatctgaacgaatgagatcagtggttgaggaaatcttcagggcaggaagacaactcgggaataaaggaacttgtccattgatgtatgagtggcacgggaagaggtactggggggctgcacacggtttagctgggatcatgaatgttttgatgcatacggaacttgaaccagatgaaatcaaagatgtcaaaggtacactaagctatatgatacaaaaccgttttcctagcgggaattacctatctagtgaaggaagcaaatcagatcgccttgttcactggtgtcacggtgctcctggtgttgctctcacacttgtaaaggcagctcaggtttataacactaaggaatttgtagaggcagcaatggaggcaggagaagttgtgtggagccgtggattgcttaaacgagtaggaatctgtcacggtatcagcggaaacacatacgtgtttctttctctataccggttaacaagaaacccaaagtatttgtaccgcgctaaagctttcgcgtctttcctactcgataaatcagagaagttaatctcagaaggtcaaatgcatggaggagatagacccttctctctctttgaaggtatcggaggaatggcctacatgttactcgacatgaatgatccaacacaagctctgtttccaggttacgaactctaaggcgcgcc

SEQ ID NO: 351 - DNA, 1024 bp, Arabidopsis thaliana
ttaattaaatgagtggtacagagttagatgagcctggaaagttaaaacgtgctgtcattgatgcttctgctggtggtgttgctggtgcgatttcacgtatggttacctctccccttgatgttatcaagattagatttcaggttcagttggagcctacagctacatgggctctgaaagattctcagctgaaaccgaagtacaatggtttgtttcgaacaacgaaggatatctttagagaggaaggtttatcgggtttctggcgtggaaatgttccagctttacttatggttgtgccttatacatccatacaatttgcagtcttacataaggtgaagtcttttgccgctggttcatcaaaggccgaaaatcatgctcaactgagcccttatctttcttacatcagtggggcactagcagggtgtgcagcaacagttggatcgtatccgtttgacctattgcggactgtattggcgtcccagggtgagccaaaggtgtatccaaatatgaggtcagcatttctgagtatagtgcaaactcgtggaatcaaagggttgtatgcaggattgtcccctactctgatcgagatcattccttatgctggtctgcagtttggcacctatgacacatttaaacgctggagtatggtatataataagcgataccgatcttcttcatcaagctcaacgaatccaagtgatagtctttctagctttcagcttttcctttgcggtttagcttcgggcactgtttctaaactagtctgtcatccgcttgatgttgtcaagaaaagattccaggtcgaaggtctgcaacgtcacccaaaatatggagcccgagtagagctgaatgcttacaagaacatgtttgacggtttagggcagatattaagatctgaaggttggcacgggctttataaaggcattgttccatcaaccattaaagctgcacctgctggtgctgtaacatttgtggcctatgaacttgcatccgattggtttgaggcaaatttgacctgaggcgcgcc

SEQ ID NO: 352 - DNA, 1312 bp, Arabidopsis thaliana
ttaattaaatggatggatcaaagcatccatcagtctttcagaagctacatggacaatcttacttgatcaatagactttctccgagtgtgcaagctcgtggttactgtgtctctggtgcttatgtcaatggaggtttgcagagtctattgcagccaactagccatggcgttggctcgtctcttatacctcatggttcatttcctgtattagctcacgctcctagtgagaaaactggtactggtttcttgatcgatttccttatgggaggagtctcagctgctgtttcgaagacggcagccgcgcctatagagcgtgtgaagctcttgattcagaatcaagatgaaatgatcaaagctgggcgtctctctgagccatataaaggaatcagtgattgttttgctcgaacagtcaaagacgaaggaatgcttgctctttggagaggaaacactgccaatgttatcagatacttccccactcaggtttgttttctcttctttgacgtggtatttgtatagacgtcgagatgggtatgctaagcaaatagttttgttttgcaggctttaaactttgcgttcaaagattacttcaagaggctgtttaacttcaagaaagaaaaagatggctactggaagtggtttgcagggaacctggcgtctggtggtgcagctggtgcatcatctctgctttttgtgtactctttggattacgctcgtacccgtttagccaatgatgcgaaggcggccaagaaaggtggtcagcggcagtttaatggcatggtcgacgtgtacaagaagactatagcctctgatggcattgtcgggctttaccgtggtttcaacatctcatgcgttggaattgtcgtgtaccgggggctttactttggattgtatgattccttgaagcctgtggttctagttgatggtctccaggtaaaaaacaaagaaaactcctcacttcaacatattgagtcctctgttactgtttactcattgctataatctgtacaggatagcttccttgctagtttcttactgggatggggaatcaccattggagctggattggcgtcttacccaattgacacggttcgcagaagaatgatgatgacgtcaggtgaagcagtgaagtacaagagctctcttcaggccttctctcagatcgtcaagaacgaaggggccaagtcactcttcaagggtgcaggtgccaacatccttcgtgcggttgcaggcgctggtgtactggccggctatgacaagctccagctcattgtgttgggtaagaagtatggctctggtggtggctaaggcgcgcc

SEQ ID NO: 353 - DNA, 1450 bp, Arabidopsis thaliana
ttaattaagtggtttggagtgcttgataagtttaatcagggcccttgatatggggtcctgcttatcatcatctggaggtggaggaagcaggagatctctccatggctctcctcatgttcctggtcctgggaggaggaagaggcctcccaagaggagacctgggtcttgtagttcttcgtttgataacaccgaggagccacttcttcataggatccctggaaggatgtttttgaatggctctacagacaccgtgtctctcttctctcaacagggcaagaaaggacctaatcaggacgctatgattgtttgggagaattttgggtctatggaggacactgtgttttgtggtgtttttgatggtcatggtccgtatggtcacattgttgcaaagagagtgagggatttgcttccactcaagttaggttctcatttggagtcctatgtgtcccctgaggaggttcttaaagagattagccttaacactgatgatagaaagatctcagaagaccttgtacatatatctgccaatggagaatcacgagtctacaataaggattatgtgaaggatcaagatatgattcaaatgctaataggctcaattgttaaagcctacagattcatggataaggaattgaagatgcaagttgatgttgattgtttttgcagtggaacaactgcagttaccatggttaagcagggtcaacatcttgttatcgggaatatcggggattcaagagcagtattgggtgtgaggaacaaagacaataaacttgttccttttcaattaactgaagatctcaaaccagatgttccagctgaagcagaaaggataaagagatgcagaggacgtatatttgctcttcgagatgaaccgggagttgcccgtctgtggcttcctaaccacaactcacctggtctagccatggcacgtgcttttggagatttttgcctcaaagacttcggtctaatttctgtacctgacgtctcctaccgacgcctcactgagaaggatgaatttgttgtcttggcaactgatgggatttgggatgcattgacgaatgaagaggttgtaaagatagtagcgaaagctccaacgcgttcctcagcaggtcgagcattggtggaggctgcagtgcgtaactggagatggaagttcccgacttcaaaagtcgatgactgtgccgtagtttgcctattccttgactccgaaccaaacagattgtcaactgcttctttctcaaaagaaaaacacatcaacaatggcgttactgaacctgaaccagacacagcatcatcatcaactccagactcaggaaccggatcgcctgagctcaatggagtcaacagaatcgatacacttgtgaatctcccagtatatgtcccaaccaaagagtaggaagatagaacagagccaggagctcaatgtctcctagctctatgttggcgcgcc

SEQ ID NO: 354 - DNA, 1462 bp, Arabidopsis thaliana
ttaattaaatgaagaacttaaagatggttttcttcaagatcctctttatctctttaatggcaggattagccatgaaaggatctaagatcaacgtagaagatctccaaaagttctccctccaccatacacagaacaacctccaaaccataagccttctattgtttcttgtcgtttttgtgtggatcctctacatgttaacccgacctaaacccgtttaccttgttgatttctcctgctaccttccaccgtcgcatctcaaggtcagtatccaaaccctaatgggacacgcaagacgtgcaagagaagcaggcatgtgttggaagaacaaagagagcgaccatttagttgacttccaggagaagattcttgaacgttccggtcttggtcaagaaacctacatccccgagggtcttcagtgcttcccacttcagcaaggcatgggtgcttcacgtaaagagacggaagaagtaatcttcggagctcttgacaatctttttcgcaacaccggtgtaaaacctgatgatatcggtatattggtggtgaattctagcacgtttaatccaactccatcactcgcctccatgattgtgaacaagtacaaactcagagacaacatcaagagtttgaatcttggagggatgggttgcagtgccggagttatagctgttgatgtcgctaagggattactacaagttcataggaacacttatgctattgtagtaagcacagagaacatcactcagaacttatacttggggaaaaacaaatcaatgctagtcacaaactgtttgttccgcgttggtggtgctgcggttctgctttcaaacagatctagagaccgtaaccgcgccaaatacgagcttgttcacaccgtacggatccataccggatcagatgataggtcgttcgaatgtgcgacacaagaagaggatgaagatggtataattggagttaccttgacaaagaatctacctatggtggctgcaaggactcttaagataaatatcgcaactttgggtcctcttgtacttccattaaaagagaagctagccttctttattacttttgtcaagaagaagtatttcaagccagagttaaggaattatacaccagatttcaagcttgcctttgagcatttctgtatccacgctggtggaagagctctaatagatgagctggagaagaaccttaagctttctccgttacacgtagaggcgtcaagaatgacactacacaggtttggtaacacttcttctagctcaatctggtacgagttagcttatacagaagctaaaggaaggatgaaggaaggagataggatttggcagattgctttggggtcaggttttaagtgtaacagttcagtatgggtggctctgcgagacgttaagccttcagctaacagtccatgggaagactgtatggatagatatccggttgagattgatatttaaggcgcgcc

SEQ ID NO: 355 - DNA, 3048 bp, Arabidopsis thaliana
ttaattaagttatgggcgaacaacaaatctcagttacagtgcctcgtgatagaactgatgaacaggcaatcttggctttgaagaaaggtgcacagcttttgaaatgtcgaagaagaggaaacccaaagttttgtccttttaaactctcaatggatgagaagtacttgatttggtactcaggagaagaggagagacaattgagattgagttctgttataacgattgttcgcggacaaatcacaccaaactttcagaaacaagcacaatctgatcgaaaggaacagtctttttcactcatttatgcaaatggagaacacactcttgatctcatatgtaaggataaagcacaagcagactcatggtttaaaggtcttagagctgtgataacaaagcatcataacattagaaactctgtgaatcatcggagtagtaggggagctcaaagttgcatcaatagtcctgcgggttttatgcgaaggaaacagaatcttggacttcttgaagagactcctgacgtcactcagatacgtagcttatgtggaagtccatcgacgttacttgaagagcggtgtttgtcgaacgggttgtcatgttcttcagatagttttgctgaatctgatgccttgggtccagtttcttcttactatgaaacagattatgatttcaggaactcggattgtgatcgtagtacaggttcagaactttgcaggttttcatcacaaagatttgctgcttctcctcctctttctatcataacacagccggttacaagatccaatgtccttaaggacattatgatatggggagctataacgggtcttatcgatggatcgaagaatcagaacgatgcgttgtctcctaagcttttggaatctgctacgatgtttgatgtacagagtatatctctaggtgcaaaacatgctgcgttggttacaagacaaggtgaagtgttttgttgggggaatggaaatagtgggaagcttggacttaaagttaacatcgatatcgaccatccgaaacgcgttgagtctcttgaggatgttgcagttcgatcagtggcttgtagtgatcatcaaacgtgtgctgttacggaatctggtgagctgtatttatggggaattgatggtggaaccattgaacagtcaggaagccagttcttgactcggaagatatccgatgttcttggcggatctttgactgttttaagtgttgcttgtggcgcgtggcacacggcaattgtgactagttctggtcagcttttcacttatggtagtggaacttttggagttcttggacatgggagtcttgagagtgttacaaagccgaaagaagttgagtctttgagacgcatgaaggtcatatctgtctcttgtggaccgtggcacacggctgctatagtggaaaccgcgaacgaccggaaattctacaacgccaagagttgtggaaagctgtttacttggggagatggcgataaaggacggttaggacatgctgatagcaagagaaagcttgtgccaacttgtgttactgaactcattgatcatgatttcataaaagtctcttgtggatggactttaactgttgctttaagcatttcaggaacggtttatacaatgggaagctcgatccacggacagttaggatgtccgcgggcaaaggataagtcggtaaatgttgttttaggcaatctaacacgacaatttgtcaaggatattgcttcaggttcacatcatgtagctgttctaacttcatttggaaatgtttatacttggggaaaaggcatgaatggacaacttggtttaggtgacgttagagatagaaactctcctgttcttgttgagcctttaggtgataggttggtagaaagtatagcttgcgggttgaatttgacggctgcgatctgtttacacaaagagatctctttgaatgatcaaaccgcttgtagttcttgcaaatcagcttttggattcacaaggagaaagcataactgttacaactgtggtctattgttttgcaatgcatgtagtagcaagaaagcggtaaatgcttcgttagcaccgaataaaagcaagctttctcgggtttgcgattcttgctttgatcatctatggagtataacagagttttcaagaaatgttaagatggataatcacactccgaggatgcagatggttacacgaagagtatctgaggatttgacagaaaaacaatcagagaatgagatgcagaatcttccacaagctaatcgatcttcggatggacagcctcgatggggacaagtctctggtccttctctgtttcgtttcgataagatttcgacaagttcttctttgaatctttcagtctcagcaaggcgaacatcttcaacgaagatttcaacctcgtctgagtcgaataagatcttaaccgaagaaatcgaaaggctaaaagccgtgataaaaaatctccagaggcagtgtgaacttggcaatgagaagatggaagaatgtcaacaagagctcgacaagacatgggaagttgctaaagaagaagcagagaaatcgaaagctgctaaagagataataaaagccttggcatcgaagctccaagcgaataaagagaaaccgagtaatcctctgaagaccggcattgcatgcaatccttctcaagtctcaccaatctttgatgactcaatgtccattccatacctcacaccaatcaccacagctcgttcacaacacgaaaccaaacaacatgtagagaaatgtgtcacgaaatcctcgaaccgtgacagcaacattaagctattagtagatgcatcgccagccatcacaagaacagggtatctccaaaacgaaacacaagactcgtcagcagaacaagttgagcaatacgagcccggtgtatatataactttcacggccttgccttgcggtcagaagacgcttaaacgcgtacggtttagtcggaagaggttttcagagaaggaagcacaaagatggtgggaagagaagcaggttttggtctataacaagtatgatgctgaaatatgaaactaactatttaaat

SEQ ID NO: 356 - DNA, 565 bp, Saccharomyces cerevisiae
aactctttgtttcttgtttgttgattaacccttaattaatatgaacggcggaggcaagaatgttttgaataaaaactcagtgggctcagtatcagaagttggtccggactcaacacaagaggaaacgccacgagatgtccgtcttttgcatctgctcctcgcatcacagtcgattcatcaatatgaggaccaagtaccgctacaattgatggattttgcacataggtacacacaaggagtccttaaggatgcgttggtttacaacgactacgctggcagtggaaattctgccggcagtggattaggagtagaagacatacggcttgccattgcagcgagaacacaatatcaatttaagcctacggcacctaaggagctcatgttacagttagctgcggaaagaaacaagaaggcattacctcaagtgatgggtacgtggggtgtcaggcttcccccagaaaaatattgtctcacagcgaaggagtgggaccttgaggacccaaagtctatgtgaatttaaatacccagcaaattggagctctgcagagctttcgttcgtatcatc

SEQ ID NO: 357 - DNA, 2618 bp, Saccharomyces cerevisiae
attcatttatttgtcagctttcaaactctttgtttcttgtttgttgattaacccttaattaagatgcatagcaacgtatttgttggtgtcaaaccaggctttaatcataaacagcacagcaaaaagtcacgtttcctagaaaatgtctctagtcattcaccagaactgcctagtaactatgattacgttttgcttcctataacaacgccaagatataaggaaatagttgggcaagttttcaaagatttccaaagacaatccatacagaactggaaaccgcttcaaattcctgaaccgcagttgcaggatatctgtatacccccgttcaacgtcaagaagctagacaatgacgatacgccgtcttacatagggctgttatcctcttggctggagctggagagtcgcgatccaaatgtaagagatcttggcttaaaggtccttctaaacgaatgtaagtacgcgaggtttgttggaatcaataagctaatattggcgcctccacgggacctgtccaacctgcaattgtatggacagatgatttacaggctcctgcaaaatcgcatcgtctttgctgcgcctgcgttaaccatatccatttctctgccactttacgaagacagcgatccattggccacttgggaactgtggaataccgtgcggaaacaatgcgaatatcatccctctttgactatctctttggctttgccaagaaccaggactccttcgtatgtgctgaatagatggttagccgaacccgtctcgtgtcttttggtatcttcatccatctttgccagtaatcagtacgattatcccgttttacacaagtttaaccagaatttgattttaaagttccaaaaggttaatggagattcacaaattttgggtaatgaattatgcgtgatattgcatgggatggagaaatatgccaataatgttaagggcggagaatctgcctatttggaatatataaactacttattgaaaaagggcgacaaagtattaaattccaatagtaatcaccaatttttgctccaagaggactctcggataatgccgcctctgaaacctcattcagataatttattaaattccacatatttgacttttgaaaaagatttggtgaagtacgatctttacgaatctgccatattagaggcgcttcaagatcttgctcctcgagcgagtgccaagagaccgttggtgatcctagtagccggtgcgggaagaggacctttagtggatcgaacttttaagataatatcaatgttgtttatggatagtaaggtttctataattgccattgaaaaaaatccacaggcatatctgtacttgcaaaaaagaaatttcgactgttgggataatagagtgaaattaatcaaggaggatatgaccaaatggcaaatcaacgagccgtcggaaaagcgtattcagatagatctgtgcataagtgaactgctgggttcgttcggttgcaatgaattatcaccagaatgtctctggtctattgaaaaatatcattcccacaatgacacaattttcataccgaggtcatactcttcatacatagcacccatttcgtcaccattattctaccaaaaactctcacaaacaaatcgctctttggaggcgccctggatagtccatagagtgccatactgtatattatcctcaagggtaaatgaagtgtggcggttcgagcatcccatggcccaaaaagatactgtccaagacgaagatgattttacagttgaattttctcaaagttcattaaatgagttcaagataaagcaccgcggcgaaatccatggctttatcggattcttctcggcaaacttatataacaatatattcttgtcaactttgcccaatgacagcacagtccgtttaaaatttagcgaagaaacgttgatgaataccagacgagaagaaaatctaatcaagaaatgtgaccatacaccaaatatgacctcgtggtctccaattatctttcctttgaagcaaccaatatcctttatagatgactccgaactttctgtgctgatgtctcggatacactccgatacagaacaaaaagtttggtatgaatggtctttggagagtttcatataccttatgttgtcaaattacacttcggcggtaactgctgcaagcatgactattccgaggtctatagttacagatgacactaaaactttagcccataatcgacattattcagcgactaccaatcaaaagctagataatcaaattgatcttgaccaagacattgaaaacgaagaagaacagggattcctatccaatctagaaactggttggcaaagcgtacaagatattcacggactcagcgaaaccgccaaaccggaccatttagattctatcaataagcctatgtttgatctcaaatctactaaagcgcttgaaccctctaacgaattgccaaggcacgaagacctcgaggaagatgttccagaagttcatgtcagagtcaagactagtgtttccacgctacataatgtctgtggcagagccttttccctgcctctgtgaatttaaatacccagcaaattggagctctgcagagctttcgttcgtatcatcggtttcgacaacgttcgtca

SEQ ID NO: 358 - DNA, 1000 bp, Saccharomyces cerevisiae
aactctttgtttcttgtttgttgattaacccttaattaagatgagcggtgaattagcaaattacaaaagacttgagaaagtcggtgaaggtacatacggtgttgtttataaagcgttagacttaagaccaggccaaggtcaaagagtagtcgcattgaagaaaataagactagagagtgaagacgagggtgttcccagtacagccatcagagaaatctcattattgaaggaattaaaagacgataatattgtcagattatacgatattgttcactctgatgcacacaagctatatcttgtttttgagttcctcgatttggacctgaaaagatatatggagggtattccaaaggaccaaccgttaggagctgatattgttaagaagtttatgatgcaactttgtaagggtattgcatactgccactcacaccgtattctgcatcgtgatttaaaaccccagaacttattgattaacaaagatgggaatctaaaactaggtgattttggcttagcgcgtgcttttggtgttccgttgagagcttacacacatgaaattgttactctatggtatagagctccggaggtattactgggtggaaaacaatatagtacaggtgtcgatacatggtccatcggctgtatatttgccgaaatgtgtaacaggaaaccaatcttcagtggcgatagtgagatcgatcagattttcaagatattcagagtattgggaacgccgaatgaagctatatggccagatattgtctacttgcctgatttcaagccaagctttcctcaatggcgcagaaaagacctatcacaagtggtaccaagtctagatccacgcggtattgatttgttggacaaactcctcgcgtatgaccctattaaccggattagcgccagaagagcagccatccacccctacttccaagaatcataaatttaaatacccagcaaattggagctctgcagagctttcgttcgtatcatcggttcgacaacg

SEQ ID NO: 359 - DNA, 2233 bp, Saccharomyces cerevisiae
aactctttgtttcttgtttgttgattaacccttaattaagatgctcaattctgcgttactgtggaaggtttggctacgaatagacaactccactgatgaagtaaaccaaccaattgctgtacagttcgatgaaatagatactgttgatgatttgaagagcaggttttttcagaaactgagttcgactcgatggcgagaaattaacgataatgcttccattgcaataggcctctacgcacctaaatttgacaatcaagccgacaataccagtagtaacaacactaacgataatagttgtcgaagtaagagtaacggtgctggaagtggcgccaacctttccgttaatagcaataccaagagttcagtgagccccacagcaggatcatttggtctttcaaaagaccttgcaaaggacaggaatgttctccagcatcctaaacctacgcagaaaagaggagcattatacgacgcctttgccgccgtgccgacagtggccgcgactaccaatgtggattttcctcccaacgaggcgccaatgctaagcccgcaaagaccatactctactagtcctaaacagtttccagcaacaactaaaagtccgttactgcgatttgcctcagtctcaccctaccctaaatttcattctgataatcaaattatggcatcagctggtcttacatacgtctcaccgcataataaaaataaatacacaaggccgttgattagaaaaggtttaaattttaccacagaatcagttaatgattgcacttataaaatcatctttgagccggatgaattggctattaacatatataaggaactattcggaaccatgggttcccaacctgcatcgcagcctttgctgatattttcgaatgttaatttacgccaggatgtaccgcctttagatatcttaaatgttgtagactatgttcctacgaatgaagaaatttcgcagcagaaaactcaaccaacagaccatggggccgttggtgtttttcatctagacgaccatatttctccgggcgaacaaggtcttaagcaaacaattggtgataaagcagatcttaaaggtaaagatggcaatagcagccctcaggaatttaaattaataactgatgaagagcaattgagaagagcgtcacaagaactgaaggatgaggaaaaggatgccgagtctccttggcaagcaatcttgctgttaccaaaaggttataaaggaggggtagattttcgaaataaaccagtggcccacacggattcatctttcaataatgaagacacaattactcattcagagttagaagtgaacaccggatccccttcgcaagaaagcggatcacttaatgaagctggtataggcataacgcaacccatgtcggaagtacaaagaagaaaagaggacgttacgcccgcatcaccaatattaacaagtagtcaaacgccgcattactcaaactcgctttataacgcaccttttgctgtttcctctccaccagatcctttaccaaacctttttaccaccacaagtgaaaaagttttccccaaaattaatgttttaatagttgaagacaacgtcatcaaccaagctatcttaggttcctttctgaggaaacacaaaatctcatataaactggctaaaaatggtcaagaagctgttaatatttggaaggaaggcggtcttcatttaatatttatggatttacagctgcctgtcttgtctggtatagaagctgccaagcagattagggacttcgaaaaacaaaatggcattggcattcaaaaaagtctcaataactcacactccaatcttgaaaaaggtacttcaaagagattctctcaggcgcccgtgattattgtagcattgaccgcatctaactctcagatggataaaagaaaagcacttctttctggttgtaacgactacctgactaaaccagtgaatttacactggcttagtaagaaaattacagagtggggatgtatgcaagccttgattgattttgacagctggaagcagggagaaagccggatgaccgacagtgttttggttaaatctccacagaaacctattgcaccttccaaccctcactcattcaaacaagcgacatctatgacccctacacacagcccagtaagaaaaaattcaaacctctcgcccactcaaatagaattgtgaatttaaatacccagcaaattggagctctgcagagctttcgttcgtatcatcggt

SEQ ID NO: 360 - DNA, 689 bp, Saccharomyces cerevisiae
tttgtcagctttcaaactctttgtttcttgtttgttgattaacccttaattaagatgaaatacatacccccattaaatttttcgccagtggtgagcacggatgtatcgttatatcgatcgggatacccgatgccgttaaattatagtttcatcaagcatcagttacacttgaagaccataatatatattggcgataaagataggcctctcgaagaatatcaaagcttcctggagtcagaaaagataaaatactatcacatatttatggattcaagccgcgatgaaggaattcaagaaagaatgaaccaggtcttgcacttggtgctggatgtcagaaactatcccatcttagtgcattccaataagggcaagcaccgtgttggtgtagttgtgggaatcataagaaagttgttacagggatggtccactgcaggtatataccaagagtacgggttattttctggtgggatgaaagatggagtagatttggagtttatcacaatgttcgaaaccaatctgaaaataccgagaaacgttatccctggctttgctaaacactgcttgtatttgaatgagctagaggctgcggaaggaagtgatgatgagtcaggaagtgagtctattctcactgccaagcaaccaatatgaatttaaatacccagaaattggagctctgcagagctttcgtt

SEQ ID NO: 361 - DNA, 841 bp, Saccharomyces cerevisiae
agctttcaaactctttgtttcttgtttgttgattaacccttaattaagatggccgatgaggaacgtttaaaggagtttaaagaggcaaacaagatagtgtttgatccaaataccagacaagtatgggaaaaccagaatcgagatggtacaaaaccagcaactactttccagagtgaagaggacataaaaagagctgccccagaatctgaaaaagacacctccgccacatcaggtattgttccaacactacaaaacattgtggcaactgtgactttggggtgcaggttagatctgaaaacagttgcgctacatgcccgtaatgcagaatataaccccaagcgttttgctgctgtcatcatgcgtattagagagccaaaaactacagctttgatttttgcatcagggaaaatggttgttaccggtgcaaaaagtgaggatgactcaaagctggccagtagaaaatatgcaagaattatccaaaaaatcggatttgctgctaaattcacagacttcaaaatacaaaatattgtcggttcgtgtgacgttaaattccctatacgtctagaagggttagcattcagtcatggtactttctcctcctatgagccagaattgtttcctggtttgatctatagaatggtgaagccgaaaattgtgttgttaatttttgtttcagggaagattgttcttactggtgcaaagcaaagggaagaaatttaccaagcttttgaagctatataccctgtgctaagtgaatttagaaaaatgtgaatttaaatacccagcaaattggagctctgcagagctttcgttcgtatcatcggtttcgacaacgttcgtc

SEQ ID NO: 362 - DNA, 1042 bp, Saccharomyces cerevisiae
aactctttgtttcttgtttgttgattaacccttaattaagatgaaaccgacacaggattcacaagaaaaggtttctattgaacagcagttagctgtagaatcgataaggaagtttttgaactcgaaaacatcttatgacgtgttgcctgtttcttaccgtttaattgtcttggacacctcgttgttagtgaagaaatcactgaatgttcttttgcaaaatagcattgtctctgcgccattatgggactccaagacttccaggttcgctggacttctaactactacagattttattaatgtcatccagtattacttctccaatccagataagttcgaattagtagacaaattacagttagatggattaaaagatatagagcgtgctctcggtgttgatcaactagatacagcttcaattcatccttctagacccttatttgaggcgtgtcttaagatgttagaatcaagaagtggtagaataccactgatcgatcaagatgaagagacacatagagaaattgtcgttagtgttcttacgcaatatagaattctgaagttcgttgctttaaattgcagggaaacacattttctaaagattccaattggggacttgaacattattacgcaagataacatgaaaagctgtcaaatgaccactccggtcatagacgtcattcagatgcttacccaaggtcgggtttcttccgtccctattattgacgaaaacggctacttaatcaacgtatatgaagcatacgatgtcctaggcttgataaaaggaggcatctacaacgacctgtcattgagcgtcggagaagcccttatgaggagaagtgatgattttgaaggtgtttatacatgcactaagaatgataaattatctactattatggataacatcagaaaagcaagggtgcatagattctttgtagttgatgacgtcggacggttggttggtgtcttgacgttaagcgatattctcaaatatatccttctaggtagcaactgaattaaatacccagcaaattggagctctgcagac

SEQ ID NO: 363 - DNA, 1779 bp, Arabidopsis thaliana
atgaattccgttcagcttccgacggcgcaatcctctctccgtagccacattcaccgtccatcaaaaccagtggtcggattcactcacttctcctcccgttctcggatcgcagtggcggttctgtcccgagatgaaacatctatgactccaccgcctccaaagcttcctttaccacgtcttaaggtctctccgaattcgttgcaataccctgccggttacctcggtgctgtaccagaacgtacgaacgaggctgagaacggaagcatcgcggaagctatggagtatttgacgaatatactgtccactaaggtttacgacatcgccattgagtcaccactccaattggctaagaagctatctaagagattaggtgttcgtatgtatcttaaaagagaagacttgcaacctgtattctcgtttaagcttcgtggagcttacaatatgatggtgaaacttccagcagatcaattggcaaaaggagttatctgctcttcagctggaaaccatgctcaaggagttgctttatctgctagtaaactcggctgcactgctgtgattgttatgcctgttacgactcctgagataaagtggcaagctgtagagaatttgggtgcaacggttgttcttttcggagattcgtatgatcaagcacaagcacatgctaagatacgagctgaagaagagggtctgacgtttatacctccttttgatcaccctgatgttattgctggacaagggactgttgggatggagatcactcgtcaggctaagggtccattgcatgctatatttgtgccagttggtggtggtggtttaatagctggtattgctgcttatgtgaagagggtttctcccgaggtgaagatcattggtgtagaaccagctgacgcaaatgcaatggctttgtcgctgcatcacggtgagagggtgatattggaccaggttgggggatttgcagatggtgtagcagttaaagaagttggtgaagagacttttcgtataagcagaaatctaatggatggtgttgttcttgtcactcgtgatgctatttgtgcatcaataaaggatatgtttgaggagaaacggaacatattggaaccagcaggggctcttgcactcgctggagctgaggcatactgtaaatattatggcctaaaggacgtgaatgtcgtagccataaccagtggcgctaacatgaactttgacaagctaaggattgtgacagaactcgccaatgtcggtaggcaacaggaagctgttcttgctactctcatgccggaaaaacctggaagctttaagcaattttgtgagctggttggaccaatgaacataagcgagttcaaatatagatgtagctcggaaaaggaggctgttgtactatacagtgtcggagttcacacagctggagagctcaaagcactacagaagagaatggaatcttctcaactcaaaactgtcaatctcactaccagtgacttagtgaaagatcacctgcgttacttgatgggaggaagatctactgttggagacgaggttctatgccgattcacctttcccgagagacctggtgctctaatgaacttcttggactctttcagtccacggtggaacatcacccttttccattaccgtggacagggtgagacgggcgcgaatgtgctggtcgggatccaagtccccgagcaagaaatggaggaatttaaaaaccgagctaaagctcttggatacgactacttcttagtaagtgatgacgactattttaagcttctgatgcactga

SEQ ID NO: 364 - DNA, 1611 bp, Saccharomyces cerevisiae
ctttcaaactctttgtttcttgtttgttgattaacccttaattaagcctttatatcaaccatcaaaggaagctttaatcttctcataatgtcacgatcccttttggtagagaatagtagaaccattaatagtaatgaagagaagggggtaaacgaaagtcaatatatcttacaaaagagaaacgtcccaaggaccattctcggtaatgtcacaaataatgcaaatatcctgcaagagatttctatgaacagaaaaattgggatgaagaacttctcaaaattgaacaacttctttcctttaaaggatgaggtttcgagagccgatgacttcacctcctcttttaatgacagtagacagggggtgaaacaagaagtactaaacaataaggaaaatattcctgaatatggatattccgagcaagaaaagcagcagtgctcaaatgatgactcttttcatacgaattcgactgccttgagctgtaatcggttgatatactctgagaacaagtctatttccactcaaatggaatggcagaaaaaaataatgagagaagattccaaaaaaaaaaggccaatatcaactcttgtagagcaggatgaccagaaaaagttcaagctccatgaattgactacagaagaagaggttctggaggagtacgaatgggatgacctagatgaagaagattgtgatgatcccttaatggtgagcgaagaggttaatgatatcttcgattatttgcatcacttggaaataatcacattgccaaataaggcgaatctctataagcataaaaatattaagcaaaacagagacattttggtgaactggataatcaagattcataataagtttggccttctgccggaaactctatatttggccataaacataatggatagatttctttgtgaagaggtggttcagttaaatagattgcaactggttggtacatcatgcctgttcatcgcatctaagtatgaggaaatatactcccctagcataaaacattttgcgtacgagacagacggtgcatgctctgtggaagatattaaagagggtgaaagatttatattggaaaaactcgattttcaaattagtttcgctaacccaatgaatttcttaaggagaatatcaaaagcggatgactatgatatccagtctaggacgttagcgaagttcctaatggaaatatctatagtggacttcaagttcatcgggatattaccgtcattatgtgcctcagcggcaatgttcctttcgagaaaaatgctgggcaagggcacctgggatggcaacttaatccattatagcggtggttacacaaaggcaaaactatatcccgtttgccaattactgatggattatcttgttggatctactattcacgacgagttcttgaagaaatatcaatcgagaagatttttaaaggcttccataatttctatcgaatgggcattgaaggtaaggaaaaatggatatgatattatgacattgcatgagtgaaggtgctagcctacacagaatactaaaacctcactgccatttaaatacccagcaaattggagctctgcagagctttcgttcgtatcatcggtttcgacaacgttcgtc

SEQ ID NO: 365 - DNA, 1159 bp, Saccharomyces cerevisiae
tttatttgtcagctttcaaactctttgtttcttgtttgttgattaacccttaattaagaaggcggcaagagagagatatcttctttgtcctttgaattatggcttttttgaatattttcaagcaaaaacgtggtgatgaagcttcacaactgagcgcaaagggacgggaggaaatttctcaatcgattaagatatgcaaaagtgacgatgctgctaacgaacatagctgctctggtgattgcaaaacagaaattgaagaaggagagcaggcttttgcgaaactaaagatcgaacatgaaactcctttgttgaactcttctaaaacgccaaaaattcacttcgttgtccccacctctcaaatcgattggcagcatgatgcctgcctcgaggacccaaagtcagtacagtataaaatttcccagtggtgtgataagaattcagctaaattttccaacgtgggcacaggtaagacactaaactgtgcagtttcatctttacctaaagatattatggatattgatgttatgcggggaaccaagaataatgtacttattttgccttacttcatttggctgaacgaccttagatcagatgacgtcgaagcaacgctggatggtttagttcctgatttattagacgagaatatttcaagagagaaattgctagaaacacgaccaaatgttgccgttgcacgtgaacgtgcatttgtatttatatgttcacatactacgagggataaacgatgcgggattacggcaccctatttaaagaaagtttttgacagtaaattacaggaacatgggctgtatagggacaattcggattacagggcagagggtgtcaaaattgcatttgttaatcatgttggtggtcacaaatttgctgcaaatgttcaaatttatttacgaaatccaaataccttaatttggttgggaagagtaactccaaccatagttccttctattgtcgaacatctgattgttcctgaagaaccaacgttgccgtttcccgaaaaagttcgctgtattaagaaatatcaaagctggtaaaggttgaccagcaaaatacaatcttttgacgccataaaaatttaaatacccagcaaattggagctctgcagagctttcgttcgtatcatcggtttcgacaacgttcgtca

SEQ ID NO: 366 - DNA, 1117 bp, Saccharomyces cerevisiae
tgtttcttgtttgttgattaacccttaattaaggtagaaaagtgagagaaggtgcactgacacaaaaaataaaatgctacgtataactgtcaaaactttgcagcagcgggcatccttccatcatagcttcaaacatattagcgttcctgatcttcatacccgtgctcaaaatgatcaaacaaactgttattgccaagaaataaacgcaaggctgccttcaaaaactgatccattagatcctcatatcaagcttcctcatagaacgcccaattacaataagcatgttttgctgttatcaccgggtgataggtttgctcaaccatggaaggtagcatggaatcataatttggatactaatacaaatcggccatataatgccattagtaaattgcgctcccatttaggtggttctccaggaatactaataaatgcggtgcatttgcaaaatgaatttattccaaggccaaaacaacacgatgaatggctttatttttttgttattcctgacatgaagctttatgtaattaaggaaacggacatcgaggaatttgcatcttttttagatgaaggagctattcaagcaccaaagctatccttccaggattatttaagcggtaaggccaaggcttcccaacaggttcatgaagtgcatcatagaaagcttacaaggtttcagggtgaaacttttctaagagattggaacttagtctgtgggcattataagagggatgctaagtgtggagaaatgggacccgacataattgcagcatttcaagatgaaaagctttttcctgagaataatctagccttaatttctcatattgggggtcatatttttgctggtaatgtcattttctataaactattcggcagagaaaagatgcaaaacaagctggattcattatggtttggtaaagtttacccacacaacttgaagctgttatgtgaaaacttggaaaacggtaaaatcatcgacgaaatgtacagaggtggcatatcgatgaattaaaacggtttccttttaaaacagaaataaagatgaggtgaaattttatttaaatacccagcaaattggagctctgcagagctttcgttcgtatcatcgttcgacaacgtc

SEQ ID NO: 367 - DNA, 900 bp, Arabidopsis thaliana
aactctttgtttcttgtttgttgattaacccttaattaatccgggcgcgcctgatttatcacaagtttgtacaaaaaagcaggctcctgcaggaccatggctgattgatgtctttggtatctggagccagggacatggggttcgacgacaacaacaacaacaagaacaacaaggatggagatgatgagaactcctcctccagaacaagagccgacgacgatgctcttagtcgacagatgagcgaatcttctctttgtgctaccgaggaggaagaagacgacgattccaaattgcaattgggtcctcagtacactatcaaagaacatctcgagaaggacaaggatgatgagagtctgaggaaatggaaggaacagcttctcggaagtgttgatgtcaccaacattggagagactcttgatccggaagtgaggattgatagcctcgccatcatatctcctggaagacccgacattgttctcttggttcctgagaatggaaatccaaagggcatgtggtttactttgaaagaagggagcaagtacaacttgaaattcacttttcatgttaacaacaacattgtctctggtcttaggtacaccaatacagtttggaagaccggtgtcaaagtggacagagctaaggaaatgcttggaacctttagtcctcagttggagccatacaaccacgtgatgccagaagagaccactccttctggcatgtttgctcgaggatcatattctgcaagaactaagtttcttgatgatgataataagtgctacttggagatcaactacagctttgacatccgtaaagaatggcctgcgctttgatagctcgagacccagctttcttgtacaaagtggtgataaattggagctctgcagagctttcgttcgtatc

SEQ ID NO: 368 - DNA, 2844 bp, Arabidopsis thaliana
ttcatttatttgtcagctttcaaactctttgtttcttgtttgttgattaacccttaattaagttaaaaccaaagtgacgaatattaatggcgttttcttcttgttttctcttagttcttctgcaaatcttctcagctttacttctttgtcttgctcaagatcagtcaggattcatcagtttggattgcggttcgcctagagaaactagctttcgtgagaaaacaacaaacattacttacatttccgatgcgaatttcatcaataccggtgttggtggaagcatcaaacaaggataccggactcagtttcagcaacaaacatggaacctacggagttttccacaaggcataagaaactgctataccttaaacctaaccataggcgacgaatatctaatcagagccaatttccttcacggcggttatgacgacaaaccctcaacgcaattcgagctctacctcggacctaatctttggtctacagttacaaccacgaacgagaccgaagcatcaatctttgagatgattcatatcttgaccactgatcgtttacaaatctgtctggtcaagacaggaaacgcaacgccttttatctccgctttagagcttcgtaaactcatgaacacaacttacttgactcgacaaggttccttgcagaccttcatcagagcagacgttggcgcgactgttaaccaaggctacaggtacggaatcgatgtgtttgatcgtgtctggactccgtataatttcggaaactggtcacagattagtaccaatcagtcagtgaatataaacaatgactatcaaccaccagagattgctatggtcacagcctctgttccaacagacccggacgcagctatgaacatttcgctagtcggggtggaacgtactgtgcagttctacgtttttatgcattttgcagagattcaagagctcaaatccaatgatacaagagagttcaacatcatgtacaataacaagcatatctatggaccttttagaccacttaatttcaccacgtcttccgtatttacacctaccgaagttgtcgccgatgcaaatgggcagtacatattttcgcttcaaagaacaggaaattcgactttacctcctctgctcaacgctatggagatttattcggttaacttgttgccgcaacaggaaactgatagaaaagaagttgatgcaatgatgaacatcaagtcggcttacggcgtgaacaagattgactgggaaggagatccttgcgtgccgctggattacaagtggtctggtgttaattgcacttatgttgacaatgagaccccaaagatcatttctttggatctgtctacaagtggcttgaccggagagatcttagaatttatatcagaccttaccagtttagaagttcttgacttgtctaacaattctttaactggttcagtcccagagtttctagctaatatggaaaccttaaaactcataaatctatctggaaatgagctaaatggctctatccctgcaactctccttgataaagaacgacgaggatctattacgttaagtatcgaaggaaataccgggctttgttcatctacatcatgcgctaccacgaaaaagaagaagaaaaacactgttattgcacctgttgcagcatcacttgtttcagtattcctcattggagctggaatcgttactttccttatcctcaagaggaagaagagaaccaagcttggtttgaatcctaattcaggaactggtacaacaccgttacattcgaggtctcaccacggttttgaacctcccgttatagcgaaaaaccggaaattgacttacattgatgttgttaagatcacaaacaactttgagagggttcttggtaggggtggttttggtgtggtttattacggcgtcttgaataatgaaccagttgcggtaaagatgctcactgagtccactgcacttggttacaaacagtttaaagccgaggttgagttgcttcttagagttcatcacaaagatctcacatgtcttgttggatattgtgaagaaggagataaaatgtctctaatctatgagttcatggcgaatggtgacttgaaagagcacttatcagggaagcgtggaccgtcgatactaacttgggaaggaaggcttcgtatagcagcggaatcagcgcaaggattggaatatttgcacaatggatgcaaaccgcaaatagttcaccgcgacattaagactactaacatcttattaaacgagaaatttcaagctaagcttgcggatttcgggctttcacggtcttttccacttggaactgaaactcacgtctcaaccatagttgctggaactcccggatatcttgatcctgaatactacagaactaattggttgaccgagaaaagtgatgtgttcagctttggtgttgttctactagagctagtaacaaaccaacccgtgatagacatgaaaagagaaaaatcacacatagctgaatgggtaggtttgatgctatcaagaggagacattaacagcattgtagatcctaagcttcaaggagactttgatccaaacacgatatggaaagttgttgagaccgcaatgacttgcctgaatccgtcttcttcacggagaccgacaatgactcaagtcgtaatggatctgaaagaatgtctgaacatggagatggcaagaaacatgggaagccgtatgacggattcaactaatgattcttcaattgagctgtccatgaatttcacaacagagcttaatccaggagctagatgaatttaaatacaaatacccagcaaattggagctctgcagagctttcgttcgtatcatcggtttcgacaacgttc

SEQ ID NO: 369 - DNA, 2426 bp, Arabidopsis thaliana
tttgtcagctttcaaactctttgtttcttgtttgttgattaacccttaattaagaaatgggtgttgatgtgaaacgtttccttgttgttatgcttctgttgcgaatctgtgaatacgcagctgcttctacttttcctcttgcacttcgtaattgcagtgaccattgcggaaatgttagtgttccttacccttttgggataggcaaaggttgttacaagaacaaatggttcgagattgtctgcaaaagctcatcagaccaacaaccgatacttttgttgccaaggatccgacgagcagttacttccttcaaccttggagaccctttctccatatcggtgtacaacaaattctacatccagagtccattgaaacattcaggttgtcccaacagagatggttattcatcatcgtctttgaatttgaagggcagcccattcttcatatcagaaaacaataagttcacagctgttggatgcaacaacaaggcgttcatgaatgtcacagggttacaaatcgtgggatgtgagacgacatgtggaaatgagatacggtcttacaaaggagctaacacgagttgtgttggttacaaatgctgccagatgactataccacctcttcttcaacttcaagtgtttgatgcaaccgtagagaaactggaaccaaataaacaaggatgtcaggttgccttcttgactcaattcacattgtcagggtccttgtttactcctcccgaattaatggagtacagtgaatatacaacaatagagctagaatggcgtcttgatctttcctacatgacttcaaagcgtgtactatgcaaaggcaatacatttttcgaagatagctatcaatgttcgtgtcacaatggttacgaaggaaatccctacatacctggcggatgccaaggtacctattaacttctttgaatagagggcttgagtgtactatataaccttatgtgaagtttggaatttttgtgtccgtagacattgatgaatgcagagatccacatctaaataaatgtggaaagagaaagtgtgtgaatgttctcggatcatatagatgtgagaaaacttggccagccattttaagtaagttatataatgtttctgcataagcctttttagattgaaagtgaaaagatcaacttacaatgcaggtggaactctaagctctggattgttgctcctgatctttggtatgtggttgctatgcaaggctaatagaaagcggaaagtagccaagcagaagaggaagttcttccaaagaaatggaggtttgttgttgcagcaacaaacatccttccttcacggaagtgtaaatagaaccaaagttttcagctccaatgacctggagaatgcaacagatagattcaatgcgagcagaatactggggcaaggcgggcagggtacagtttataaaggaatgttggaagatgggatgatcgtcgctgtcaagaagtccaaagcattgaaagaagagaatcttgaggaattcatcaatgagatcatccttttgtcacagattaaccaccgaaatgttgtcaagatcttaggatgttgtcttgagacagaagtacctatattggtgtatgagttcattcctaaccgtaaccttttcgatcatcttcacaacccatcagaggatttcccaatgagttgggaagtccgtctctgcatcgcctgtgaagtcgccgatgccctctcctacctgcattcagccgtctctatccccatttatcacagagatgtcaagtcaacaaatatcttattggatgaaaagcaccgtgcaaaagtgtcagattttggaatctcgagatctgttgctatagatgatactcacttgacaacaattgtacaaggaacaattggatatgtagacccagagtaccttcagtcaaaccacttcacagggaagagtgacgtctacagctttggggttttgctcattgagctcttaaccggagagaaacctgtctcccttctgagacggcaagaagtccgaatgttgggtgcttacttcctcgaagccatgagaaatgacagacttcatgaaattctcgatgctcgcatcaaggaggaatgtgatcgagaagaggtccttgcagtagccaaacttgcaagaaggtgtttgagcttgaactcagaacatcgccctaccatgagagacgtatttattgaactagataggatgcaatctaagagaaaaggtactcaaagccaagcacagaatggtgaagagcatgcacacatccagatcgcaatgccggagtctatgtcacttagttactcttctccgaacatagtcgttgaaaacagctcattctcattggacacaaaaccactaatgcctcacaagacacagtgacatttaaatacccaaatacccagcaaattggagctctgcagagcttcgttcgtatcatc

SEQ ID NO: 370 - DNA, 1721 bp, Agrobacterium tumefaciens str. C58
atttatttgtcagctttcaaactctttgtttcttgtttgttgattaacccttaattaatccgggcgcgcctgatttatcacaagtttgtacaaaaaagcaggctcctgcaggaccatggatgaacctttgaccgccgccgaatacaaggcgattgcctcagaccttcagttcccggccaatgccttcattgacggggctttccggcccgccggttccggcaagaccttcaagacgatcaatcccgccaccggcgaaacgctcgccgatatttcggcctgcgacgtgagtgacgtggactatgcggtcggcaaagccagggcggcattcgacgacggccgctggcgcctgctgccacctggcgaacgcaaggccattttgctcacattcgcaaaactactggagcagcatcgccacgaactagccgtcatggaaagcctggacagcggcaagccggtttccgaatgccagaccgtcgacattcctgacacgatccacaccatccgctggcatgcggagctcatcgacaagctgtatgacaataccgcaccggtgggatcgaacgcccttgcactcgtggtgcgcgagccggttggcgtcgtcggctgcgtgctgccgtggaacttccctttgctgatgctggcctggaagatcggcccggcgctcgcctccggatgttcggtgatcgtcaaaccggccgaggagacaacgctgacgaccctgcgcgtcgccgaactggcgcatgaagccgggattccggctggcgtcttcaacgtcgttccgggcggcggcaaggaggtcggcgagccgatcggcatgcatatggatgtcgatatggtagcgtttaccggatcgacgccaacgggacggcggttcctgcgatatgcggccgactccaacctcaagcgcatcgtccttgaatgcggcggcaaaaatccggcggtggtgctggatgatgcggaagacctcgacctcgtcgccgagcaggtggtcaacggcgcattctggaacatgggcgaaaactgctcggcctcgtccaggctcatcgtccatgcaaaaatcaaggacgagctgctgcagcggatcggcgcctatatgcgggaatggaggatgggcgatcctctcgatccgcaaaaccgcgtcggcgcgctcgtcagcaaagcccatttcgataaggtccactccttcctcgaggacgtgaaggcagaaaatcttaccatcgttcacggtggcaagaccgagaagggaatcttcatcgaacccacggtcgtcgatgccgtgccccctgcaagccgtcttttccgggaagagattttcggcccgatcctgtcggtgacgaccttcaacacgctggcagaggcggtagctcttgccaacgacacgaattacggccttgccgcatccgtctacaccggaagccttcgcaaggcgatcaagctctcgcgcgaaatccgggcgggtgtcgtcacggtcaattgcttcggcgaaggcgacgcaacgacgccgtttggcggctacaaggaatccggtttcggcggacgcgacaaatcgatcttcgcgcacgataattattgcgaactcaaaacgatctggatcgacgtctccgatcgttcggtggacgagacggtcagatgactcgagacccagctttcttgtacaaagtggtgataaattggagctctgcagagctttcgttcgtatcatcggtttcgacaacgttcgt

SEQ ID NO: 371 - DNA, 1676 bp, Bacillus halodurans
catttatttgtcagctttcaaactctttgtttcttgtttgttgattaacccttaattaatccgggcgcgcctgatttatcacaagtttgtacaaaaaagcaggctcctgcaggaccatggaacgggaccactatcggatggtcattaacggagaacgggtcgatagcgacgaaacctttgagacgtttaaccctgccaaaggtgagattttagcaacggttgcaaaagcaagtcgtgagcatgcagaaaaggcagttcaggcggctcgccatgctttcgatcacggcaaatggcgaaagtaccctgttggaaaacgtgctcgtgtgcttaatcaaattgccgccattatgagggagcggtttcaagagcttgtagaaatcgaagtgcttaatagtggcaaagcgatcagtgctgctcaagcacaaatcaatcaagcaatcgaagactttgagttttatgctggggcgattgtaggccatcgtggaaccgtaaacaacgtccctaatggatttctgaactacacacagaaggagccggtcggtgtttgtgcacagatcattccgtggaactacccgttgatgatggcagcatggaaagtcgctccggcactagctgcgggttgttctgttgttgttaagccggcaagcttaaccccgattacagcgattcttttaaatgaaatttgccatgaagctggtgtgccagaaggtgtggtcaatacggttgcaggggctggaagcgttgttggtgattatctagttgggcatgaagacgtaaataaagtcgcatttacaggctctactccaatcggaaaagacatcatggaaaaggcctcacacacattgaagcgtgtcacgttagagctcggcggtaaatcacctaatctagtttttgcagatgccgatatggaagcagccgttgcaggttctttatttgggatttactttaatactggtcagtcttgtgaagcgagatcgcgcctgtttgttcatgaagaaatttacgatgagtttatagaggagtttatcactcgcgcaaaaaagttacagctaggagatccatttgataaaggtacacatgtcggttcgatcattagtagagaccagcttgaaatcattgatagctatgttcgttcagcagaggaagaaggggcaacgattgccttaggtggaaaagagaggcgggtggaaggctttgaaaacggccattggtatgagccaacagtcattaccaatgtaacaccagatatgaaggcggtacaggaagaaatctttggacctgttgtggttgtcgaaacgtttcaggatgagagagaggtcattaagcgggccaatgatacgaaattcggcttaggttcagctatttggacgaaagatcaaggtcgtgctacgcgcgtggctcatcagctggaagcagggattgtcatggtgaactgtccattttcggcttttcctggtaccccttttggcggctacaaagaatcaggatttggtcgtgagctttgcgtagagactctcgatctctatatggaggataagagtatcttatcctattatggaccgaagcctattaatccattcggagtttaactcgagacccagctttcttgtacaaagtggtgataaattggagctctgcagagctttcgttcgtatcatcggtttcgacaacgttcg

SEQ ID NO: 372 - DNA, 1701 bp, Bacillus halodurans
ttcatttatttgtcagctttcaaactctttgtttcttgtttgttgattaacccttaattaatccgggcgcgcctgatttatcacaagtttgtacaaaaaagcaggctcctgcaggatcatgaaaaaaatctcaacaaacgatagcaaattaaatccaaggttagtggcgtttttaaacggtggaccaaagaagctatttattaatggggaatgggttgattcattctctggacaatcttttgaaacgatgaatccagcaaccggagaaacattagctctcgtagcagaagctgggtcagaggacatcgattttgcagtgaaagcggcaaggaaagcgttcgatgaagggccttggtctaaaatgagcgcagcggaaagaagtcgactcatatacaagctggctgatttgattgaggatcataaagaagcgttagctcagcttgagacgttagataatggtaagccaattcgtgagacggccaatgctgatattccattagtaattgaacactttcgttactttgcagggtgggcgacaaaaattgtgggccaaaccatccctgtacaaggccattattttaactacacgcgccatgaagccattggcgttgtgggccaaatcattccttggaatttcccgttattgatggctgcttggaaacttggtgccgctctagctacaggttgtacggttgtgttaaaaccggcagagcagactccactttccgccttatatttaggagaattgatcaatgaagcaggttttccaaaaggggttgtgaacattgtccctggatttgggcattcggctggaactccccttgtgaatcacccagctgtagataaagtggcttttacagggtcgactgatgtcggaaagttaattatgaaacaagcgagtgaatcattaaaaagagtaacgcttgaacttgggggcaagtcaccaaatatcattttacctgatgctgatttgtcaaaggccgttcctggctcacttatgggcattatgttcaatcaaggccaagtgtgttgcgcaggaagtcgtttatatgtacaaaagaaacagtatgatcatgtcgttgctgacctggtgtcgttaacgaacgagattcagcaaggggatggattattagaacaaacgaccatgggacctctgatttcaaatcaacaacaaagtcgagtgaaaaattacatcgatcgtggggttgaggaaggggcagaactactaacaggtgggaacattccgtatgatcaagggtattttgtcgccccaaccatttttgctgacgtggatcattccatgacgatcgccaaggaggaaatttttggtccagttgtagccgcaatgccgtttgatagcatagacgacctaattgataaagccaacgattctgattatggactagctgccggtgtttggacacaggatattaaaaaagcacactacattgcccaccgaatcaaggcagggaccatttgggtgaattgctacaatgtattcgatgccgcgagcccgtttggtggttacaaacaatcggggattggccgggaaatggggagctatgcattagaaaattatactgaagtgaaaagtgtttgggtgaatatggattaactcgagacccagctttcttgtacaaagtggtgataaattggagctctgcagagctttcgttcgtatcatcggtttcgacaacgttc

SEQ ID NO: 373 - DNA, 1431 bp, Arabidopsis thaliana
atggcgttacaaaggcaactcctgaagagagctacttccgatatctatcaccgccgtgcgatctctctcctccgtactgatttctctacttctccttcgattgctgatgctccgccgcacattccgccgttcgttcaccagccacggccgtataaaggtccttccgccgatgaggttttacagaaacggaagaagtttctcggaccttctcttttccactactaccagaagcctcttaacatcgttgaagggaagatgcagtacttgtatgatgagagtggtaggcgatatctggatgcctttgctggaatagtcactgtgtcgtgcggtcactgccatccggatattcttaatgcgattacggaacagagcaagctacttcagcacgcgactactatttacctgcatcatgccattggtgattttgctgaagcattggctgccaagatgcccggaaatcttaaggttgtgtactttgtgaattctggctcagaagctaatgagctagcaatgatgatggctaggctttacactggtagccttgagatgatttccttgagaaatgcttatcatggtggaagttccaatactattggactaactgctcttaacacatggaagtacccattacctcagggggaaatccatcacgtagtaaatccagatccataccgtggagtttttggctctgatggttctctttatgctaaagatgttcatgaccacatcgagtatggtacctctggaaaagtagctggatttatcgcagagaccatccagggggtcggaggagctgtagaattggctcctggttacttaaagtcggtttatgaaattgttcgcaacgctggtggtgtatgcattgctgatgaagtccaaactggatttgggcgaacaggaagccactattggggtttccagactcaagatgtggttcctgacatagtcacaatggcaaagggaattggaaatggattgccattaggagctgtggtgactacaccagaaatcgcaagtgttttagctagcaagattctgttcaacacttttggtgggaacccggtttgttcagctggtggacttgcggttctaaacgttattgataaggagaaacgccaagaacattgtgctgaagttggttcacaccttatacaacgtttgaaagatgtgcagaaaagacatgatatcattggagacgtgagaggaagagggttaatggttgggattgagcttgtgagtgaccggaaagacaagacaccagccaaggctgaaacatctgtcttgtttgagcaacttagagaacttggcattctcgtcggaaaaggaggacttcatgggaacgttttcaggataaagccaccaatgtgtttcactaaagatgatgcagatttcttggtagatgcattggactattccatctccaggttgtga

SEQ ID NO: 374 - DNA, 1666 bp, Bacillus halodurans
attcatttatttgtcagctttcaaactctttgtttcttgtttgttgattaacccttaattaatccgggcgcgcctgatttatcacaagtttgtacaaaaaagcaggctcctgcaggaccatggaagcgatctatacgcgtcagtttcttgccggagaatggattgaaggggctagtactcaaacgatcaccaactataatccgtatacaggagagaaaatacatgaaatcaaaggagctagtctggacgatttagatcaagcataccgcgccgcgaagaatgcgcaaaaagaatgggagcagacgctaccagcacaaaagcaagaggttcttgaaaaagcagcggctctacttgctgaacggaaagatgaagtgatcgaacggctcgtcaatgaagcaggcagttcaatcatcaaagcgagcattgagtggggggctactttgcaaacgataaaagtcgcggccaccttccctttgcgcatggagggaaaaattctcccatctaatatccctggaaaggaaaaccgcatttatcgatcagccaaaggggtcatcggtgtgattagcccttttaacttccccctcgtcttagcgatgcgttctgtagcacctgcacttgcaactgggaatgcggttgtacttaaatgttcgtctgatgcgccgatcacgtcaggtcttctcattgcagagctttttgaagaagccggtttaccgaaaggagttcttaacgtcgtagtcggaaaagcggctgagattggagatgctttcgttacgcatcctatcccaaaattaatctcgtttaccgggtcaacggaagtggggcgacacattgctcaattagcggctcgtgagttaaaggagacggctctagagcttggaggtaacaacgtgatgatcgtccttgatgatgctgatattgaaaaagcagcagaaaaggcagctgtcgggaaatttttacatcaggggcaaatatgtatggctttaaatcggatcatcgtagatgcgagtatttacgattcttttgttgaagtgtttaaagaaaaagtgagccagctacaaacaggaaacccagcagagcctgccacattgattgggcctctcattaattataagcaaatcggccgtatccaacagctagtcaaggaaagtgttgcccaaggagcggtaaaagtattggaaggacatgttcaaggtaatctaatgagccctacgattttatcagaagtgacaaacgatatgccagtggcaaaagaggaaatcttcggccctatcgctccaatcattaaagcgaaggacgaagcggaagcgatagcgattgccaacgattccccatatggcttaagcggctctatattcacaggctctcttcatcgaggtgttcaagtggcaaaacaaattgatactggcatgattcatgtcaacgaccagcctgttaatgaggaggcccatatttcatttggcggggaaaaagattctgggatcggacgttttggcggggaatgggtgttagataaattcacaactgttaagtggattagcattcaagagaaggagcgagtatacccgttttggggataactcgagacccagctttcttgtacaaagtggtgataaattggagctctgcagagctttcgttcgtatcatcggtttcgacaacgttcgtc

SEQ ID NO: 375 - DNA, 1508 bp, Bacillus subtilis subsp. subtilis str. 168
tctttgtttcttgtttgttgattaacccttaattaatccgggcgcgcctgatttatcacaagtttgtacaaaaaagcaggctcctgcaggaccatgggtcaaacaacagcaagcatcacaactgcacaatggcagcaaaaacgggatcaatttgtgtcaaaaggtgtgagcaacggcaaccgcagtctggcggtcaaaggagaaggggccgagctgtacgatctggatggccggagatttattgattttgcaggcgccatcggcacgttaaatgtcggacactcgcatccgaaggtggttgaggctgtgaagcggcaggcggaggagctgattcatcctggttttaatgtcatgatgtacccgacttatatcgaattagcagaaaaactgtgcggcatcgcgccgggcagccatgagaaaaaagcgatttttcttaactcaggggcagaagcggtcgaaaacgctgtgaaaatcgccagaaagtatacaaagcgccaaggcgttgtctcgtttacacgcgggtttcacgggcgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggtcattcaagcattcaatgatttctttatcgcttcagtggcgcctgaaacggtggcgtgtgtcgtgatggagccagtgcagggagaaggcggatttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggtgtgatcgggcgtgcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagacaaggcgtatgagtggaaacaagaattcccgttcatcggtgacatccgcagactcggggcgatggccgcaatcgaaatcgtcaaggatcctgacacgcgtgagcctgataagacaaaagcagcagcgatcgcggcctatgcgaatcaaaacggattacttttgctgacagcgggaattaacggtaatatcatccgctttttgacaccgctcgtcatctcagacagcctattaaatgaagggctcagcatcttggaggcgggcctgcgagcttaatcattggaaagaaaatggccgggtctgctatcattttaagtaatcatgaactcgagacccagctttcttgtacaaagtggtgataaattggagctctgcagagc

SEQ ID NO: 376 - DNA, 1370 bp, Bacillus subtilis subsp. subtilis str. 168
aactctttgtttcttgtttgttgattaacccttaattaatccgggcgcgcctgatttatcacaagtttgtacaaaaaagcaggctcctgcaggaccatggaatttgaacagtctcatgtattgaaggaattgcctaaacaattcttcgcttctctggtgcagaaagtgaaccgaaagcttgcagaaggacatgacgttatcaatctgggacagggaaatccagatcagccgactcctgagcatattgttgaggagatgaaacgagctgtcgctgatcctgagaatcataaatattcgtcttttcgcggctcataccgtctgaagtcagcggctgctgcattttacaaaagagaatacggcattgatctggatccggaaaccgaagtcgctgtattattcggcggaaaagccggtctagtcgagctcccgcaatgcttgttgaatcccggtgatacgattttagttcccgatccgggttatcctgattactggtcgggtgtcacacttgcaaaagcaaagatggaaatgatgccgctcgtaaaggacagagcgtttctccctgattacagcagcataaccgctgaaataagggaacaggcgaaattgatgtatttgaattatccgaataatccgactggagctgttgctacttccgagttctttgaagataccgtgcgttttgcggctgaaaacggaatctgcgtcgttcacgattttgcttacggcgctgtaggatttgacggctgcaagcctttaagctttttgcagactgaaggtgcgaaggatatcggaattgaaatttacacgctgtcaaaaacgtataatatggcaggatggcgggttggctttgccgtcggaaacgcttcggtcattgaagcgatcaatctttatcaagaccatatgtttgtcagtcttttcagagcgactcaggaggctgcagcagaggcactgttagccgatcagacgtgtgtggcagagcaaaatgccaggtatgagagcaggagaaacgcttggatcacggcatgccgggaaatcggctgggatgtaacagctcccgcaggttctttttttgcatggctgcctgtgcctgaaggctatacttctgagcagttctcagatcttttgctggaaaaagcgaatgtggcagttgcggctggaaacggcttcggtgaatatggcgagggctacgtcagagtcggacttttaacaagtgaagaaagacttaaggaagccgcttatcgaattggcaaactgaacctgtttacccaaaaaagcattgacaagaccttataactcgagacccagctttcttgtacaaagtggtgataaattggagctctgcagagctttcgttcgtatcatcggtttcg

SEQ ID NO: 377 - DNA, 1628 bp, Bacillus subtilis subsp. subtilis str. 168
aactctttgtttcttgtttgttgattaacccttaattaatccgggcgcgcctgatttatcacaagtttgtacaaaaaagcaggctcctgcaggaccatgggtttcgaaacgttaaacaaaagttttatcaacggaaaatggactgggggagaaagcggacgtacggaggacattttgaatccgtatgaccagtctgtgatcacaacagcatctttggcaacgggcaaacagcttgaggatgcgtttgacattgcacagaaagcccaaaaagagtgggccaagagcacgacggaagaccgaaaagccgtgctgcaaaaagcgcgcggctatttacacgaaaaccgtgatgacatcattatgatgatcgcccgcgaaactggcggaacgatcattaaatcaacaatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaatttcccaatgaatctatccatgagatccattgcgcccgcaattgcgctgggtaacagcgttgttcacaagcctgatatccaaactgctatttccggcgggaccatcattgcgaaagcgtttgaacacgccggtcttcctgccggtgtccttaacgtcatgctgacggatgtaaaggaaatcggggacggcatgctcaccaatccaatcccgagattaatcagctttacagggtcaacagcagtcgggcgccacatcggtgaaatcgccggtcgcgccttcaaacgaatggcacttgagctcggcggcaacaatccatttgccgttctttcagatgcggatgtcgatcgtgctgtggatgccgcgattttcggaaaatttattcaccagggacaaatctgtatgattatcaacaggatcatcgttcatcaagatgtatacgatgagtttgtagaaaaattcaccgcccgtgtcaaacagcttccgtacggcgatcaaaccgatccgaaaaccgttgtcggcccgctgatcaacgagcgccaaatcgagaaagcgctggagatcattgagcaggcaaagacagacggcattgagcttgcggttgaaggaaaacgcgtcggaaacgtgctgacgccgtacgtctttgtcggtgcggacaacaacagcaaaattgcccaaacggagctgtttgccccaatcgcaaccattattaaagctggcagcgaccaggaagcgattgacatggcaaatgatactgaatacggcctcagctctgcggttttcacttctgatttagaaaaaggcgaaaagttcgccctgcaaattgacagcggcatgacccatgtcaacgaccagtccgtcaatgattcgccgaatattgcctttggcggaaacaaagcaagcggtgtcggccgtttcggcaatccgtgggtcgtcgaggaatttaccgtgacgaaatggatttcgatacagaagcaataccgcaaatatccgttctaactcgagacccagctttcttgtacaaagtggtgataaattggagctctgcagagctttcgttcgtatcatcggtt

SEQ ID NO: 378 - DNA, 1173 bp, Cupriavidus metallidurans
gctttcaaactctttgtttcttgtttgttgattaacccttaattaatccgggcgcgcctgatttatcacaagtttgtacaaaaaagcaggctcctgcaggaccatggccatcaagatcggcatcaacggctttggccgcatcgggcgcatggtgttccgcgccgccgccgcgaacttcaaggacattgaagtcgtcgccatcaacgacctgctggaaccggactacctggcgtacatgctgaagtacgactcggtccacggccgcttcgacggcgaagtgtcggtggaaggcaacacgctcgtggtcaacggcaagaagatccgcctgaccgccgtcaaggatccgtccgagctgaagtggggcgaagtcggcgccgacgtggtgatcgagtcgaccggcatcttcctgacgaaggaaggcgcgcagaagcacatcgacgcgggcgccaagaaggtgatcatgtcggccccgtcgaaggacgacaccccgatgttcgtgttcggcgtgaaccacgagacgtacaagggcgaagcgatcatctcgaacgcaagctgcacgaccaactgcctggccccggtggcaaaggtcctgaacgacaagtggggcatcaagcgcggcctgatgacgaccgtgcacgctgccaccgccacgcagaagaccgtggatggtccgtcgaacaaggactggcgcggtggccgtggcatcctggaaaacatcatcccgtcgtcgactggcgccgccaaggccgttggcgtggtgattccgcagctgaacaagaagctgaccggtatgtcgttccgcgtgccgacctcggacgtttcggtggtcgacctgaccgtcgaactggaaaacccggccaagtacgaagaaatctgcgccgagatgaaggcccagagccagggcgcgctgaagggcgtgctgggctacaccgaagacaaggttgtggccacggacttccgcggtgatgcccgcacctcgattttcgatgctgaagccggtatcgcgctggacggcacgttcatcaaggtcgtgagctggtacgacaacgagtggggctattcgaacaagtgcctggaaatggcacgcgtcgtggccaagtaactcgagacccagctttcttgtacaaagtggtgataaattggagctctgcagagctttcgttcgtatcatcg

SEQ ID NO: 379 - DNA, 1106 bp, Rhodopseudomonas palustris
aactctttgtttcttgtttgttgattaacccttaattaatccgggcgcgcctgatttatcacaagtttgtacaaaaaagcaggctcctgcaggaccatgggcaatcagcttctcgaccgtgtcgttgccgaaatcgccgatgagatggcgcagcgggcggaccgcggcgaggtggcgagctatattccggagctggcgcgggtcgatccgaaggcgttcggcctcgcggtgatcggcgccgacggtcatatcgcggccgccggcgatgccgatgtgccgttctcgatccagagcatctcgaaggtcttcacgctcacgctggcgctcggcaaggccggcgaccggctgtggcgtcgcgtcgggcgagagccatccgggtccgccttcaactcgatcgtgcagctcgagcacgagcgcggcatcccgcgcaatccgttcatcaatgccggtgcgatcgccgtcaccgatctgatcctgtccgggcatcagccgcgcgaggcgctcggtgagattttgcgcttcatgcagttcctcgccggcgattcctcgatcgccatcgatgaagcggtggcgaaatccgaacagcgcaccggatttcgcaacgctgcgctcgccaactacatgaagtcgttcggggtgctggacaatccggtcgagtacacgctcggcgtttatttccaccactgcgctatcgcgatgagctgtcgccaactggcgatggccgggcgattcctggcgcacaacggccagaacccgtcgaccggcctcaacgtggtgtcgagcgaacgagcgcgtcgcatcaacgcgctgatgctgacctgcggccattatgacggctcgggcgaattcgcttatcgggtcggcctgccgggcaagagcggggtcggtggcggtatattggcggtcgcgccgggcagagcctcgatcgcggtgtgggcgccggggctcgatgccgcgggcaactcccatctcggccgcgttgcgctcgaggggctgaccaagcgcatgggctggtcgatcttcggcgtctgactcgagacccagctttcttgtacaaagtggtgataaattggagctctgcagagctttcgttcgtatcatcggtt

SEQ ID NO: 380 - DNA, 846 bp, Sinorhizobium meliloti
gctttcaaactctttgtttcttgtttgttgattaacccttaattaatccgggcgcgcctgatttatcacaagtttgtacaaaaaagcaggctcctgcaggaccatgagcggcaccctcgtccttgtccggcacggccagagcgactggaacctgaagaacctcttcaccggctggcgcgatcccgacctcaccgaactcggcatcgaggaggcaaaggccggcggcaaggcgcttgccgattacggcatcaaattcgacatcgccttcacctccgtcctcatccgggcccagcgtacctgccagctcgtcctcgacgccgtcggccagtcgtcgctcgaaacgatccgcgatcaggccctgaacgagcgcgactacggcgacctctccggtctcaacaaggacgatgcgcgggcgaaatggggcgaagagcaggtccatatctggcgccgctcctacgacgtgccgccgcccggcggcgagagcctgcgcgacaccggcgcgcgcgtctggccctattacctgaccgacatcctgccgcgcgtgctttcgggcgagaaggtgctcgtcgccgcccatggcaactcgctgcgctccctcgtcatggtgctggacaagctgaccaaggagcagatcctcaagctcaacctcgcgaccggagtgccgatggtctacaagctgaacgcggattcgaccgtcgcttcgaaggaagtgctaggggatatgtccggggcgcattgaggcacacacctcttgcgggctggtgcggcggatactgctcgagaccagctttcttgtacaaagtggtgataaattggagctctgcagagctttcgttcgtatcatcg

SEQ ID NO: 381 - DNA, 1347 bp, Sinorhizobium meliloti
gctttcaaactctttgtttcttgtttgttgattaacccttaattaatccgggcgcgcctgatttatcacaagtttgtacaaaaaagcaggctcctgcaggaccatgaggaccagtcatttggcacagatgtcgaaacgcagcgcagtcgagccgttccacgccatggacgtgctggccgaagccacgcggcggcgcgattccggccacccggtcatatccatggcggtcggtcagcccgcgcatccggcgccgaaagcggcactcgatgctgcaaggcgggcgctcgatcacggtcggctcggctatacggacgctcttggcacacactccctgaagagggcgattgccgctcattatcacagccggcacggcatcacgctcgatccgcagcggattgcggtgacgaccggatcgtcggccgggttcaatctcgcttttctcgccctgttcgatccgggcgatcgcgtggccatcgcccggccgggctatcccgcctatcgcaacatcatggccgcgctcggcctcgaagtggtcgagatcgaagccaatgccgaggccggcttcactttgaccccggacagcctcgagggcgccgcggcacgtgccggaaaaccgctgaagggcgtgcttctcgcaagccccgcgaacccgacgggaacggtgaccggcaaggcgcagctgaaggcgctcgccgactattgccgggatcactcgatcgccttcatttccgatgagatctatcacggccttactttcgccggggaggagacgacggcgcttgaagtcgccgacgacgcagtcgtgatcaactccttctccaaatattattgtatgaccggatggcgcatcggctggatggttctgcccgaggcgcgggtgcgtgccttcgagcgcatcgcgcagagcctctatatttcgccgccggagctatcacagattgccgcagaggcggctctcggcgcgcatgaggagctcgacggctacaagcgcgcatatgccgcgaaccgcgcattgctgctcgaacggctgccgcagatcggcttttcgatcgcctcgccgatggacggcgcattttacgcctatgcggatgtcagccgcttcaccaatgacagcatggccttcgcccgtcggatgctggccgagatcgacgttgcggcaacgcccggcttcgacttcgatcccctcgaagggcatcgcaccatgcgcttttcctatgcgggcgcggctaccgagatggaggaggcgatgaaccgcatcgcgcgctggctggcctagctcgagacccagctttcttgtacaaagtggtgataaattggagctctgcagagctttcgttcgtatcatcg

SEQ ID NO: 382 - DNA, 945 bp, Sinorhizobium meliloti
gctttcaaactctttgtttcttgtttgttgattaacccttaattaatccgggcgcgcctgatttatcacaagtttgtacaaaaaagcaggctcctgcaggaccatggcgcccgatatccgcccgctcgtcgccggcaactggaagatgaatggaacacgtgcgtctctggaccagatcaaggcaatggccgagggcgtcaaaggcgacctttccgcgagggttgacgccctgatctgcccgcccgccacattgctttacgttgcgaccgcgctttgcgacgacagccctttgatgatcggggcgcaggactgccaccagaaacagtcgggagcccataccggcgaagtctcggctgaaatggtcgccgattgcttcggcacgcatgtgatcgtcggccattccgaacggcgcaccgatcatggcgaaggcgacgcactggtgcgtgccaagacggaggccgcgcatggagcggatctcgtcgcgatcgtttgcgtcggtgagacggaagaggagcgcaaggccggccggacgctcgatattctgaagcgccagctctccgagagcctgccggatcaggcgacggccgaaaataccgtgattgcctacgaacccgtgtgggcgatcggcaccggcctgacgcccaccgtgtccgacgtcgaggaggcgcacgccttcatgcgccgcgagctcgtctcgcgcttcggcgcggaaggcggcaagatgcgcatcctctatggaggttccgtcaagccctcgaatgcgaaggaactcatgggcgttgccaatgtcgacggcgccctgatcggcggcgcgagcttgaaagccgatgatttcctcgccatctacagggcctatgaagaattgactgcctgactcgagacccagctttcttgtacaaagtggtgataaattggagctctgcagagctttcgttcgtatcatcg

SEQ ID NO: 383 - DNA, 1527 bp, Sinorhizobium meliloti
tttatttgtcagctttcaaactctttgtttcttgtttgttgattaacccttaattaatccgggcgcgcctgatttatcacaagtttgtacaaaaaagcaggctcctgcaggaccatggccaaccgcctgaacaccacgcccaacgatctcagcgccttctggatgccgttcacggcgaaccggcagttcaagaaggagccgcggctgttcgtcggcgccaaggacatgtattacaccacccatgacgggcggacggttctcgatgggaccgcggggctctggtgcgtcaatgcaggccactgtcggccgaaaatcaccgaggcgattcgcgaacaggcgggcgaactcgactacgcgccggccttccagctcggccatccgaaagccttcgagctcgcaaatcggctggtcgatatcgcgcccgagggcatgaaccacgttctctacaccaactcagggtcggagtcggtcgataccgccttgaaggtcgctctcgcctaccaccgcgccaagggcaatggctcgcgcttccggctcatcggccgcgaacgcggctatcacggcgtcaacttcggcggcatctcggtcggcggcatcgtcgccaaccgcaagatgttcggcacgctgttgacgggcgtcgaccaccttccacacacgcacctgccggccaagaacgcctttagccgcggcgagcccgagcacggcgccgatctcgcagccgaactcgagcgcatcgtcaccctgcatgacgcctcgacggtcgcagcagtcatcgtcgagcccgtcgccggctcgaccggtgttctcatcccgccgaagggctatctccagaagctgcgcgaaatctgcaccaagcacggcatcctgttgatcttcgacgaggtgatcaccggctatggccgtctcggcacgcccttcgccgctcaatatttcgacgtgaagcccgacatcatcaccacggccaaggggcttaccaacggcgtcattccgatgggcgcggtcttcgtgacatcggaaatccacgatgccttcatgaccgggccggaacaccttatcgagttcttccacggctacacctattcgggcaatccgatcgcctcggcagcggcactcggaacgctggacacctacagggaagaaggcctgctgacgcgcgccgccgagcttgccccctattgggaggaggcgctgcactcgctgaaggactgcccgcatgtcatcgacatccgcaatatcggactgatcggcgcggtcgagctcgagccgatcgcaggggagccgacgaagcgcgccttctcggccttcttgaaggcctatgagaaaggcctcctgatccgcaccacgggcgacatcattgcattgtcgccgccgctgatcatcgaaaagcgacagatcgacgagcttttcgacaagctgcgcgacgtgctgaagaacaacatctgactcgagacccagctttcttgtacaaagtggtgataaattggagctctgcagagctttcgttcgtatcatcggtttcgacaacgt

SEQ ID NO: 384 - DNA, 1731 bp, Xenorhabdus nematophila
tttcaaactctttgtttcttgtttgttgattaacccttaattaatccgggcgcgcctgatttatcacaagtttgtacaaaaaagcaggctcctgcaggaccatggccagacggctcagaagaactaaaatcgtcactacacttggcccagctacagatcgtgacaacaatttagagaaagtgatcaatgcgggagccaatgttgtccgccttaatttttctcatggtaccgcagaagatcatatcctgcgcgcaaacaaagtacgggaaatcgcagctcggctgggttgccatgtcgctatccttggtgatctacaaggccctaaaatacgtatatcgacgtttaaagaagggaaaatattcctcaatatcggggataaattcctgcttgatgccaatttaggcaaaggagaaggcgataaagaaaaagtcgggattgattacaaaggactgccatcagatgttacaaccggcaatattctgttgctggatgatggacgagttcaattaaaagtacttgatgtgcagggcatgaaagtatttacagaagtgactgtaggcggcccgctttccaataacaaaggcattaataaacagggtggcggcttatctgccgaagcactgacagaaaaagacaaagaagacatcatcactgctgcgaaaatcggcgttgattatctcgcggtctctttcccccgctctggtgaagatctgaattatgcccgccggttggctcgggacgctggctgcgaaacacaaattgtagccaaagtagaacgagctgaagcggtcagcagtgatgagattatcgatgaaattattctggcatctgatgtagtcatggtagcccgtggcgatttgggtgttgaaatcggcgaccctgaattagttggagttcagaaaaaacttattcgtcgtgcccgtcaactgaatcgtgtcgtaatcacagcgactcagatgatggaatcgatgattaccaacccaatgccaacacgggcggaagtgatggatgttgccaatgccgtccttgatggtactgatgcggttatgctatctgcggaaacagcagcgggtcaatatccagcggaaactgttgcggcaatggctcaagtctgcctgggcgcagaaaaaatgccggggatcaatgcatccaagcatcggatggatatcacatttgacagtattgaagaagctatctcaatgtctgccatgtatgcagccaatcatctgaaaggggtcaaggccattatcgccatgaccgaatcaggtcgtacagcacgtatgatgtcacgtatcagctccggtctgcctattttctctatgtcacgccatgaatcaacgctgaaccgtaccgcattataccgtggtgtcacaccggtttattgtagcagccacattgatggtattgccgcggcgagtgaagcagtcagccgtctgcgtgacagaggttacttagcctctggcgatttggtgctggtcactcagggggatcagatgggaactatcggcagtaccaatacttgccgagtgcttgaagtcgaataacgcaaatacttattctgcgcgatctcaaaaacgcgcagaataacaaaatactcgagacccagctttcttgtacaaagtggtgataaattggagctctgcagagctttcgttcgtatcatcggtttcgacaacgttcgtcaagttcaatgcatcagtttcattgcgcacacaccagaatcctactgag

SEQ ID NO: 385 - DNA, 1189 bp, Xenorhabdus nematophila
aactctttgtttcttgtttgttgattaacccttaattaatccgggcgcgcctgatttatcacaagtttgtacaaaaaagcaggctcctgcaggaccatggcaatcaggatagcgattaacggttttgggagaatcgggcgcagtatcttacgtgctctctacgaatccgggcgtcaagctgaaatttcggtgatcgctattaatgagctggctgatgcggaaggtatcgctcacttattgaaatacgattccagtcatgggcgttttgcatgggatgtacgcctgaacaacagcttattgcaagtgggagatgacagcatccggctgtttcatcaaccggatatttcagcgttgccgtggaaagagttggacattgatatcgtacttgactgtacgggcaaatacggcgagcgggcggatggtgaagcgcatattgccagcggtgccaaaaaagttctgttttcccatccgggagggaatgatctggatgcgaccgtagtctatggtgtgaatcaccatgagctggtggcggaagattgtatcgtttccaatgcatcctgtacgacaaactgcattattccaatcatcaaattattggatgatgcgttcaatattgaatctggcacggtgacaaccattcatgcttctatgaatgatcaacccgtgattgatgcttatcatagtgatttacgtcgaacccgcgctgccagtcaatccatcatccctgtcgatacaaaactgtctgcggggatcacacgtatcttccccaaattcagtgatcgttttgaggccatttcggtgcgggtgccgactatcaatgtgacagcgattgacttgagcgtgacggtcagcgccgcagtggatgtcagggatgtgaaccagctactgcaagaatcagcggtaagctcgtttcgtggtatagtggattacactgatttaccgttggtttcaacggattttaaccacgatccccacagtgccatcgtggatggtacacaaacgagggtcagcgggaaccacctgatcaagactctcgtgtggtgtgataatgagtggggctttgccaatcgtatgcttgatacgacgttggtaatggccgcaacgggtttcaaataactcgagaccagctttcttgtacaaagtggtgataaattggagctctgcagagctttcgttcgtatcatcggtt

SEQ ID NO: 386 - DNA, 651 bp, Bacillus subtilis subsp. subtilis str. 168
attattcatttatttgtcagctttcaaactctttgtttcttgtttgttgattaacccttaattaatccgggcgcgcctgatttatcacaagtttgtacaaaaaagcaggctcctgcaggaccatgatggaaaagacttttatcatggtgaaaccagacggtgtccaacgtcagctcattggggatattttatccagatttgaacgtaagggcttacaattagctggtgccaagttaatgagagtgactgaacaaatggctgagaaacactacgccgaacatcaagggaagcctttcttcggagagctcgttgagtttattacttcagggcctgtattcgcaatggtttgggaaggcgaaaatgtcattgaagtaacgagacagctgatcggaaagacaaatcctaaagaagctttgcctggtacgattcggggagattatggcatgtttgtcgggaaaaacatcatccacggctctgattctctcgaaagtgcagaacgcgagattaacattttctttaagaatgaagaattagtatcatatcaacagctcatggcaggctggatctattaactcgagacccagctttcttgtacaaagtggtgataaattggagctctgcagagctttcgttcgtatcatcggtttcgac

SEQ ID NO: 387 - DNA, 705 bp, Xenorhabdus nematophila
gctttcaaactctttgtttcttgtttgttgattaacccttaattaatccgggcgcgcctgatttatcacaagtttgtacaaaaaagcaggctcctgcaggaccatgagcctgaacaacgtaccggcgggtaaagaactgccagaagacatctacgttatcattgagatcccggcaaatgcggatccaattaaatatgaagtcgacaaagactccggcgctctgtttgtagaccgtttcatgtcaacggctatgttctatccgtgcaactacggttacatcaacaacactctgtcccttgatggtgacccggttgacgtactggttccaactccatacccattgcagccaggctccgttattcgctgccgcccggttggtatgctgaaaatgaccgatgaatccggtgaagatgctaaactgattgctgttcctcatactaaactgagcaaagaatacgatcacattaaagatgtgaacgatctgccagaattgctgcgctctcagattactcatttctttgaacactacaaagatctggaaaaaggcaagtgggtaaaagttgacggctgggaaaatgttgaagcagctaaagctgaaatcctgacttctttcgaacgtgctgccaaaaaataactcgagacccagctttcttgtacaaagtggtgataaattggagctctgcagagctttcgttcgtatcatcg

SEQ ID NO: 388 - DNA, 1716 bp, Saccharomyces cerevisiae
attcatttatttgtcagctttcaaactctttgtttcttgtttgttgattaacccttaattaagaagccttttattaattaccccctctctctcttcattgatcttatagatgtccaacccaatagaaaacacagaaaactcacagaatactagttcatcaaggtttttgaggaatgtacaaaggttggccttaaacaatgtaacaaatacgacatttcaaaagagtaatgcgaataatccagccctaacaaatttcaaatctacactaaactcagtaaagaaggagggaagtcggattcctcaatttactagagaaagcgtatcaagatcaacagccgcacaagaggagaaaagaaccctgaaagaaaatggtatccaactccccaaaaacaatcttttagatgataaagaaaaccaagacccaagtagtcagcaatttggtgcgctaacttctataaaggaggggagagctgagctgcctgcaaatataagtttacaagaatcctcctcagcgaaggagataatccagcatgatcccctaaaaggcgttggatcaagcactgaggtagtccataactcggtagaaaacgaaaaacttcatccagctagaagtcaacttcaagttagaaataccgaaagtgaaactgatagtggaaaaaaaagaccaatttctacaattgttgaacaagaactgcccaaaaagtttaaagtgtgcgatgaaaatggcaaagaagaatatgaatgggaagacctagatgcagaagatgtaaatgatccattcatggtcagcgagtacgtcaatgatatattcgaatatctccaccaactagaggtcattactcttccaaagaaggaagatctctatcagcatagaaatattcatcaaaatcgagatatcctagttaattggttggttaaaatccataataaattcggcttattaccggagactttgtatcttgccattaacataatggacaggtttttaggtaaagagctagttcaactggataagttacaattggttggcacatcatgccttttcattgcctctaaatatgaagaggtctattctcctagtataaaacatttcgcatcagagacagacggtgcatgtacggaagatgaaatcaaagaaggggagaaattcattttaaagacattgaaatttaacctaaattatcccaatccgatgaattttctgagaagaatttcgaaagcagatgactacgatatacagtctcgaactcttgccaaattcttattagagatatcattggtagatttcagatttattgggatactaccctcattgtgtgcagcagctgcgatgtttatgtcgagaaaaatgttaggtaaaggtaaatgggatggaaatctaatacactatagcggcgggtatactaaagaagaacttgcgcccgtgtgtcacatgataatggattatctagtgagtccaattgttcatgatgaatttcatagaaaatatcaatctagaagatttatgaaagcttctataatttccgtccaatgggctttaaaggttagaaaaaacggctatgatataatgaccttgcatgaatgagaagaggggcagatgcttaaaatatctaaaacgataatcgaaaaatgtacatttaaatacccagcaaatacccagcaaattggagctctgcagagctttcgttcgtatcatcggtttcgacaacgttcgtc

SEQ ID NO: 389 - DNA, 1693 bp, Saccharomyces cerevisiae
ttatttgtcgctttcaaactctttgtttcttgtttgttgattaacccttaattaatccgggcgcgcctgatttatcacaagtttgtacaaaaaagcaggctcctgcaggaccacgaagaggccaagaagacaaatcgaagaaagagagagataacatgggtcaaatattgtccaatccaattatcgacaaagagcatcattctggtacggactgtttgacagcgtttggactatgtgccatgcaaggctggcgtatgtccatggaagatgcccatattgttgagccgaaccttttggctgagtctgacgaggaacatctcgcattttatggtatatttgacggtcatggtggttcttctgtagcggagttttgtggctctaaaatgatatctatactgaaaaaacaggagagcttcaagagcggtatgttagagcagtgcttaatagatacctttttagctacagatgttgagttgttgaaagatgaaaaattaaaagatgaccatagtggttgtacagcaactgtgatattggtatctcaattgaaaaagctactaatttgcgccaattccggtgatagtagaacagttctatctactggtggtaatagtaaagcaatgtcatttgatcataagcccacattgttaagtgaaaaatctcgtattgtagctgctgatggttttgttgagatggaccgtgttaatggaaatttagcgttatcaagagccataggtgattttgaattcaaatctaacacaaaattgggacctcatgagcaagtcgttacatgtgttcctgatatcatttgtcacaatttgaattatgatgaggatgaatttgttattttagcatgtgatggtatttgggattgtttaacttctcaagagtgtgttgacttggttcactacggtataagtcaaggtaatatgacgttgagcgacatttcatctagaatcgtagatgtttgttgttcacccacaactgaaggctcaggaattggctgtgataatatgagtatttccattgttgctttactaaaggaaaatgaatctgagtcacaatggtttgagcgtatgagatcaaaaaattacaatatccaaacgtcttttgtccaaagaaggaaaagtatttttgatttccatgatttttcggatgatgataacgaagtgttcgcaataaccaccaaaaaattacaagaccgcttgaatcgtagtaaagataatgacgacatggaaattgatgatcttgataccgaattaggcagcagtgctactccctcaaagttatcaggtgaggatagaactggccctattgacttgttttcgttggaggctctattagaagccgggattcaaataaggcagaggcccagctccgacagtgacggcaacacttcttatttccatggtgcttctttatcagatatgttggcatctttaagcaatgcggctgcaggagaaacagaacctaatgatgctgatgataacgatgataacgacggcgaagaaaacggcaagaatgaaaatgcgaagaagggttccaagattgaagaaattgaataataaatattgtcgaaccgtactttgcaacgaaagagtagtcaaactttgctcagacccagctttcttgtacaaagtggtgataaattggagctctgcagagctttcgttcgtatcatcggtttcgacaacgt

SEQ ID NO: 390 - DNA, 1466 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggacccaaagaataattgagtaatcgaacttgaagttctatagaacagcttgtatatggtttcattgttcaaaagaggtaaggctccaccgctcacgaaagaaggccccacttctaaaaagcctcctaacacagcgtttagacaacaaaggcttaaggcatggcaaccaatactgtctcctcaaagtgtgcttccgttgttaatattcgttgcatgtatatttactcctattggtattggactcattgtaagcgctactaaggtacaagatctaacaattgattatagtcattgtgatacaaaagcatctacaactgcttttgaagatataccaaagaagtacattaaatatcactttaaaagtaaagttgaaaataaaccacaatggaggctaaccgaaaatgaaaatggcgaacaatcatgcgaactgcagttcgaaatcccaaacgatatcaagaaatccatttttatatattataaaataaccaatttttatcaaaatcatcgcagatatgtccaatcgtttgacacaaagcaaatattaggggagcctatcaaaaaagatgatctggatacaagctgtagtccaataagaagtagggaagacaaaataatatatccctgtgggttgatcgctaattccatgtttaatgatacattttctcaggtgttgagtggtatagatgacacagaagactataatttaactaacaagcatatatcatggagtattgatcgtcacagatttaaaaccaccaagtataatgctagcgatattgttccaccgccaaactggatgaagaagtatcccgatgggtatacagatgaaaatcttcctgatatccatacttgggaagagttccaggtatggatgaggactgcagcctttcccaagttttacaagttgacgttgaaaaatgaatctgcttctttaccgaagggtaaatatcaaatgaacattgagttgaattatccgatttcactctttggtggcacaaaatcatttgtactgactacaaatggagctattggtggtagaaatatgtcactaggcgtactgtacctcatcgttgcagggctttgcgccttatttggcatcatttttttggttaaattaatcttccaaccaagagcgatgggtgatcacacttatttgaattttgatgatgaagaaaacgaggattatgaggatgtacacgcagagaatacaacattgagggaaattttatagaggccaaaaaacaaactttagtgcctgtaggtatttgtgtttctcgagacccagctttcttgtacaaagtggtgataaattggagctctgcagagctttcgttcgtatcatcggtttcgacaacgt

SEQ ID NO: 391 - DNA, 1630 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccatggctgataagatagagaggcatactttcaaggtcttcaatcaagatttcagtgtagataagaggtttcaacttatcaaagaaatagggcatggagcatacggcatagtgtgttcagcgcggtttgcagaagctgccgaagataccacagttgccatcaagaaagtgacaaacgttttttcgaagaccttactatgtaaaagatccctacgtgagctaaagcttttgagacatttcagaggccacaaaaatattacatgtctttatgatatggatattgttttttatccagacgggtctatcaatggactatatctttatgaggaacttatggaatgtgatatgcaccaaatcatcaaatccggtcaacctttgacggatgctcactatcaaagtttcacataccaaatattatgtggtttaaagtatattcattctgcagatgtcttgcatcgtgatttgaagcccggcaatttgcttgtcaatgcagattgtcaattgaaaatctgtgattttgggttagctagaggttattcggagaatcctgtcgaaaacagtcaatttttgacggagtacgtggccactagatggtatagagctccggaaataatgttgagttaccaaggatataccaaggcgattgacgtatggtcagctggctgtattttagcggagtttcttggtggaaagccaatcttcaaaggaaaggattacgttaatcaattgaatcaaatattacaagttttagggacacccccagacgaaactttaagaaggattggttctaaaaatgttcaggactacatacatcaattaggtttcattccaaaagtaccttttgtcaatttatacccaaatgccaattcacaagcattagacttattggagcaaatgctcgcgtttgaccctcaaaagagaattaccgtggatgaggccctggagcatccttacttgtctatatggcatgatccagctgacgaacctgtgtgtagtgaaaaattcgaatttagttttgaatcggttaatgatatggaggacttaaaacaaatggttatacaagaagtgcaagatttcaggctgtttgtgagacaaccgctattagaagagcaaaggcaattacaattacagcagcagcaacagcagcagcaacagcaacagcaacagcaacagcagccttcagatgtggataatggcaacgccgcagcgagtgaagaaaattatccaaaacagatggccacgtctaattctgttgcgccacaacaagaatcatttggtattcactcccaaaatttgccaaggcatgatgcagatttcccacctcgacctcaagagagtatgatggagatgagacctgccactggaaataccgcagatattccgcctcagaatgataacggcacgcttctagaccttgaaaaagagctggagtttggattagatagaaaatatttttagctcgagacccagctttcttgtacaaagtggtgataaattggagctctgcagagctttcgtt

SEQ ID NO: 392 - DNA, 1520 bp, Saccharomyces cerevisiae
tttatttgtcagctttcaaactctttgtttcttgtttgttgattaacccttaattaatccgggcgcgcctgatttatcacaagtttgtacaaaaaagcaggcttctgcaggaccatgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatagctcgagacccagctttcttgtacaaagtggtgataaattggagctctgcagagctttcgttcgtatcatcggttcgacaacgt

SEQ ID NO: 393 - DNA, 1561 bp, Saccharomyces cerevisiae
ctctttgtttcttgtttgttgattaacccttaattaatccgggcgcgcctgatttatcacaagtttgtacaaaaaagcaggctcctgcaggaccatgcgatattaataacaccatcccgatttttgaaattatttttttggtgtaaatgagagaggaggggagtgaattagaaatggaaaaaggcttccttaaatggaaaccagtcaacttgatgaagaaaatattgtctttaccaatgaaaaaaactaaaaacgatataggtttgagattagatatatcatatattttagttaatctaatagtctgctcatacccggtaaacacgtatccaaaactgctttataggaatagcttggatgacttaatattgtttctaacagtgtaccatggcaagggaaattttagaatttttaattttagaggtgagaaagaagacagcgattataaagataatgatcttattggtatcgctgccaagtttgagagcaaagattttgaaattcaagaattacgttcgacgctgattaatgatggaaagataccaatatcacccattgatctcgaaacaaggaccttggtcgaagaagaaaccaataatgtaatttgtgaaaggatcggttggctagatcattttccaccgccatttgaactgctggaagagattgtagatggtatagaaaattacctgtccgtttcgaagaatagagtggctgttttacattgtcgaatggggaaaggccgatctggtatgataacagtagcatacctcatgaaatacttgcagtgtcctcttggagaagcaagattgatattcatgcaggctagattcaagtatggtatgacgaatggcgtcaccataccctctcaattaagatacttaaggtaccatgagttttttattacccatgaaaaagcagcccaagaaggaatttctaatgaggcggtaaaattcaaatttaaattcaggcttgctaaaatgacgttcctccgcccatcaagcttaatcacttccgagtctgctattgtaactactaagattcaacactacaacgatgatagaaatgccctcctaacccgaaaagtagtatattcagatatcatggcgcatgaatgcggtggtaatatgaccttcatttttggtagggactacttaacactggaaaatgattgtcgtatagaatttaccctggggaccagcaagtccaaagccgccagtagcataatatcttggacttcatgcgccagctgttggctgaatatataccttgagactttgatgcacataattaaagacgattcttcgccagattactttcaagtagagaggttaaagagagacgaaatgcttgggacaaccataagctggcaagagctggacggttttggggagctcagcactcacggcttgaaattatttcaggcactgaaattggaatgggaaattatataggtttatgcatttcgtcaaatccattcattcgttaaactagctcgagacccactttcttgtacaaagtggtgataaattggagctctgcagagctttcgttcgtatcatcg

SEQ ID NO: 394 - DNA, 1410 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccatggagatttacattagacttaacgcagatgtcgagcacgactatgcgtttcaggtgtcaaatgaagacaccataaataacaaaattaagaagattttcccttccaagacgggtttggcggacttaatggtgctgagaccatcaattttccatgagaaggagcccgtaaagttctataagtctatccatccagggtacctgtccgaaggtggttgtttgatgttccattatgaagctgataacgaagaaaatctcgaggagttgaatgactccaagccgcttattgaccagttgtggcctggtcagctagttgttccggagtggaagctatccaagaaaaacatatgggtatacaccattattatgttggcctggctatataccgatttgcccgacgccatttctccaaccccaggtatttgtttgactaatcaattgtctagactattgattcctgtagccaagcacatggatttacctgaaattgccgctaaactcgaacaagaagttcaggcaaactattctagtctcgtagctcaatggcttttctttgtcatgcacattttcaaagtgggcataattactttattcctcaaattaggcattgccaaccccatcagcttcaatccttacaagttatggagtttgagagatttaacttctccttctgctaacggcgctaagaattctggcggcaataacaacactactgacttaaagacacgtttgcgctctctgggctggattggtgctaagagagctacttacgacgattaccagactaactattacaactatgtcatagataagatgggtggtgcagttgctgcttatagagcgggcgcgattaggaaagctgcagcaccaggtatccaacttgtggctggagagggtttccaaagtcctctagaagataggttcactgcttccactttcacggctattaaaaccgaacggaaattcattttaagtgaagaatactttgtggagctggaaaacaatctaaagaagatcttggaagagtatgacggggatattggtaagatgaatgctgaaattaggaggtttagaaggtttggtatttatgaaccagatgaaaaactggcctcgctagttaagctcagaagagaaattgctgatgagaaagagaaagcatcaaacaatgatgctacttttggtataaaaaagaatgatttgaaaaaatctaattaactcgagacccagctttcttgtacaaagtggtgataaattggagctctgcagagctttcgttcgtatcatcggtttcgacaacgt

SEQ ID NO: 395 - DNA, 357 bp, Arabidopsis thaliana
atggccgcagaaggagaagttatcgcttgccacaccgttgaagattggaccgagaagctcaaagccgccaacgaatccaagaaactgattgtgatagacttcactgcaacatggtgcccaccttgccgtttcattgcacccgtctttgctgacttagccaagaagcacctcgacgtagtcttcttcaaggtcgatgttgacgaattgaacactgttgctgaggagtttaaagttcaggcaatgccaacgtttatcttcatgaaagaaggagagatcaaggagactgtggttggtgctgctaaagaagaaatcattgccaatctcgagaagcacaagacagttgttgctgctgcttga

SEQ ID NO: 396 - DNA, 1932 bp, Saccharomyces cerevisiae
ttcatttatttgtcagctttcaaactctttgtttcttgtttgttgattaacccttaattaagtttaaagacaagagaagagaaaacaaaggcggagcaatgtcggaaggaagaacgtttctgtcacagttgaatgtcttcaacaaggagaactatcaattttcttcttctactacaaaaaaggaagtaagtaactcgacagtggatgctgacaacggtgcctccgattttgaggcaggccagcaatttgctacagaattggaccaaggtgaaaagcagttaggtattttgtcgtgtattgggcttatctgtaatagaatgcttggtaccggtgttttcgccgtttcctcgaccatttacacactatgtgggtctgtggggcttgcattaattatgtgggcagttggcgccattattgccatttctgggttatatgtatacatggaattcggtacggctataccgaaaaatggtggtgaaaaaaactacctggaggctattttcaggaaaccaaaattcttcattacctgtatgtatgctgcgtatattttcttcctaggttgggctgctggtaattccatcaatacagctattatgtttttaactgctgctgatactgaagtgaccaaatggaatcaaagaggtattggtgtggccgtcgttttttttgcattcctaattaattctctgaatgtcaagattggtctatatttgcaaaacattttaggtattttcaagattggtattgtcctcttcatttctattaccggttgggttgcccttggcggtggtctcaaagatggttatcaatctcacaactttcgtaatgcttttgaaggtactgaaaccgccactgcttatggtattgttaacgccttatatagtgttatttggtcgtttgtcggttactccaatgttaactatgcacttggtgaagttaagaaccctgtgagaactttgaagattgctggtcctacatcgatggtcttcttggctataatctacatttttgtgaacattgcttacttcgctgtggttccaaaagataagttaatttcttcaaaattgattttagctgctgacttcttcgatattgtgtttggcggccaagccaagagagcagcagccgcactggtcgggttgagtgccttaggaaatgttctttctgtcattttttctcagggtagaattattcaacaactaggacgtgaaggtgtgttgcccttttctaatttctttgcctcttctaagccattcaactccccaatggttggtttgtttcaacattttattgtttgtacagtaaccattttagccccacctccaggtgatgcatatttgctagtccaaaatttaatttcctacccaatgaatattattaattttgccattagcgcgggtttgctttggatatactggcaacgtagacaaggtaaaattgaatggaacccaccaattaaggccggtgtttttgttacgggatttttcacattatccaatttatacctgattattgctccttacgttccaccttcaaatggcgagtcggtgtattcaagcatgccatactggatccactgtgtaattgcttggggtattttcttctttggtggtgtttactacgttgtttgggcccaattattgccaagatggggccactacaaattggtttccaaggatgtgcttggtgaagatgggttctggagagtcaaaattgccaaagtttatgatgacactattggcgatgtcgatacacaagaagacggcgttattgaaacgaatataatcgaacattacaaaagtgaacaagaaaaatcgctgtaaccaaaaaggtacttaccatctcatctcgattcttataatcacgatttaaatacccagcaaattggagctctgcagagctttcgttcgtatcatcggtttcgacaacgtt

SEQ ID NO: 397 - DNA, 2762 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccatgagttctgtcaaccaaatatatgacctatttcccaataagcataatatccaatttacagattctcattcacaggagcatgatacttcgtccagccttgctaagaatgatacagacggaactataagtataccaggtagtatagacactggcattttaaagagcattattgaggagcaaggttggaatgacgctgagttatatagaagttcaatacaaaatcaaagattttttttaacggataaatacactaaaaagaagcatttgactatggaggacatgcttagcccagaagaagaacaaatatatcaggaacctattcaagatttccaaacatataacaaacgtgttcaaagggaatatgagctcagggaaaggatggaagaattcttccgtcaaaacaccaaaaatgatttacatattttaaacgaggattcattaaatcagcaatattccccgttaggacctgcagattatgttctgcccctcgatagatactccagaatgaaacacattgcctcaaactttttcagaaaaaaacttggtattcctagaaaactgaaaagaagaagccattataatcccaacgcagagggccacaccaaagggaattcttctatattgagttccactactgatgtaattgataacgccagctacaggaatattgcaatagatgaaaatgttgacataacacataaagaacacgccattgacgaaataaacgagcagggtgcatcaggtagtgaatctgttgtggaaggtggatcgttattgcatgacattgaaaaggttttcaataggtccagggcaactaggaaataccatatccaacggaaattaaaagtgcgccatattcaaatgctttctatcggggcttgctttagtgtcggattatttttaacctcagggaaagccttttctattgccgggccatttggtacactacttgggtttggactcacaggtagcatcattttagccacaatgctgtcatttacagagttatccacccttattcctgtgtcttctgggttctcaggactggcttctagatttgtagaggatgctttcggatttgcattgggctggacgtattggatttcctgtatgcttgctcttcctgcccaagtttcctcaagtacattctatctcagctattataataatgtcaatatatcaaagggagtaacagcagggtttatcacgctgttttctgcatttagcattgtagtaaatttactggatgtcagcataatgggtgaaattgtatatgttgctggaataagcaaagtgataattgcaattttgatggttttcacgatgatcatcctaaatgccggacatggaaatgacattcacgaaggagtcggttttagatattgggatagctctaaatctgtccgaaatttgacctacgggctatatcgtccaacatttgacctggctgatgctggcgaaggaagcaaaaaaggaatttcaggcccaaaaggccgatttttagctacggcatcagtaatgctaatttcaacatttgcgtttagcggtgttgagatgacttttttagctagtggggaagctataaatccaaggaaaacaattccttctgctacaaaaaggacattttccattgtactgatatcttacgtttttttgattttttcggtaggcatcaacatatacagtggcgatccaagactactatcatattttcctggtatttccgaaaagaggtatgaagccattataaaaggcacaggaatggactggagacttaggactaattgtcgcggcggtattgattataggcagatttcagtaggaacaggttattctagtccttgggttgttgcattgcagaactttgggctatgtactttcgcatctgcttttaacgcaatactgatatttttcactgctacagcagggatatcctcgttatttagttgttcaagaacactatacgccatgtctgtacaacggaaggcaccgccagttttcgaaatttgcagcaagagaggtgttccttatgtttcagtgatattctcctctttattttcagtcattgcttatattgcagttgaccaaaccgcgattgaaaacttcgacgtcttggccaatgtttctagtgctagtacgtctattatatggatgggattgaatctttcctttttgcgattctattacgccctaaaacaaaggaaggatattatatcaagaaatgattcatcatacccatataaatcgccattccaaccatatctagcgatttatggtctagttggatgttcattatttgttatatttatgggatatcctaactttatacatcatttctggagtactaaagcttttttttcagcatatggtggcctgatgtttttctttatcagttacacagcttataaggttctcggaacgtcaaagattcaaagactagatcagttagatatggacagtgggaggagggaaatggacagaactgactggaccgaacatagccaatatttgggaacatatagggaaagagcgaagaagttggttacctggctgatttagctcgagacccagctttcttgtacaaagtggtgataaattggagctctgcagagctttcgttcgtatcatcggtttcgacaacgtt

SEQ ID NO: 398 - DNA, 2181 bp, Saccharomyces cerevisiae
ttatttgtcagctttcaaactctttgtttcttgtttgttgattaacccttaattaagatgaaacctccgttaaacatgtcacgttcaaataaaccacttactcaggaagctaatagttcggcgcatattgatagggcacatcagctagcacaggattttaacagtaaacaggatgataccgcactaacttcactgccccacaagaaccccgacatattcagatttgagaacaacatcacagctcatagctcgcgtcgtggttctctatatagagacagcgatgctactgtggttttgccgctttctgaacatacccctagattatcaatggatgatccataccgccaattactacaacaggctgaaatctcacaactacgaagtaagaaaaaaaggcattccagtcgagttttgcgtacttcgtttatatcttttgtggtgctagtttcctcgctgtcagggttggaccaaggcctcatatctggtaacgttatgactttgtcgttccagaagtattttcattacccacttacttctccgctgggcaatatagtgagcattgttaatctgggtgcgttcatggcgtcgttatttgtctattctggcatcctggagccttgtagcaggaaaaaaatgctccaaataagcacaatgatatactctttgggtgccattgttcaggtcttggctctaaaccaatggtgtttactactgggtagattcttactcggagtaggtatgggctttgccttttctatggtaataatttatcaattcgagtttccccttccctgtataagaaaacggacattaatttccattcaatgcgtctctagtgtcattgcgtattcattcggaatatggattaattgtgctttcagatatttgggctttgcatggagataccctttgtcaacacatgtggcacttggaataatactaaacctaatgtcgttctatcttattttagagtccccttcgtggctgttgaagcaaaagaacgacgtagaggcattggttttaatatcgaatgttttcgatgatggaaatttcgaagaaaaccaaactcagttgaaatttagggtcctgaaacgagacatattattaaagtcacaccttcaaaaaaactcctatccatatgcgtatatcttaaaggatttttcttcaataataaaattgttgataggtttccaacttctcacacgaacaaatggagtggatgctttcttgtattactcaccgttaatattacaacaaatggggagaggagaaagaaaatctatctatttaacggggcttaatgctttaatttacagcatcgtaatattagcatatgttcccttggtgttacggaaacgtaaagagaaaacgaatgtactcttaggttcgattgtgatgtgtgcattgctatttaccatatcttttacagactggtttcccaagagcacaacgaggtatatatcaatactatttgctgtttttctttttacgcacttcatcagttgggattctataggatgggttatgaccattgagcttctacctcacttgtcacaggccccagtgatactactagtctcaaacttttattggatttttaagtggttcgtcagcttaataacccctatacttattgaccgtctgtcttggaagttttatcttattccatctttatcttcctttatttccattatatttgtgctgaagatttttcctatagaaacccgtgacgaaaggttagattctgatgatgattctaccggaaacggtagcggtaaccatgatgatgtttttgacgataccggttctgaattctcctcctcaccatctttttccgcgtatcagataaacactctaggaagtagtatcaaacaaaataatcaagcctattcatctattcaaaatgagcagattctacccaaaaacggaaacttatcgaaccagacacacggttctgcacaaaatgtttatttcattacatctgattcaggaccatcaaggactggagaatttttcagttttcataacagaaccgatccaaatatcagcgacaacattgctgcgaataaacccagttcaggtggaggccagaattcgcctggagacatggcagttgcctagatttaaatacccagcaaattggagctctgcagagctttcgttcgtatcatcggtttcgac

SEQ ID NO: 399 - DNA, 1745 bp, Saccharomyces cerevisiae
aactctttgtttcttgtttgttgattaacccttaattaatccgggcgcgcctgatttatcacaagtttgtacaaaaaagcaggctcctgcaggaccatggaagacaaagatatcacatcggtaaatgagaaggaagtgaacgagaacactaatcctagaataataaaatatgatgccgagaggcgtgcaacccgtactgaaacctcaaagaaagataaatggaaaaacatagttacaatcattgcgtccggttttgctctgataagtgatggttacgtaaatggttcaatgagtatgctaaacaaggtttttgttatggagtacggtaagaaaaactatagctcaaaagtgtcgactagagtttccaacgcagccctagttggtattatttttggccaattctttatgggtatcgctgctgattattatagtagaaaatcttgtatccttgtggccactgctatcttggttattggtagtgctctgtgtgctgcctctcacggtactactgtacctggcatgttttggatgttaacagttatgagaggtttggtaggtattggtgttggtgcagaatatcctaccagtacattaagtgctaatgagtctgctaatgaatataccactaccaaaagaggtggtatcctggttatggtgacaaatttgccactagccttcggtggtccatttgctacgatcatctttttaatcgtctacaaaatctgttcaggaacaaaacatttagaggcgatctggaggactgtttttgcaatagggtgcttctggccattgagtgtgttctattttagatggaagactgctactacagaagtctatgaaaaaggtagaatcaagagaaatataccatatttcctagcattgaaattttattggaaaaggttacttggtacatgtggtacatggtttatgtatgattttgttaccttcccaaatggtattttcagttcaacaattatcagttccgttatcaaggaccaaaatgatttagtaaaagtggcagagtggaacttactgttgggagttttagctgtactgggtgtaccaattggtgcttatctgtccgatcgtattggtcgtaaatatacgttgatgtttggtttctctgggtacatcatctttggtctaatcattggatgtgcgtacgaccaattgaaaaaaatcacccccttgtttattatcttctacgcattcatgaatatgttaggtaatgctggaccaggtgatatgcttggtgttattagtagtgaagcgtcagcaaccgctgttagaggtgttttctatggtttatctgctgtgactggtaaaatcggttctgtagtaggcgtcgaatgtttccaacccattagggataatttgggtgcaagatggacttttattattgctgcaatttgtggtcttattggtatcattattacatatttctttgttccacattctcttgaaagcgatttaatgaagcaagacgttgaatttcacaactatttggtatccaatggctggactggtaagatgggatttgatgagacagatgaagaatcaatggttagaactattgaagttgaagagaatggtactaattgtagtaagaaaaacgcagaaataatttcagtcagacaggtcgatcaaagttgactcgagacccagctttcttgtacaaagtggtgataaattggagctctgcagagctttcgttcgtatcatcggtttcgacaacgttcgtcaag

SEQ ID NO: 400 - DNA, 1883 bp, Saccharomyces cerevisiae
ttcatttatttgtcagctttcaaactctttgtttcttgtttgttgattaacccttaattaagatgaccgaagactttatttcttctgtcaagcgttcaaatgaggagctgaaggagcgaaaatctaactttggatttgtagaatacaaatccaagcaattaacatcatcctcatcacacaattcaaactcatcgcatcacgatgatgacaaccaacacggcaagaggaatattttccagcgatgtgttgattctttcaagtctcctctggacggctcgttcgacacaagtaatttgaagaggactctgaaaccaaggcacttaatcatgattgccattgggggcagtataggtactggtttgtttgtcggtagtggtaaggcaatcgccgaaggtggtcctcttggtgtcgtcattggttgggctattgcaggctctcaaatcatcgggacgattcatgggctaggtgaaatcacggtgcggttccccgttgtcggggcctttgccaattacggcacaaggtttttggatccaagtataagttttgttgtttcgaccatatacgtgctacagtggttttttgtattacccttagaaatcattgcggcggcaatgaccgtacagtactggaactcgtctattgaccccgtaatttgggtagccatcttttatgctgttattgtttccataaatttgtttggtgtacgaggttttggggaagcggaatttgcattttccaccataaaagcaataacagtttgcggattcattatattgtgcgttgtcctcatttgcggtggaggtcccgaccacgagttcattggcgccaaatactggcacgaccctggttgtttggccaatgggttcccgggcgttctatctgttcttgttgttgcttcgtattctctcggtggtatagaaatgacgtgcctggcatcaggtgaaacggaccccaaaggcttaccaagtgctatcaagcaagtgttttggaggatcttatttttctttttgatatcactgaccctggtaggattcctggttccatatacaaaccaaaacttactgggtggttcatctgtggacaactcaccttttgtcattgccataaaattgcatcacattaaagccttgccctccatcgtcaatgcggtcatccttatcagtgttttgagtgtaggtaactcctgcatcttcgcttcaagtagaacgttgtgttcgatggcccaccaaggccttattccatggtggtttggttatatcgaccgtgctggtaggccactggttggcattatggcaaattcactatttggattactagcatttctggtcaaatctggctcgatgtctgaagttttcaattggttaatggccattgccggcctggccacgtgcattgtctggttgagcatcaacctgtcacatatcagatttagactggcgatgaaggctcaagggaagtctctggatgaattagaatttgttagtgctgtcgggatttggggatcagcgtattccgctttaatcaactgtctaatcttgatagctcaattctattgttcactatggcccattggtggctggaccagcggcaaagaaagggctaaaatattttttcaaaattatctgtgtgccttaatcatgttatttatattcatcgtccacaaaatttattacaagtgtcaaacaggcaaatggtggggggttaaggcgttaaaggacatagatttggaaaccgatcgtaaagatatcgacatcgaaatagtcaagcaagaaattgccgaaaagaaaatgtacctagattcccgtccatggtacgtgagacagttccatttctggtgttaaatttaaatacccagcaaattggagctctgcagagctttcgtt

SEQ ID NO: 401 - DNA, 1412 bp, Arabidopsis thaliana
ttaattaatcggaaaaatgagtaagaaatcgacagaatctgacgctggcaatactgagaagcaatggtccctggcagatttcgagatcgggagaccacttggaaaaggcaaatttggcagagtctatctcgcccgagaagccaaggtactcgtttcctttcgattatgttgtaattgttagattggggtagaaatttcgttcagtttgagcttttactgtcatcgaaaccctaattttatgaatcaattgctgttttggttgaatttgggatatagagcaagtacatagtggcgctgaaagtcatattcaaggaacagatagagaagtataaaattcatcatcagcttaggagagaaatggagatccaaacgagtttaaggcacccaaatatcttgcgtctttttggttggttccatgacaatgagaggattttcttgattctcgagtatgctcatggtggtgagctctatggtgtgctcaaacagaatggtcatcttactgaacaacaagccgccactgtgagtctctctctcgctccctctccccttttaatcccaattttgcctgaaatgttcactttgttgcaatgttggttgtgcaatgcttctcaattgattcttgtgatgaaactgatggcttttcctttatttcagtacattgcaagtctcagtcaggcactggcctattgtcatggcaaatgtgtgattcatagagacatcaaacctgaaaatttgttgctcgatcatgaggtatgtgtgtatggttatagtttttgcattgagaactcaggatatgcatcattggtattgtcatatacttgcaggggagattgaaaattgctgactttggatggtcagttcagtcaagtaacaagaggaaaacaatgtgtggaaccttggattacttagcacctgagatggtagaaaatagagatcatgattatgcagttgataactggaccttaggcatactgtgttacgagtttctctacggtaaccctccattcgaagccgagagtcaaaaagatacattcaagaggtaagaaaagactagactttttatcttttgtagaaaattacagaagctcagctcctgatgacgttttgtattcactgtcatgcagaattcttaagattgatctgagttttcctcttacaccgaatgtttcagaagaagccaaaaatcttatcagtcaggtacacacccaaccaagctaaagcatacccacaacgactctcttgcttgactagttattaagcattaacatatagttgttttaaatcttttgcagcttcttgttaaggatccctccaaacgactctctattgagaagatcatgcaacatccatggattgtcaagaacgcagatccgaaaggtgtgtgtgcctcaattgatatttgatggcgcgcc

SEQ ID NO: 402 - DNA, 1414 bp, Arabidopsis thaliana
ttaattaaatggagccgcgagtcggaaacaagtttcggctcggaaggaagatcggcggtggatcattcggagagatctatcttggtaccaatatccagacgaatgaagaagtggctattaaacttgaaaatgtgaaaactaagcatcctcagttgctgtatgaatcaaagttgtacaaagtattacaaggaggaactggcgttccaaacgttaaatggtatggtgttgaaggggactataatgtcctcgtgatagacttgttggggcctagccttgaagatctattcaatttctgtagtaggaaactctcactaaagactgtactaatgcttgcagatcaaatgatcaatcgcattgagtttgtacatcagaagtcatttctacatcgggacatcaagcctgacaactttctgatgggtcttggaaggcgtgcaaatcaggtatacgtcatcgactttggtctggcaaagaagtacagagactcaaatcatcagcatattccatatagggaaaacaaaaacttgactggaactgctagatacgctagcatgaacactcaccttggcattgaacaaagtcgtagagatgatttggagtcacttggattcgttctcatgtacttcttaaaaggaagtcttccttggcaaggactgaaagctggcaataagaagcaaaagtatgagaaaatcagtgaaaagaaagtatcgacatctattgaggctttatgccgaggttatccatctgaatttgcatcttatttccattattgccgttctctgagatttgacgacaagccagactatgcctacctgaaacggcttttccgcgacctgtttattcgtgaaggcttccagtttgattatgtatttgattggacgatcttgaagtatcagcaatcacagatttctactcctcctcctcgtcatcatggtcctgtagttgggccaagctctgccctcccccctgccattaccagtgctgagaggccatcaggtggcgacgaagctagaccttctggctggtcatcaggaatccctagacgaaattctggacaaatttttaactcaggaagcttagctaaacaaaaagcaccagtttcaagtgatcctgcaatatctaaagatgtagtgttatcaagctctagctttctccgcgcaactgggtcatcaagacgtgctgctgtatccagtagtcgcgaagctgcagttctgggaactgattctgagccatcaaaccctcaaatcgttgaagctggatcaggctccaattcaaagatccctgttagtcgaaactcacctatcgtctcatctgagatcaacaagctatcatcaccttcaagggcgactacttcagtcatgaagaactatgaggctaatcttaaagggatcgagagtctgcatttttagggcgcgcc

SEQ ID NO: 403 - DNA, 826 bp, Arabidopsis thaliana
ttaattaattctatttgcaatggagttcgaaaggtatctgggggaaggttcgtttggatcggtgagccttttcagttataaaagacgatgcgacgttgagactctctacgccgccgtgaaaacctctgacgatgctaagtctctctacgaagagtttcagattctgtctaaattcaagggttgctcgagaatcgtccaatgctacggtagcggagtagaacagagacttaacgacaagggttacgtagagtacacgattcctatggagtacgcagccggaggaagcttgagcgatttcatggaccgattcaacgacaaaaaattgcctgatccgatgatcagaaagtttactcgtatgcttctcgagggtttagccacaattcacagacacggctatgttcactgcgatctcaaacccgagaacatccttgttttccctggttctgtctgcgatctcaaattgaagatttctgattttgggttgtcgaaaagagatggagacactacgtggtggcatcctcttaaatcgtatgcgggaacaccgatctatatgtcgccggagtctatctctcacggggagatagggaaaggacttgacttatggtcgttgggatgtgttgtgttggagatgtacactgggaagagaccatggtggcatactaactatgaactagaagatctcatgaagtgttacgagccattgtttccgcctaatcttccttgtgatgcaaaactctttctcatgacctgctttgcgcctgaaccagatgagaggaaagacgcgttgacattgttgagacaaagcttctttcgttgagggcgcgcc

SEQ ID NO: 404 - DNA, 1262 bp, Arabidopsis thaliana
ttaattaaaaattccttctttaaatccccattgttgtaagtcttaaagaaaaaagaagatgacttgttgtttctcttgtttgaatcctcgaaccaaggacataagagtcgacattgataacgctcgatgcaactctcgttaccaaaccgattcatcagttcatggaagtgatacaacaggaacagagtcgatttcgggtatcttagtaaatggtaaagtgaatagtccgatacctggtggtggagctcggagcttcacgttcaaggagttagctgcagctacaagaaacttccgggaagttaatttgctcggagaaggaggttttggcagagtttataagggacgtttagattcaggacaagtagtggctattaagcaattgaatccagatgggcttcaagggaaccgagagtttatagtagaagttcttatgcttagcttattgcatcatcccaatctcgttacattgatcggttactgtacttctggtgatcaaagacttcttgtctatgaatacatgccaatgggaagcttagaagatcacctttttgatcttgagtctaatcaagaaccattaagctggaatactcgaatgaaaatcgcggttggtgcagctcgaggaatagagtatcttcactgcacagctaacccgccagtgatttaccgtgatttgaaatccgcaaacatattgttagataaagagttcagtccaaaactctcggatttcggattggcgaaactcggtccagttggtgatcgaactcatgtatcgactcgtgtcatgggaacttacggttactgtgctcctgaatacgcaatgagcgggaaattaactgttaaatcggatatctactgcttcggtgtagtgttgcttgagctgattactgggagaaaagctattgatttaggtcaaaagcaaggcgagcagaatcttgttacttggtcacgtccatacctcaaggatcagaagaagtttggacatttagtggatccgtctctacgaggaaaatacccaagacggtgtttaaactatgcgattgcgattattgcaatgtgtcttaatgaagaagctcattatcgaccgttcataggtgacatagttgtggcactagagtacttagccgcacagagcagatctcatgaagctcgaaacgtctcatcaccgtcaccagagatttcaagaacgccgcgacgagacttgtaaaaactcaaaaacagcttttaagaatttcagtttggtgttgtgtaaaaatgggcgcgcc

SEQ ID NO: 405 - DNA, 1291 bp, Arabidopsis thaliana
ttaattaaatgagagactcttcaacaactgcatccaccaaatcctcaccgttatggaaaccctttgcctcaaactgttgttccgttgatgaccaaaccgtctttggcaatctcagccgttgccgaccttcgagatcagaattctccaagaaccatctcggaccacttccttcttttcggcgactctcctttgctgatctaagccgttcttcttcggctaggatcaatgaagatcttgcacagactcttggagccgacttagtggattttcagatgtgtgaactcaagatgatcactcagagtttctccgggaactatcttctcggagaaggtgggttcggtaaagtgtataaaggttatgttgatgattatctccgacaaagtctcaaggctcagcctgttgctgtcaagctattggacattgaggggcttcaaggacatcgtgaatggctttctgaggtcatatttcttggacagctaaaacacccgaatttagtcaaacttattggttactgctgcgaagaagaggaacgagtactcatctacgagtttatgccacgtggtagcctagaaaatcacctcttcagacggatatcactatcgttgccgtgggcgacgcggctgaagatagcggtcgcagctgctaagggtttggcgtttttgcatgatttggagagtccaatcatttaccgtgatttcaaaacttctaatatactacttgattcggattttactgcaaaactctcagattttgggttggcaaaaatgggaccagaaggatccaaatctcatgtcacaactcgagtcatgggcacttatggttatgctgctcctgaatatgtttcaacagggcatttaacaacaaagagtgacgtgtatagttatggcgtcgttttactcgagctcctaacgggaagaagagccacagaaaagtcacggccaaaaaaccagcagaacatcatcgactggtcaaagccttatctaacaagcagccgccgactccgatgtgttatggacccgaggctcgctggacaatactccgtcaaggcggctaaagatacagctcttctagccttacaatgtgtgagcccaaaccctaaagaccggcccaaaatgcttgccgttgtggaagctctagagagtctcatacattataaggacatggcggtttcttctggtcattggccactgtctcctaaatctcagggcgggaaggtttccccgaaggttcgaggggatcatcggagtggtagaaaatcagctccgggttcgttaagatcgtgaggcgcgcc

SEQ ID NO: 406 - DNA, 1424 bp, Arabidopsis thaliana
ttaattaaaccccagagaataaaaagtttcctccgccgctggtggcgatgccggcgttacatcccacgtttccactgccggaaacaggacataaactgagacccgccgctaccccgcctcgtgaaaaaccgcaacataggacgacgagatccgtcgagaacccacctcgtgaaaaaccgcaggagaagacaagatccgtcgagaacccgcctcgtgaaaaaccgcaggagaaaacaagatccgttgaaaccccacctcaggagaagacgagacccgtcgataatccgccgtcaaagccggtagaaaaattgggtttaggaaggaaagcagtgccaccgagtgggaagatagtgacacctaatctaaagatgtttacattagtggagcttaagacggctacaaagaactttcgaccagaatctgtgatcggagaaggtggattcggacaggtttttaaaggatgggtggatgagaaaacattagctccgtcgagagctggcgtcggaataccagtcgccgtcaagaaatcaaaccctgatagtgagcaaggcttacatgaatggcagtgtgaagtgagattcttagggaagtttcatcatccaaatttggtgaagctcttgggttattgctgggaagagaaccagttccttttggtctatgagtatttgcctaaaggaagccttgaaaatcacctcttctcaaaaggagcagaggcattaccttgggatacacgtttgaagatagccattgaagcagctcaaggacttacctttttgcataactccgagaagagtgttatctatagagacttcaaagcttccaatattcttctcgattccaacttccacgccaagctttcagacttcggactagctaaaaatgggcccattaatggattctcacacgtgaccacacgtgtcatgggcacacaaggctatgcagctcccgagtacatggctacaggtcatctatatgtgaggagtgatgtttacgggtttggagtggtactcttagagctcttaaccggtttaagagcattagacccaaaccgaccatctgcgcaacaaaatcttgtggaatgggctaaaccggggttgaaccagaagaagaaggttcagaaaatgatggatccacggctcgagcagaagtatccacttttggcggtgaccaaaaccgcggagctcattcttcggtgtctggaggctgacccgaaaaaccgaccgccaatggatgatgtgcttagagaattagaagtcgtaaggactatcagagaccaaccccaagaagagaggcgtaaaaggagcagtggtccagatactaaccgggttcgtggaaatgattcaccatatggccgtagaaccggtcgaaccggatagtcaaagagttcttttggatcagtcatacgtatattacacaggcgcgcc

SEQ ID NO: 407 - DNA, 1806 bp, Arabidopsis thaliana
ttaattaatttttctccgggaaaggtttttcttttttgaagatttcatgcaaatggaggctaatgactgtcaagaggaacataagttcactctcgacaactatcatgtcgtggagcaggttagaagaggcaagtcctcttccgatttcgtggttcttcatgatattgaagacaaaaagtatgcaatgaagaagatttgcctagcgaaacacacggacaagttaaagcaaaccgctttacaagagatgaaattgctctcaagcttaaagaatccttatatcgtgcattatgaagattcttggattgacaatgacaataatgcctgcatttttactgcttactatgagggagggaacatggctaatgctattaagaaagcgagaggaaaattattcccggaggaaagaatctttaaatggttggcacaattgttactggctgttaactatttgcactcaaaccgtgtagttcacatggatctaacgtgttcaaatattttcctgccgaaagatgatcacgtccagcttggtaattatggtctggcgaaacttataaatccagaaaagcctgtttccatggtttcgggtatctctaacagcatgtgccctgaggtattagaagatcaaccatatggatataaatctgacatatggtcgctgggttgttgtatgtatgaaattacagcacaccagcctgcgtttaaagctccggatatggctggactcatcaataaaataaacagatcccttatgtctcctcttccgatcgtctactcctctaccttgaaacaaatgataaagcttatgcttaggaagaaaccagaatatcggccaacagcctgcgaattgttaagaaacccatctctacaaccataccttcttcaatgccaaaacctgtcgcctatttatcttccggttttcccgataaagccggtaaatagtccgaaggataaagcaagaagaaactcattgccaggaaagtttggaaaggaaagagtttcaagagagaagagcgaggtgtcccgcagtttggaaaatctatatccattttggacgaatacagagactggatctagcagctcatcgcaaccggcatcatctacgaatggcgcagaagacaaacttgaaacaaaaagaatcgatccaagctgtgacacattgaagatttctgagtttacaagccagaagtcggatgagagcttaattgatcctgatattgcagtttactctacagaaacgccagccgaagaaaatgctctgccaaaagaaactgaaaatatattctctgaggaatctcagttacgtgatgttgatgttggggttgtgagtgcacaagaagtagcatgttcccctccaagagccatcgaagaagctgaaactcaggaggcattacctaaaccaaaggaacagataacagtgcccatttctagtgttgcacattcatctactgaagttgcagcagcaaaagaccatttgtctggaagccttgagggcgataaagcaaagatggtgaaactaacagcgagtgaaatgtcatcggtactaagtaagctcacaaaattgggtccgccgcagagtaaagaaagggcagatgcattagagtgtttattggagaaatgtgcagggcttgtaaagcaagagaaatatgaagaacttgctggtttgcttacaccatttggggaagatggtgtctcggctagggacactgcaatttggttcgcaaagacactcttgtcgtctgacaaactcaaccaaggaacctgattgagttagagacaaatttccctttttggtttttgtggcgcgcc

SEQ ID NO: 408 - DNA, 2034 bp, Arabidopsis thaliana
ttaattaactcatggtaaaacctagctcctctgtttcctctgtttctatgtttgctctgttttctcttgtcctctgtattcttattcattgcttgtacaccaaaaaacctagcttcttccaacgttttctctcccttctcctcccagatctaagattactagaggtagataaagagaagcaagaccccaaatcaccaagaggagccctcgaagcctgcttaactcgttgctcaatctcttccgcttcatcttcatctgacgatcctcctccaaacagagaagctatcgacaatgcagatgcagacacagacgtacagtgcaagaatcacagagcatcttctaattggggaaaattcttcaagctatggaaacgcagatccatgaaacgcctctcttcctttcctccattaagtggcgccgccccaccgatcatcaaacaaaacaaaagtgcagatccaaacatgaatggcatggtccttcacgatatctacgatttccaatcatctctccaaaacttctcaatatctgacatcgaaattgcaactgacaatttcagtccaggtatcgagtttatcttcataacaatatactctcttcttttttacttgaaggactgtttggttgctactattactgcaattaaaacgacgcttctatgcagaaaacattatcggtagaggcggttacgccgatgtataccagggaattctaccggaaggaaagctaatcgctgtgaaacgtttgacaaaaggcacaccggacgagcaaacagctgagtttctatcggaacttgggattattgctcatgttgatcatcctaacactgccaaattcatcggttgttgcatcgagggtggaatgcatctcgtgttccggctatctcctcttggaagcttaggctctctcctccatggtttctatatccacccataaacttaacggatatacatatcgggcttttaagcttatcatatctaaatgctcaaattaatttgtacaggaccatcaaaatataagctgacttggagcagacgttacaatgtagcgttaggaacagcagatggactagtgtatcttcatgagggttgtcaaagacgaatcattcatcgagacatcaaagctgataatattcttctcaccgaagattttcaaccgcagatttgcgacttcgggttagccaaatggcttcccaagcaattgacacaccataacgtatccaaatttgagggaacattcgggtaacaatttgaaattttttaggaaaagtttttttttatgtggttcagttgagaatttggttggacaatgttttaggtactttgcacctgaatatttcatgcacggaatcgtggacgagaagactgatgttttcgcttttggagttctcctcttggagctcataaccggacatcctgcccttgacgagtctcagcagagccttgtcttatgggtgagtatatagaccagtttgacatttgaggctaaaccggaccggttcactatccttttatcagtctggtacgagttacgtttcctttttgcttacaggctaagccgttgctagagagaaaagctataaaagaattggtggatccatctcttggagatgagtataaccgagaagagcttatccggttaacttccacggcttctttatgcatcgatcaatcttctcttctacgaccccggatgagccaggtataatattgtaattccatcccggttaaggtttcaaagtgggaaagaaccaaatgtcaaattcgttttggttccggttttgatactgtttctttaaatgtatccaggttgtggaattattactaggccacgaagatgtcgtaatgactccaagagaagcgaagataaagatgatgcaacgaacgtattccgaagaattattagatagtgtagaatataactccactaagtacttgggagatcttgatcgcattcgagaggttgctttagcctcttgaaatcgatccaaattattattatgtaaaactattttggtttctttcattggggcgcgcc

SEQ ID NO: 409 - DNA, 1429 bp, Arabidopsis thaliana
ttaattaaatgggttatctctcttgcaacggcgaatccgccgtcgcaatctgcgatacttataactggaatcctcgtcgacgatctaaagtaccggagaaacgtcatcctcctaagcttcgggttttcaactacgacgaactcgccgtcgctactaacggcttctccgccaataacttcctcggaaaaggaagtcacggcagagtttacaaagcagttctcgacgacggaaagcttctcgccgccgtcaagagaacaacaatcaccactaccgttggtaataacaataacaacgtgagtcaggtagacaatgagatcgagattctttcacgggttcgtcaccgttggatggtcaacttaatcggttactgcgttgaccaccggaggaaaacaaagctgttagtcgtcgagtacatgcctaacggtacgcttcacgatcagttacattctcgtagttcgttagattcacggttaagtagttggaatcggagaattaaacacgcgcttcagatcgcgattgctgtccacgctcttcacaccgcagagactcaagtgatccaccgtgacattaaatcgtgtaacgttttaatagacggtgacggtaacgctaggttagctgatttcggattagcattgatcggaaacgttgacgatgagcgtttgaaatatactccgccggcgggtacgttgggatatttagatccgtcgtacttagcaccggcggacttgacggctaagagcgatgttttcagctttgggatattgttgttggagattattagtggtagagaagccattgatttgaattatagtccgtcgtgtatcgttgattgggcggtgccgcttatcaaacgcggcgattacgacgcgatttgtgatttgaagattaagaaccgtccttattacgccgtgattcggaagttggccgttatggcggctaggtgtgttagatcgacggcgaagaaacgtccagatatgttagaggttgttgagtgtttgaaaacggtgaggcagttatctccggcgtggaataaactgcggcggaggagtgaagagagatcggaaaatgttttggcggttgaggaagagaaggaagagattcatgtgaggattgtgagaggaggaagcaggaagaatcggaaggtatcgaacgtgacgacgagtgtggatgatgtttacgagagattagttccggaggaaacgctgccgtttcgtcgtcggaattttgtgctgagatcgagatcagtaggagcgaaagttggaccggatccatacgacgggtttggtgatgagacggtggttacaatgagattacttattgagaaagaaagaccggtgacgacggcagcgatgaggctgagtaagtcgaggtcggtggggattgtacgtagtcataaaacggcgtcgcggaagagatactgaggcgcgcc

SEQ ID NO: 410 - DNA, 1377 bp, Arabidopsis thaliana
ttaattaaatggaaaacaaaagccatagcaaccaccaccggtaccatcatctatcatcccggagccacgagcaaaaccagcgtggcctaatttcgataaatgccataatcatcattggcatctccattatctccatattcataatccttgcaattctcctaataatcattttacttcatcgacttaaatccgcaagagtcaaagcacaagaattatcttgcaaagaaagcttcaacaacatgaacaatggtggagcttccaccaactacagctacacttctagccctgatgacatcaagagagattgtctatactcaagaaacccaacatcgttcagacaattacccccacagacaaaaagttgtaggagaagccgagccgaaggagtagaagtgtacacatacaaggaattagagattgcaacaaataatttcagcgaggagaagaaaatcggaaatggagatgtgtacaaaggagtactaagtgatggaactgttgcggccattaaaaagcttcatatgtttaatgataatgctagtaaccaaaagcatgaagaacggtcctttaggcttgaggttgatcttcttagtcgattacaatgcccatatttggtggaattacttggatattgtgcagatcaaaaccataggatcctgatatatgaatttatgcctaatggtactgtggaacatcatctccacgatcataattttaagaatctaaaggatcgacctcaaccattagattggggagctcggcttaggatcgcccttgattgcgccagagccctagagtttcttcatgagaatacaatctctactgttatccaccggaacttcaagtgtaccaacattttgttggatcaaaataatcgagctaaagtttcagatttcggattagccaaaaccggatccgataaactaaacggtgagatttcaacaagggttattggcaccacaggatatcttgctccagagtatgcctctactggaaagcttactacaaaatcagatgtttatagttatggtattgtgttactacaactcttaacgggtcgcacaccgatcgattcaagacgtccacggggacaagatgtccttgtctcttgggctcttccaagactaaccaatagagagaaaattagtgaaatggtggatccaaccatgaaaggtcaatactcacaaaaagatcttattcaggtagcagccatagcagcagtgtgtgtgcaaccagaagcaagttatagaccgttgatgacggatgttgttcactcgctcattccccttgttaaagctttcaacaaaagtactgattcttctcggtttcctagccgtagagaaagcttgtcatttgatgatattatgccatgaggcgcgc

SEQ ID NO: 411 - DNA, 1162 bp, Arabidopsis thaliana
ttaattaaatggagcaaaaagttttcccatttcaagttttagtttccgctaccaaagattttcacccgacccataaactcggtgaaggtggtttcggtcccgtcttcaagggaagattacctgacgggagagacatagcagtgaagaagctatctcaggtttcaaggcaaggcaaaaacgagtttgtgaacgaggctaagttgttggctaaagttcagcatcgcaatgttgttaatctttggggttattgtacacatggagatgataagctcttggtttatgagtatgtcgttaatgagagcctcgacaaggtcctcttcaaatccaacagaaaatcggagatagattggaagcagaggtttgagatcataacaggcattgctcgaggactgctctatctacatgaagacgcgccaaactgcatcatccacagggatattaaggctggcaatattttgctggatgaaaaatgggttcctaagattgcagattttgggatggctagactctatcaggaagatgtaacacatgtcaacactcgtgttgcaggaaccaatggttatatggcgccagagtacgtaatgcacggggttctatcggtaaaggcagacgtattcagctttggggttttggttctggagctcgtaagtggacagaagaactcgagttttagcatgagacaccctgaccagactcttcttgaatgggcatttaagttgtacaagaaaggccggaccatggagatactagaccaagatatagcagcttcagctgatccagatcaagtcaaactctgtgtacagatcggactactctgcgttcaaggcgatccgcatcaaagaccgagcatgagacgggtatctctacttctctctagaaaaccaggacatctagaagaaccggatcatcctggtgtcccgggatctagataccgtcggcgaacacaacgtccttcaggagcagcatcacttggaacattgtcgaccactggttccagcacagattctttcggttcaaacctgaacacaaacacgggaactggtgttagaggtacccccgcatcttctaaagcttcaactcggagtaatgccactagaagtgctggtcagagctctagctcagaccctcacgggaaacgacatatgagttattgaggcgcgcc

SEQ ID NO: 412 - DNA, 1077 bp, Arabidopsis thaliana
ttaattaactgagtacagtcgcggtagaagagtcgtccgagaagaagatggtgaaagggattagggtttatgagcatggcggtcctgaggttctgaaatgggaagatgtggaagtaggggaaccaaaggagggtgagatacgtgtgaagaacaaggctatcgggcttaactttattgatgtttacttcaggaaaggtgtttacaagccagcttctatgcccttcacaccaggtatggaggctgttggagaggtggtagctgttgggtcgggattgactggcagaatgatcggtgatctcgttgcttatgctggaaatccgatgggtgcgtatgctgaggaacaaatccttccagcggataaagtggttcctgttccttcatctattgatcctatcgttgcagcatcaatcatgctcaagggtatgactgcacagtttctccttcgccgttgcttcaaggtcgaacctgggcacacaatccttgttcatgctgcagctggtggagttgggtctctgttgtgtcaatgggcaaatgcgcttggagccactgtgattggaactgtctcgaccaatgagaaagcggctcaagccaaagaagatggatgccaccatgttattatgtacaagaacgaggattttgtttcccgagtcaatgacattacatcgggtaaaggagtaaatgttgtttatgactctgtgggaaaagacacctttaagggatcgttagcatgtttgaagagccgaggatacatggtgagctttggacaatcctcaggatctccagatccgattccattatctgatcttgctccaaagtcgctcttcttgacaagaccttccatgatgcattacaatgaaactcgagatgagctcttggaatgtgcaggagaggttttcgctaatgttacctccggcatcttaaaggctcgtgtgaatcacaagtacccgttgtctcgagtcgctgacgcccacgcagatcttgagaataggatcacctctggctccgttgtgctcttgccatgaaaacatatacaatgatgttagtatctttcaatagggcaatgagattcggcgcgcc

SEQ ID NO: 413 - DNA, 1824 bp, Arabidopsis thaliana
ttaattaaacatataacacagtgagaaaacagagcaaaaacagagagatattacgatgtttttctctaaggatcttccttcacctacttcggttttcacagcttacgcatcaatggcgggttacatgatgatgataagatcaatggctcacgagctaatcccagctcccctccaagatttcatctacaggactctccggtctctcttcttccgttcttcttcctccactttgacgctaaccatcgatgacgacaacatgggtatgaacaacgagatctaccgagctgctcagacttatctctccaccaagatcagtcctgatgcagtcaggctcagaataagtaaaggccataaggataaacatgtcaacttgtatctcagcgacggagaaatcgtcaacgatgtgtacgaagatgtgcagctagtatggaggtttgttactgacggtggagacaagaaaggaggcggcggaggagtaggaggaagaggaggaggaggaggaagaagaggtggtatggacgatgacggtaaaagcgagtacttcgagctgagtttcgacaagaaacataaagatttgatattgaactcttatgtgccttacatcgagagtaaagctaaagagataagagacgagagaagaatcttgatgctgcattctctcaacagtcttagatgggaatcagttattcttgaacacccttcgacctttgagacaatggctatggaagatgatctcaaacgtgacgtcatcgaggatcttgatcggttcataagaaggaaagagttttacaagagagtagggaaagcttggaagaggggttacttgttgtacggtccaccgggtacggggaagtctagtcttgttgcagccatggctaattacctcaagtttgatgtttatgatcttcagcttgcgagtgtgatgcgtgactctgatctaaggaggctcttactagctacacgtaaccggtcgattcttgtcatagaagatatcgattgtgcagtggatttacccaacagaattgagcagcctgttgaaggcaagaaccgtggcgagtctcaggttagatttctactatgattggttttggtttaggattggccaattgaaccaaatttaccaaatcgaaccaaaccaaaatccgtatcaaccaaattttaatttagtgtaacaagactgactctgattagtatagagaattttagtatatttaaaattgtatttttttttgttttctatgaaaatgtgtgtttagggaccattgacgttatcggggctgctgaatttcatagacggactatggtcaagctgtggagacgagcggattataatattcacaacaaaccataaagataggcttgacccggcattgcttagaccaggacgtatggatatgcacatttacatgggacattgctcttttcaaggattcaagactttagcttctaactacttgggtttgagtgatgctgcgatgccacaccgtctatttccggagattgagcgtttgattgacggggaagtaatgacgccggcacaagtagcagaggagctgatgaagagtgaggatgctgacgtggcgctagagggtttggtgaatgttttagagaaaatgaggctaaaatctaaggaatcgaatccggtgatgatgaagcagaaagagagtagactggagatggaggagatgagactaaagagtgatactgagggttctccgaggaagaacagcaaaagatttaagaagcttgtattgttttggacataatccattaattagttcaaataagattatgaggaagcaaacaaaaatagacgggcgcgcc

SEQ ID NO: 414 - DNA, 1457 bp, Arabidopsis thaliana
ttaattaaatttggtgcgatgatgttgcgtgctgtttttaggagagcttccattagaggctcttcttctgcttcgggattgggaaaatcattgcaatcctctcgtgttgcagtgtctgctcaatttcattctgtttcagcaacagagacgttggtgcctcgtggaaaccatgctcatagcttccatcaccgttcttgtccagggtgtccagactgttcaaggactattatcaacggttaccaaggcacagccctgcaaagatgggtcaggcccttttcatctgatagtggggatgtcgtggaagctgttgtgccacacatgggtgaatcaatcactgatggcaccctagccgcctttctgaagaaacctggcgatagagtagaagctgatgaggctattgcacaaattgaaactgacaaggttacaatagatattgctagcccagcaagtggtgtgatccaagagtttctagtcaaggaaggagatactgttgaaccaggaaacaaggttgcaagaatttctacatctgcggatgctgtgtctcatgtggcaccctcagaaaaggcaccagagaaacctgctcccaagccttctcctcctgctgagaagcccaaagttgaaagtaccaaagttgcagagaaacccaaggcaccatcaccgccacctccaccgccatccaaacagtcagctaaagaaccgcagcttccacctaaggatagggaaagacgggttcctatgacaagacttcgcaaacgggtggcaactaggttgaaagactctcagaacacttttgcgttgctgacaactttcaatgaagttgatatgactaatctgatgaagctccgatctcagtacaaggatgcttttcttgaaaagcacggagtgaagttggggcttatgtctggtttcattaaggctgctgttagtgccctccagcaccaacctgtagtaaatgcagttatcgatggagatgatatcatttacagagactacgtggatatcagtatcgctgttggtacctctaagggtcttgtagttccagtcataagagatgctgacaaaatgaactttgctgacatagagaaaacaataaacggtctcgctaagaaggctactgaaggaaccatatcaatcgatgagatggcaggaggatcattcacagtatcaaatggtggtgtctatggaagtcttataagcactcctatcatcaaccctcctcagtctgctattcttggaatgcattcaattgtgcaacgtccaatggttgtgggaggaagcgtagttccgaggccaatgatgtatgtcgcgctgacttacgatcataggctaattgatggaagagaggctgtgtatttcttgcgccgtattaaggatgttgtggaagatcctcagaggcttcttctcgacatatgataaagatccaagacagaagagatcataagtttctgtggcgcgcc

SEQ ID NO: 415 - DNA, 2277 bp, Arabidopsis thaliana
aatgatttatcataaaagtattgatccgaattacccaaaccgacccgacccgagtatgaatgggccgaggcccataaaagaggaatatttgagagtcaacaactgaagaagaaagaagcaatgagaggacgaagcttgacactctcaagagtaaagctcgagcttgcgagaagaagcatgtctgcaacatccgtaccttcaatggcggattttctcaccaaaaaaccttactctcctccttcttgggcttctcatcttcgtccgcttccttctcacactttctccctcgctcacgtacgttaattttcaattttctctatgtttcaattctccttctccattacttttcactgatcatcttcttcttcttcttcttcagcttcctactccgatccatcgatggaatcttcctggtcttcctaatggcacagaactctggatcaagcgagatgatttcaccggaatggaattgagtggaaacaaagtacgaaaactcgaattcttaatggcggaagctgttgatcaacacgctgatactgtaatcactatcggcggtattcagagcaatcattgtcgtgctacagccactgcatctaactatcttaatctcaattctcatcttattctccgtacttccaaggtctcgcttctgattcttcaccttacatcgattcacttaccttttcgtgaattcatgtttatgtgtgtgtggtgtgtttgcagcttcttgctgatgaagatcctggattggttgggaatctccttgtcgagcgtctcgttggagctaatgttcatctaatctctaaagaagagtattcttccattgggagtgaggttaagtccgttgcattaagttttacttactaagaacaagaaatgagtagtttttacttagcctgatattgttgatcaaaacttgttcttgtgaatggtaggctcttactaatgctctgaaagagaaactggaaaaagaaggaaagaaaccctatgttattccagtcggtggatcgaactctttgggaacttggtgagactgtgttctcatagatactgttttgatatagctaagtgcagtaaccggtttgttgttattattacttgttttagattgttgagaccatttaaagctgaattccctgcaatgatcgtctaggggttatatagaagcagcaagggaaattgaggagcagctgaattatagacccgatgacctgaaatttgatgatattgtggtagcatgtggcaggttctgcttttgctttccttgtaattttttcttgccttttacttttgtttgcttcactctcatctaagttttcttttggattgctagtggtggtacaattgctggtatttcattggggtcttggttgggagctctaaaagccaaggtatattctttaaattttagttggttcactcactgtgaagttgacagatggctcagttaagtttccattcattgtacaggttcatgctttctcggtttgcgatgatcctgattacttctatgactttgtccaagggcttctggatggacttcacgctggtgttaactctcgtgatatcgtcaacatccacaatgtgagtttcatgacttctctgtttatgtgttgtctatttcgcattggtgatttctcttggctccttcgcaaataccactaggtggaaaattgtgatacaagctttttctctttaagcacacaggttctggtattgattctcgtgttctttttgcaggccaaaggaaaaggatatgccatgaacacgtcagaggagcttgagtttgtaaagaaagtagcaagttcaactggtgttattcttgatccggtttacaggtatgttagtctttctaattcttccttgttcctagtaatgtttatggtcgtgactaccccttgaatctctcaaagtagtgagattgacatttgggttttcgagtgtttatctagtgggaaagctgcgtatggtttgataaatgagatcaccaaagatcccaaatgttgggagggaaggaagatattgttcatacacactggtgggcttcttgggttgtatgataaggttgatcaaatggcatctctgatgggtaattggtcccggatggatgtttcagaatccgttccaagaaaagatggtgttgggaaaatgttctagcacaacaaaatctgatttgtaataatcctgtgaaaataagacagattgaacaatttgtgcatttggcagtgaataaacacatctctgttttctattctgatgtattatgttcataggctt

SEQ ID NO: 416 - DNA, 691 bp, Arabidopsis thaliana
ttaattaagacaaacaccaagacaaacgtaagcacaagcacgagtgagtgagagatgtttgccgtggagaatgggttgcagggagacccgagattaaaggccatctccgacgccattcgtgtcattcctcacttccccaagactgggatcatgtttcaggacataacaacgttgttgctggatccagttgcctttaaacatgtcgtcgacatcttcgttgatcgttacaagcacatgaacatctctctcgtcgccggagtagaggcgagaggattcatatttggacctcccatcgcgttagccataggtgccaagttcgttccactacgcaaaccgggaaaactacccgggagagtgataagcgaagagtacgaacttgagtatggaagagattgtctagagatgagtgtagaagccgtcaaatcggaggaacgagctctcatcatcgacgatttagttgccactggtgggacactctctgcttccattaacctcttggagcgtgccggggccgaagttgtagagtgtgcatgcgttgttggtttgcctaagtttaaggggcagtgtaagctgaagggaaagcctttgtacgttctggtggaaccaaaccagtttgatgaattaaccttataaaagccttttctattcaacgattatgacaaataatgtaatcggtttaatcgggcgcgcc

SEQ ID NO: 417 - DNA, 1470 bp, Arabidopsis thaliana
ttaattaattctaatcctttatgcaaagcagtgtgtatcgtgataaagctagctcgatcgcgatgatcttagaaacccagaggaatgttgaattccctcatcggatcgttgataagcgtcccaggaaacgtccccgattgacttgggatgctgctccgcctcttcttcctcctcctcctccacccacggtatttcaacctccgttgtactatggtccggagtttgcgagtggtttagttcccaattttgtttacccaaacatgttctataatggccttcctcgtcagggctctcctccctggagaccagatgataaagacggccattatgtctttgttgttggggatactttgactccacgatatcaaattctcagcaaaatgggtgaaggtacatttggacaagtattggaatgctttgataataaaaacaaagaagtcgtggcaatcaaagttatacggtccataaacaagtatcgtgaagctgccatgatcgaaattgacgtgctgcagaggcttacaaggcatgatgtcggtggttctcgttgtgtgcaaatacggaattggtttgactatcgtaatcatatttgtattgtatttgagaagcttggaccaagcttatatgattttctccgcaaaaacagctaccgttcatttcccattgatcttgttcgggagcttggcagacaacttttggagtctgttgcatatatgcatgatttacggctgatccacacggatttgaagccggagaacattcttttggtatcgtctgaatatatcaaaatacctgattataagtttctatcccgacccacaaaagatgggtcatacttcaagaatctgcccaagtcaagtgccatcaagctcattgatttcggaagtacaacatttgaacatcaagaccataactacattgtatccacaagacattaccgcgcaccagaagttatcctaggggttggatggaactatccatgtgatctgtggagtattggttgcatacttgttgaactttgttcgggagaggcgcttttccaaacgcatgaaaacttggaacatttggccatgatggaaagggtcctaggacctttaccacctcatatggtgctcagagccgaccggcgctctgagaaatacttcagacgaggtgcgaagttagactggcctgaaggtgcgacatcaagagacagcttaaaagcagtatggaaacttccccggctaccgaacctgataatgcagcatgtggatcactcagccggtgatctgatagacctattacaaggtctgcttcgatatgatccaacagagaggttcaaggcaagagaagcactgaaccatcccttcttcacaagaagccgggaacagagtataccacccttcaacccaaaccctcatccatttttatacaaccaaaagaactaaaaaagaaaagaaaaaagaaacagcagataatgtttggaggcgcgcc

SEQ ID NO: 418 - DNA, 1165 bp, Arabidopsis thaliana
ttaattaagtgattggtagaggaaattggaaaagcttggattgaaaactatggaagcgaagaaagtgacagaagaggaagaagagacgtggaggagagagatagtaacaagcgttatgagattagtgagtacgagattgcctcagacagatctaatttctctacttctggttagcccatggctttatcgcaccctcatctcctatccttcaatctggctgaccatcaatttgcgcgagatgaccaatgcaggggatcggcttttagctgctctgtccttgccaagatatcgacaagtgaagcatatcaatcttgaatttgcccagggtgttgtggacagtcatcttaaacttgtgaaaaccgagtgcccggatgctcttttgagtctagaatggttgaatctgaacgtgtgccaaaagatatcagacaatggaatcgaagctataactagcatatgtccaaagttaaaagttttctctatctactggaacgtaagggtgaccgatgctggcattagaaatctagtgaagaattgcagacatatcactgatttgaacttaagtggctgcaagagcctaacggacaaaagtatgcaactagtagctgaaagttatccagacttagagtcactgaatatcactaggtgtgttaagattacagatgatggattacttcaagtgctacaaaaatgtttctctctccagaccttaaatctctatgctctttcaggcttcacagacaaagcctacatgaagatatcacttttagctgacctaaggttcttagatatatgtggcgctcagaatatatctgacgaggggattggtcatatagctaaatgcaacaagttagagtctctcaacttgacatggtgtgtgcgtatcacagatgcaggtgtgaataccattgctaatagttgtacctccctcgaatttctcagcttgtttgggatagttggggtgactgacagatgtctggagaccctttcgcagacatgctcgactacactcaccactcttgatgtcaatggctgcaccggcatcaagagacgaagccgtgaagagttgcttcagatgttccctcgtttgacatgcttcaaagtacacagctgaaatttgctcatataaattagaggactctcaacaaatgctatccttcggcgcgcc

SEQ ID NO: 419 - DNA, 880 bp, Arabidopsis thaliana
ttaattaaatgtctcaaacaagctactaccgatcaccgttcggagacacgacttacaccaaagtgttcgtcggaggattagcgtgggaaactcctaccgacgaaatgcgtcgttacttcgaacagttcggagagattcttgaagccgtcatcatcaccgataaaaacaccggcaagtctaaaggctacggattcgtgacgtttcgggagtcggactcagccacgagagccgtcgctgatccaaatccggtgatcgacggaagaaaagccaattgtaatattgcatcttttggacggcctcgaccatcgccgcctcgaggtcgaggacaaacaggaagtccgagtcagtaccaaagtggaggaccatcaacctataccgggatggctgcaccactgccaccggctgcagctccccagctcatgtatccgtcgtacgggtacacctataaccctgatcaatttgggtaccaccaagcattgtacaacacacagttgcaacaagcacaatactatcagcagcagcaacagctttatggaggaggagcaacatcaccatcatcatcaggagcaaccatcatgccttctccatactattatggctattctcttcaagctcctagagtaccataccaacaccatcatcatcttcctcaaccatataatcctcaacaacatcatcatcaacggttttcttctccttctttcctcgtttacccatccaattcctcttttgcccctcctctccaaggagtactatcttcttccaccgaatctgaagcagtaccacaacaagtaccagctgcagaaggcgaagcaacaacgactgctcctgaaatcacaacaagcaacaccaaagaacctatttcttcttgaggcgcgcc

SEQ ID NO: 420 - DNA, 1379 bp, Arabidopsis thaliana
ttaattaatttcgctcgagccattggagcaattatgtcgattccttgtctaaccgaagagacagccaaaactgttcttcgccaggtggagttctatttcagtgatagtaatctacccattgatgatttcctcaagaagactgttacagagagcgaagatggcttggtgagtttggcgttgatttgctcctttagtaagatgagaggatatttgaagttgggtgattctaaaggagatgatattcctgaagataccatcaaagctgttgctgatactcttcgaacctcttctgctctcaagatttctgacgatgggaaaaaggttggtaggagtactgaattgttgaagctggaagatttgattgagcaacttaatgctagaacagtagctgcgtcacctttctcctatgatgttaaaagggaagacgtggaatcctttttcagtcagtatggaaaggttaatagtgtgaggatgcctcgtcatgttgcagagtcgaggatattttctggtgttgccttggttgagttccctacagaagaggatgcccagaatgttatgaagcagaatttggtctttgctggtcaggagttggagctgaaaccaaagaaagagtttgataatgaaagggagaaggatgaagtaaaatttgctaattaccaacctcagaagggatctgcaaatcagaagaatggttctgatcacaaaaacaattctgcttatgagccagattatcccaagggtttgatcatttcattcaccctcaagcgttcagctgaagagggtaccacggaacaaaaaagttctgaggagccaactgataagacaatggaagaaagtgaaacaaagccagcagatactcctgatgctgataaagaaaacactggtgaggttcaggccgagggagcagaggatgaagatgatgagaaagaagaaaagggtgctctagccacccataaagataataaggatgttgtcttacgtgaagatcttaaggctgttttcggaaaatttggtgatgtcaagtttgttgatttcaagatgggatctgagacgggttatcttaggtttgatgaacctgaagcatcccagaaagcccgtgcagcagcagtattagccaatgaaggtggactagccgtgaagaattttattgctgtcctagaacctgttattggcgaagctgaaaaggagtattggactctcctacgaagcaaagatcggtttgacaagggtggccgtggaggaaggggaggaagaagaggagggagattcgggagaaagaggggatcagattcaccgggtggtcgctggaacaaatctcagaaggtggaagcatgagagatttcgctcgtgactgcttctgtttttcaatatggcgcgcc

SEQ ID NO: 421 - DNA, 1551 bp, Arabidopsis thaliana
atgggttctggtcaatggcatatggagaagaggtctactttaaagaatgattcgtttgtaaaagaatacaatccagtcacggaaactgggagtctctctatcattgttcttggtgcttctggtgatcttgctaagaagaagacttttcctgcacttttcaatctatttcatcagggatttcttaatccagatgaagttcatatatttggatatgcaaggagtaagattactgatgaggagcttagagataaaatccgcggatatcttgttgatgagaagaatgcatctaagaaaacagaagctttgtccaagtttctaaagctgattaagtatgtgagtggaccttatgattctgaggaagggtttaagagattagacaaggcgattttggagcacgagatatctaaaaagactgctgaaggatcttcgaggagattgttttatcttgcacttcctccgtctgtataccctcctgtaagcaagatgatcaaggcatggtgcactaacaaatctgatcttggtggatggactaggattgttgttgagaaaccatttggaaaggatttggaatctgcagagcagctgagttctcagattggagccttgtttgaagaaccacagatttatcgtattgatcactatctgggaaaagagttagttcaaaacatgttggttcttcggtttgccaatcgcttgtttttgccactatggaaccgcgacaatattgcaaacgtacagatcgttttcagagaagattttggaactgaaggtcgcggtggatattttgatgaatacggaatcattcgtgatattattcaaaaccacttgctccaggttctttgccttgtcgccatggagaaaccaatctctcttaaacccgagcacatccgggatgagaaagtgaaggttcttcaatctgtgattcccataaaagatgaagaggtggttcttggacaatatgaaggatatagagatgatccaactgttccaaatgactcaaacactccaacgtttgccacaacaattcttcgcattaacaatgaaagatgggaaggtgttccttttatactgaaggccggaaaggcaatgagttcaaagaaggcagatattcgcattcagtttaaagatgttcctggcgacatattcaaatgtcaaaaccaagggaggaacgagtttgttatacgcttgcagccttcagaggccatgtacatgaagctaactgtgaagcaaccgggtctggagatgcaaaccgtgcagagtgaactagacctatcgtacaagcagcgttaccaagatgtctcaattccagaggcttacgaacgccttattcttgacacaatcagaggcgaccaacaacactttgttcgcagagacgaattaaaggcagcttgggaaatcttcactccactgcttcacaggatcgacaagggagaagtgaaatcggtcccatacaaacaaggtagccgtggcccagcggaagcagatcagctacttaagaaagctggttatatgcagactcatggctacatttggatccctcctacattgtaa

SEQ ID NO: 422 - DNA, 1289 bp, Arabidopsis thaliana
ttaattaaccaaccattttcttcttcaaatcatcatcatcatccctcgtacaaagaaaatggccatgagcatactcgcgaagatctttctcgtctttgccatctattgcgctatcgatcccttcagtcacagctccatttccaagttcccggatttcaaaacttacaagattgacatgcctccgttatcgtcacttccaaaggagagagaccgccagaatctgttgcagaattcagagatcaggtttcttaacgaggttcaaggtcccgagagcattgctttcgatccgcaaggtcgtggtccttataccggagtcgccgacggtcgaattctcttttggaatggcactcgttggacagatttcgcatatacttcgaacaatcggtcagagctatgtgatcctaagccatcgcttttggattacttaaaggatgaagatatctgtggtcggcctttaggtcttcgattcgacaagaaaaatggggatttgtacattgcagatgcgtatttggggataatgaaagttggtccggaaggaggtttagcaacttctgttacaaacgaggctgatggtgtgcctttgagatttaccaatgatcttgacattgatgatgaaggcaatgtttactttactgatagcagctctttcttccaacgaaggaaatttatgcttttgattgtctcgggggaagacagtgggagggtgttgaaatacaatccaaaaacaaaggagactaccactctcgtgagaaatctccagtttcctaacggattatccctcggcaaagacggctcctttttcatcttttgtgaaggatctattggaagattacggaaatactggttgaaaggggagaaagctggaacgtcagaagtggtagctctattacatgggttcccagacaacatccgcacaaacaaagatggagatttctgggtggcggtgcactgccacagaaacatattcacacacttgatggcgcattacccgagggtgaggaagttctttctgaagctgccgatatcagtgaagtttcagtacttgctgcaggtaggtggttggcctcatgctgtagctgtgaagtacagtgaagaagggaaagtgctaaaggtgttggaagatagtaaagggaaagtggtgaaggcagtgagtgaagtggaggagaaagatgggaagctttggatgggaagtgtattgatgtccttcattgccgtatatgacttgccttagttcgtttctttttctattcaaatttgtatatttctagtttggctatgggaggcgcgcc

SEQ ID NO: 423 - DNA, 2372 bp, Arabidopsis thaliana
ttaattaaagaatattccgatttaaccctcaccgaatattccctcttcctccatggaaaacgacgtcaaagagaatctcgaagaagaggaagaccgtcttcttcctcctcctcctccttcacaatctctcccatccaccgattccgaatccgaagcggctttcgaaacaaacgaaaagatcctaatcgtcgatttcgaatcacccgacgatccaacaaccggagacacaccaccgccattctcatggcggaagctctggttattcaccggtccaggtttcttaatgagtatagcgtttttggatccagggaatctagaaggagatctacaagctggtgcaatcgctggctattctctgttgtggctactaatgtgggcaacagctatggggttgttgattcagatgttgtcagctagagtcggtgtagctactggtcgtcatttagctgagctttgtcgtgatgagtatcctacttgggctaggtatgtgctttggtctatggcggaacttgctttgattggtgctgatattcaagaggttattggtagtgctattgctattcagattcttagccgtggcttcttgcctctttgggctggtgttgttattactgcttccgattggtgagtcctttcgatactctattcgttctttagagatgttggattcgtagaattagtagagacttggtttggagaatcttatgattcattctgaaattttaaaactttgcggatcatcttagcggtattgagtttgagtatggatcattcgaactcacaaatcagtagaaacttggtttagagattcatgattcaatctgaagttgagaatttgcttttactttggctgttttcttgtaaaactttgctaagatgatccaaactcacaaatcagtagagaattggtttaacgatttgtgatcgaatctgaaattaagaaacttgcttttttgtattttgaaaacttggctaatgaatttgttgcaaacagttttttatttttgtttctagagaattacggtgtgaggaagttagaagctgtttttgcagttttgatcgcaactatgggtttgtcctttgcttggatgtttggtgaaacaaaaccgagtgggaaagaacttatgataggtaaagatttcagatttttactcttgaatttcactttatttgctttgatttgagtgcttaaaaatcaaatctttgtgtttatggataggtattttactaccgagacttagctcaaagacaattaggcaagctgtaggtgttgttggctgtgttataatgcctcacaatgtgtttttgcattcggctcttgtacaatcgaggaaaatcgatccgaagaggaaatcccgggttcaagaagcgcttaattactatttgatcgagtcatccgtcgcacttttcatctccttcatgattaacttgtttgtgactactgtctttgcaaaggggttttatggaactgagaaagctaataacattggcctagttaatgctggtcagtatcttcaagaaaagtttggaggcgggcttcttccgattctttatatctggggtatcgggttgttagcagccggacaaagcagtacgataactggtacatatgctggacagtttataatgggcggttttctgaatctccggcttaagaaatggatgagggcagtaataacaagaagctgtgctattgtgcctacaatgattgtggcaatcgtgttcaatacttctgaagcttccttggatgttttgaatgaatggctcaatgtccttcagtctgtacaaattccttttgctcttctccctcttctaaccttggtatccaaagaagaaattatgggagacttcaagattgggcctattctccaggtaaatttccacttcttttactacaagtctccataggataccacaataggtgaattagtgttgagtcttatcgttttaggtgtctcgacttttttagtttcactgtttgtgcaattatcttagtaaacatgtagaattgaaagtccttcaatggaatagagaagcatgaagagtgagtatttgtaagttgattggatttattgattacattgcagagaatagcttggactgtggctgcacttgtaatgatcatcaatgggtatcttctgttggatttctttgtatcagaagtcgacgggtttctgtttggagttacggtctgcgtctggacgactgcttatatcgcctttatagtgtacctcatttcacacagcaacttttttccttctccttggtcatcctcttccatagaacttcccaaaagagtgtccgtctccaatagctagtagctgcacaaaaataactgccctcaagaccatttgttacatgtcaggcgcgcc

SEQ ID NO: 424 - DNA, 486 bp, Arabidopsis thaliana
ttaattaactgaaacctagattcgattcagtcagaacttttgtcgaagatggaaagacaaatcatggcttcttctaaaaaggtacaacgggaagagaatacgaaagaggaatatttaccaaacaagcaagtttcagatgaatcagaacaacttgagaagagttgtttgacagaagaagaagatgcgtgtttgtctgatgctagtcatagcagtaagaagacgataagggaagatgcaatttgtgaatcaaagaatagaaagaagtataagccaagcaacgaatctggattcaacacgttatttgatgatgactggctttttggtaacaatcagcaaaagaatgttgttaccactaataaagccgctatcaagaacgatgcagagatgatcatgaagttgctgcagagatcatgtggagattccttgtttcctagctaaggcccagttttcgcctcaattcggaatatttgtattaccaggcgcgcc

SEQ ID NO: 425 - DNA, 1437 bp, Arabidopsis thaliana
ttaattaacagaaaatggacaacttggaagatttgaagattgtggcagagcagtggtctaaacaaggacttgaatttgttcaaaaaataccaccacctcagctttatactgccattggtgttctcttattagctaccatttggctcttatctagtaagtagtgaacaccacgacattcttcttctcattgatcttttccttatttggtattagattcattttaggatttggatgttactatggtggtaggtatagatttcctattgcattgtatgtcctctgttttggttgttaatgttgtcacttttgctgatttctgcagttcgtttgtttagacgtacaaaatccaatactgtactcctctctgggctaagtggaagtggcaaaacagttctcttctatcaagtgagtaattttagggtttaaggttcctttactcgtttgtagacaatgtattttagttatcagaaaagctgctaaaagaaactgagtaggtgaatgttgttgtgtcattatttataagatggtttggtttacgtttttttatgtatttgtgatagctacgagatggatcttcccatcagggtgctgtaacgtcaatggaaccgaacgaaggcacctttgtgcttcacaatgaaaacaacactaaggtaaagaaagatcttcactttggttttgttcaagaatgtaaagtttttaagggacttgaaagatattgcctctttgtttgatagaaaggaaaagtaaagcctgttcatcttattgatgttcctggacactctcggcttatatctaagctagaagaatacttgcctcgagccgccgctgttgtgtttgtagtagatgcattggagttcctcccaaatatccgggcagcttcagagtaattcattaccatataaaagatgatttgcttaggcataagtgattcttagagattgaagacttattaaacatggtttgtaattttacaggtacctttacgacattctgaccaatgctagcgttattaagaataagaccccggttctgctttgctgtaacaagacagataaagtaactgcacacaccaaagagttcatccgcaagcagatggagaaagaaatgtgagattgattcctagctgttttctaaattctgaagataaaaagaagctctgattgatactccttttgttaatgtgtgtgtgtgtgttttgcagagataaacttagggtttcgaggagcgcaatatcaacagctgatatagcgaatgacttcactcttgggattgaaggagaagtgttttccttttcgcattgccataacaaagtcacggtcgctgaggcgtctggactaacaggagaaacagatcaggtacaagagttcatcagagaacacgtaaagccatgaggattgtgtaagcatctcagagaatgtacttaaatgtcggcgcgcc

SEQ ID NO: 426 - DNA, 890 bp, Arabidopsis thaliana
ttaattaaatggaagaaatcgccgataaaaccttcttccgatactgtctcctcactcttattttcgccggcccaccaaccgccgtccttctgaaattcctccaagctccttacggtaaacacaaccgtaccggatggggtcccaccgtatctccaccgattgcttggttcgtcatggagagcccaaccttgtggctcactctcctcctcttcccctttggtcgtcacgctctcaaccctaaatctctacttctattctctccttatctcattcattacttccaccgcaccatcatttaccctcttcgcctcttccgcagctccttccccgccggtaaaaacggatttccgatcaccatcgccgccttggctttcacctttaatctcctcaatggttatatccaggtacggttttagctaatttcggtttggttcgtttcgattttccggttttcatctattttgctaatttcggtttgtctgagaacaggcgaggtgggtttcgcattacaaggatgactacgaagacggaaactggttctggtggcggtttgttatcggtatggtggttttcataaccggcatgtatataaatatcacgtcggaccggactttggtacgattgaagaaagagaaccggggaggttatgtgataccgagaggaggctggttcgagttggtaagctgtccgaattattttggagaggcgattgagtggttgggctgggctgttatgacttggtcttgggccggtattggattttttctgtacacgtgttccaatttgtttccgcgtgcacgtgcgagtcacaagtggtacattgccaagttcaaggaagagtatcccaagactcgtaaagctgttattccttttgtgtactgaggcgcgcc

SEQ ID NO: 427 - DNA, 295 bp, Arabidopsis thaliana
ttaattaaatggcgtctcaacaagagaagaagcagctggatgagagggcaaagaagggcgagaccgtcgtgccaggtggtacgggaggcaaaagcttcgaagctcaacagcatctcgctgaagggaggagccgaggagggcaaactcgaaaggagcagttaggaactgaaggatatcagcagatgggacgcaaaggtggtcttagcaccggagacaagcctggtggggaacacgctgaggaggaaggagtcgagatagacgaatccaaattcaggaccaagacctaaggcgcgcc

SEQ ID NO: 428 - DNA, 449 bp, Arabidopsis thaliana
ttaattaagagctcgaagaaagagacgaaaatggcactgagaaatgcaattcttcgtcacctgagggttccggtgcaaaccctaggattgaatcagtctaaaattgggttccttggtacgatccggtcattttcttcgcacgatgatcatcttagcagagaagctgtcgtcgatagagtactcgatgttgtcaagagcttccccaaagtcgatccctctaaggtgactcctgaggttcatttccaaaacgatttgggattagatagtttggacacagtggagatagtgatggctattgaagaggaattcaagctggaaattccagacaaagaagctgacaagatcgattcttgctctctcgccattgaatacgtttacaatcatccaatgtctagctaatcgctgtgtgctctctcatggtttctccttcctttttcttgtggcgcgcc

SEQ ID NO: 429 - DNA, 653 bp, Arabidopsis thaliana
ttaattaagaagaagaagaagaagaagaggaaaggagaaatctgccatggcgtcgccgagcaaacgtcgagagatggatatgatgaaactgatgatgagtgattacaaggtggatactgtcaacgacgatttgcaaatgttctatgtcacattccatggacccactgacagtctttatcaggggggtgtatggaagataaaagtggaacttcccgaagcttatccatacaaatctccatctgttggatttgtcaacaagatttatcaccctaatgtcgatgaatcttctggtgctgtttgcttagatgttataaaccagacttggagcccaatgtttgatcttataaatgtgttcgaatccttccttccgcaactgcttctatatccaaacccatcagatccatttaatggagaagccgcttctctgttgatgcgagaccgtgcagcctatgagctcaaagtgaaagaatattgtgagaaatatgcaaaaccagaggagattttaagtgatgatgatgatgatgatagcatgagcgaagatggttcggactctgatgatgatgacgacgacgaaatcgttgggaaagccgatccatgactgtttacaaatcaatctttctttgcactttcattactccatcttcaggcgcgcc

SEQ ID NO: 430 - DNA, 913 bp, Arabidopsis thaliana
ttaattaaatggggttagagaggaaagtgtacggtttggttatggtatctttggtacttatggctattgcaacgatgtgttgtgtccaagctacgatcgaggaagaagcggctaaggatgaatcatggactgattgggcaaaggagaagatcggtctcaagcacgaagacaacatccaacccactcacaccaccacgaccgttcaagacgacgcttggagagcgagtcaaaaagccgaggacgcaaaggaggcggctaaacgcaaagcagaggaagcggttggagccgcgaaggagaaagcgggttcggcatacgagacagctaaatcgaaagttgaggagggtttggcttctgtaaaagacaaggcctcgcagagttacgactcagctggtcaagttaaggatgacgtgtctcacaagtcaaagcaagttaaagatagcttgtcgggagacgaaaacgatgagtcttggaccggttgggccaaagagaaaatcggaatcaagaacgaagacatcaacagccctaacttgggagagacggtatctgagaaggcaaaagaagctaaggaagcggctaaacgcaaagcaggagatgctaaagagaagttggcggagacagttgagacggcgaaagagaaggcgagcgatatgacgagtgcagctaaggagaaggcggagaagttgaaggaggaagcagagagagagagtaagagtgcgaaggagaaaattaaagaaagttatgagactgcaaaatcaaaagccgatgagactttagagtccgcgaaagataaggcgtcgcagagttacgactcagctgcgcgtaaatcggaggaagctaaagataccgtgtctcacaagtcaaaacgtgttaaagagagcttgaccgacgatgatgctgagctctgaggcgcgcc

SEQ ID NO: 431 - DNA, 1040 bp, Arabidopsis thaliana
ttaattaacggaacataacataacaaaacagagagatgagtcaagaagaacaaccaaagcggccacaagagccagtcacttacggtgacgtttttgaagtctccggtgaactcgctgataagcctatagcgccggaggatgcaaacatgatgcaagcagcggagacacgtgtgtttggccacactcagaaaggcggtgcagcggcagtcatgcagtctgcagccactgctaataaacgcggtggctttgtccatccaggtgacacaactgatctcgccgctgaacgaggcgtcacagtggcgcaaactgacgtccctggtgcacgtgtcacaacagaattcgtcggtggacaggtcataactcaaatccagaattacatcttttttcttacgatcatgttttataatggtgaagatatatttgtcataggtcgttggacaatacgtcgagcctaggccagtggcgactgcggcagctatggaagcagaagttgtgggtttgagtttacaaagtgcaataacgattggagaagcattggaagcgactgtgcaaaccgctggaaacaaaccggtggatcaaagcgacgcagcagcgattcaagcggcagaggttagagcttgtggcactaatgtgattgctcctggtggaatcgccgcttctgctcaatcagcagcaaatcacaacgctaccatagaccgtgatgaggataaaatcaagctcattgatgttttggcggttaaaccccaattttaaaaacatcttcaatgtcttaatgttttagttttaagattgtctaaatgtgtttgaaccggatggcttattagggtgcgaccgggaagttagccgcagataaagctgtgaccaggcaggacgcagagggagtggtgagcgctgagctgaggaacaatcctaatttgtctactcaccctggtggtgtagcggcttctattactgccgccgctaggcttaacgagagagctgatatatgaaaaatcctgcgagagggagatgttttggttctgttgttcaaaaggcgcgcc

SEQ ID NO: 432 - DNA, 629 bp, Arabidopsis thaliana
ttaattaaaaaaccgtaccatcttaaccaaagcgataacccgtaccaccggttcagctatggaggatttattggaggagaggctaactcggactgactctgtcgggaataaacgagtcagagacgggttagacctcgactcgccggacgtgaagcggttaagagatgatttgttcgatgactcggggcttgacccagtgagtcaagatcttgactcggtgatgaagagtttcgagaatgagttatcgacaacgacggcggcgctaagctccggtgaaactcagccggatcttggataccttttcgaagcttctgatgacgagctgggtttgccaccgccgcttacgccaccgcaaacgcttcttcctccgtcgtgtgaggaaacggtgacggaattggtacgagcctcgtcggattcatcagaggttggagagttatgtgggtttgaggatcatgttacggagttcggaccttgcgatcttggtgatgatgggcttttcgaatatttcgatgggtgtttagattccggcgatttgttttcatggcggccggagtttttaccggcggagtaacaacataccggacctttttaaaaaagcgggctacgaacggtgacgttttgggcgcgcc

SEQ ID NO: 433 - DNA, 785 bp, Arabidopsis thaliana
ttaattaatcttcacctaaacagcatcaatggcgacttctctctccgtttctagattcatgtcctcctccgccaccgttatctccgtcgctaagccgttactttcccccaccgtatccttcaccgcgccgctctccttcacacgctctctcgctcctaatctctctctcaaattccgcaaccgccgcaccaattccgcctccgccaccaccagatccttcgctacgacacccgtcaccgcctccatttccgtcggagacaagctcccagactccactctctcctacctcgatccatccaccggagacgtcaaaacagtaaccgtctcatccctaaccgccgggaagaaaacaatcctattcgccgttcccggcgcattcacaccaacatgctcacaaaaacacgtccctggattcgtatccaaagccggagaactcagatctaaaggcatcgatgtaatcgcatgtatctccgtcaacgacgcgttcgtgatggaagcgtggaggaaagatcttggaattaacgatgaggtaatgttgctatccgatggaaatggcgaattcacagggaagcttggtgttgaattggatttgagggataagcctgtgggacttggagttaggtcaaggagatatgcgattttggctgatgatggtgttgtgaaagttctgaatcttgaagaaggaggtgcttttactaatagtagtgctgaggatatgcttaaagctctctgattcttatgattttctcatcaatttcgtcttcttctctgttttgaggcgcgcc

SEQ ID NO: 434 - DNA, 621 bp, Arabidopsis thaliana
ttaattaacttgaaaaatgggtctatccttcggaaagttgttcagcaagctctttgcaaagaaagagatgcgtatcctcatggtgggtctcgatgcagctggtaagactacgatcttgtacaagctcaagcttggagagatcgtgactacgattccaaccattggtttcaatgtggagactgtggaatacaagaacattagctttaccgtgtgggatgtcgggggtcaagacaagattcgtccattgtggaggcactacttccagaacactcagggacttatctttgtggtggacagcaatgatcgtgaccgtgttgtggaagccagagatgagcttcacagaatgttgaacgaagatgagttgagagatgctgtgcttctcgtttttgctaacaagcaagatcttccaaatgcgatgaacgccgctgagataaccgataagcttggacttcactctctccgtcaacgacactggtacatacagagcacatgtgctacctccggagaagggctttatgagggacttgactggctctctaacaacatcgcaaacaaggcttaggagaacaacgtgtggtttggtttttaatcgaggagagtcttgtcttcttccggcgcgcc

SEQ ID NO: 435 - DNA, 1547 bp, Arabidopsis thaliana
ttaattaaatggaaccactcatcagcccacaaccacgtttccgcctccaacccataccggaaaatccctcctcctcctcctcctccgcctccatcacaatccctcgctctatctcaaacacttccttcttccatgaaatctcccaagaacgtcttctccttcatcatcaagacctcgaacaatccgtacaagacgacaaagaagaccaagactcagactcagacgaaacaaatcgctttttatctcagacaagaccacttcaccgatctcgtacagctccagctatggtaatcatcaaagacttaagaaccaaacctccagaaaccaaaaaaccatcaccagtctctaaatccataatcagacaagcgattttcttgctaatcgtctacttaaccttaggcgtttcaatctactcattcaatcgtgaccactactcaggaatcgaaacccatcctgtagtcgacgctctctatttctgtatcgtcactatgtgtactattggttacggtgacatcgctccgttgactccatggacaaagatcttcgctgttgttttcgtcttgttcggattcgggttcttggatattttactcagtggtgttgttaactacgttttggatcttcaagagagtatgattctcaccggaatccaaacgaggcagcatcatcaacaccatcatcatcatagattctctgctaaagattatattattgattttgagaaagggaggatgaggataaggatgaaagtttgtttagcgttatgcgtcgtcgttttgtgtatcggtgttggtgctttggttttgcatttcgttgaggaattgggttttgttgattcggtttatttgtcggttatgtcggtgactactgttggttatggtgatcgtgcttttaaaacgcttcaagggaggctttttgcggcggtttggctacttgtttcgactcttgcggtggcgcgtgcgtttttgtatttggcggaagcgagaattgatcgccggcatcggaaagctgttaaattggcgttgaatagagaaatcactgttgatgatttgctcaaagctgatacttatcaacatggtttcatcaggttaacatcttttaaaaacctcaactttgtttttttttttagaatcttggattaattgcttagagatgagagtgatttgagctgattctgataaagggttttatgcaatttgtgtgaagtttaggtcaaataagttgcagagagtgttaagctttagattaatcatgttaatgttaagactttttcttgcaagcaacagtttagttatgtctttgtgtaatctaatttcaatgatttaagtttgagtgattagtgttttgacttttttttttatgttttgatttggttttggtgtgtgtttcagtaaatcagagtatatagtgttgaagcttaaggaaatggggaagatcactcagaaagacattgaccaagttgtgattcagttcgagaaacttgatcctaatcaaataggaaaaatcacattacctgatcttttgggggatcctttgtgaggcgcgcc

SEQ ID NO: 436 - DNA, 572 bp, Arabidopsis thaliana
ttaattaacactcactgtaataaacacaaatgacgagttcttctgaatcaactcgcaagggtctgaccaaaatcgccacgaaccggttgcagaaagagttcatggagtggcaaaccaatcctccttctggtttcaagcacagagtctctgataatctccaacgatggatcattgaagtgcatggagttccaggaactctttacgccaatgaaacttaccaacttcaagttgagttccctgagcattatcctatggaagctccacaggttatctttcagcatccagctccacttcatcctcatatttacagcaacggtcacatttgtttagatgtcttgtatgattcgtggtcaccggcgatgagactaagttccatctgtctcagcattctctcaatgctctccagctcatccgtgaagcaaaagccgaaagacaatgaccattacttgaaaaactgcaaacatggaagatctcccaaagaaactaggtggcgtttccatgacgataaagtataacatctcctataatattgtgattacaaacgaattgtaagatctcaggtcgggcgcgcc

SEQ ID NO: 437 - DNA, 869 bp, Arabidopsis thaliana
ttaattaattttgtcatctctctcactctctcccgacgatggctcgcttagtattttctttaaaccttccatctagtcatggattcaatctcagtcctcgaaatcttcaatctttcttcgttacccaaacaggagctccacgatttcgcgctgttcgttgcaaaccaaacccagaatcttccgaaaccaaacaggagaaattggtaatagataatggtgaaacttcatctgcatcgaaggaagtggaatcatcatcatctgttgctgactcttcttcttcttcttcttcgggattccctgaatctcccaataaggatatcaatagaagagttgcggctgttactgtaatcgcggctttgtcgttatttgtatcgacaaggctcgattttgggatttctttgaaggatttaaccgcttctgcgttgccttacgaggaggcgttatcgaatgggaagccgactgttgttgagttctatgcagattggtgtgaagtttgtcgagaactagctcctgatgtttataaaatcgagcagcaatacaaggacaaagttaactttgtgatgctaaatgtggacaacacgaaatgggagcaagagttggatgagtttggtgttgagggtattcctcatttcgccttcctcgatagagaagggaacgaagaaggtaatgtggtcgggaggctcccaagacagtatttagttgaaaatgtgaatgcgcttgcagccgggaaacaatcaattccttatgcccgagccgtgggacagtactcaagctcagagtctcgtaaggtgcatcaggttactgatcccttaagccatggataaagagagtggcatcactatcatgcttctggcagatgatggcgcgcc

SEQ ID NO: 438 - DNA, 1011 bp, Arabidopsis thaliana
ttaattaaatttgtgtccatggcagctttgcaaacgcttcgtgaatggatcggtatccagcagttcccacctgctactcaatctaaattgctcgagatccttgggaagtataaagaagaggatgtgagctcgctaacggtccttgtaatggggaaaggtggtgttggaaagtcatcaactgtgaattcagttataggcgagaaagctgctgcagttagtactttccagtctgaaggactgaggcctaccttggtctctcgcacaagatcgggatttacattgaatatcatcgacactcctggtcttattgagggaggatatgtgaatgatcaagccatcaacattataaaacgatttctcctcaacatgactatagatgtgctactatacgtagaccgtttggatgtgtaccgggtggatgaccttgataggcaagttgtcggtgctataactgatgcatttggtaaagagatatggaagaagtctgctcttgttctcacccatgctcagttctctccaccagacgggttaaattataaccactttgtctccaaaagatctaatgctcttctaaaagttatccagacaggcgctcaactgaagaaacaggatttgcagggtttttctattcctgtcattcttgttgagaacagcggaagatgccataagaacgaaagcgatgaaaagattcttccatgcgggactagttggattcccaatctgttcaacaaaatcacagagatctcttttaatggcaacaaggcgattcatgttgacaagaaactggtcgaagggccaaacccaaacgaaagaggaaaaaaactgattcctttaatgtttgcattccaatacttgctggtgatgaagccattggttcgagcaatcaagtccgatgtttcgagagagagtaaaccggcgtgggagctgcgagactccggtttagcaagtcgaaggtcttgagttgtggacacgagttttgtttggtttgtttgtctatctgagaggcgcgcc

SEQ ID NO: 439 - DNA, 1110 bp, Arabidopsis thaliana
ttaattaattctaaattcagacccattttcaccggcgcgagtcatcgttgaaccatgtcttggcttcctgtagaatctgatcctggtattttcactgagattatacaacaaatgcaagtgaaaggtgtgcaggttgaggaattgtattccttggacttcaactctctggatgaaataagacctgtctatggattgatattgctttacaagtggcgtccagaagaaaaggagaatcgtgttgtcatcacagagccaaacccgaatttcttctttgcaagccagataatcaacaatgcttgtgcgacccaagcgatattatcagtcctcatgaactcttcgagtattgatattggctcagaactatcagaactgaaacaattcgccaaagaatttcctcctgaactgaaaggtttagccatcaacaacaatgaggcaatacgtgcagctcacaacacatttgccaggcctgacccgtcttccatcatggaagatgaagaattagctgctgcgaaaaatctagacgaagatgatgatgtgtatcattacatcagctacttacctgttgatggtatcttatatgagctcgatggtcttaaagaaggacccattagtcttggacagtgtctgggtgagccagaaggaatcgagtggctcagaatggtccaacctgtggtacaagagcagattgaccggtattcgcagaatgagattcggtttagtctcttagctgtagttaagaacaggaaagagatgtatgtagctgaactgaaagagtatcaaagaaagcgagagagggttttgcagcagttaggtgctttgcaagctgataaatacgctgagaaaagcagttacgaggctcttgatagagagctttcggaagtcaatatcgggatagagactgtttcacaaaagattgtaatggaggaggagaaatctaagaactggaagaaagagaacatgagaaggaaacacaactatgtccctttcctcttcaacttcctcaagattcttgctgacaagaagaagctgaaacctctcattgctaagcaccatccctaaatctgctttaccgggatgttaacttgatagaaatcagatgtttggcgcgcc

SEQ ID NO: 440 - DNA, 777 bp, Arabidopsis thaliana
ttaattaagtggattctttggtttcgatttgtaataatcttcgtagaaaaaatggattctgattcttggagtgatcgtctcgcatcggcttcaagaagatatcagctcgatttcttgtctcgatctgacaatttcttggggtttgaggagatagaaggagaagatgacttcagggaggagtatgcttgcccgttctgttcagactattttgatatcgtctctctatgctgtcacattgatgaagatcatcctatggatgcaaaaaatggggtatgtcccatttgtgcggtgaaagtgagctctgatatgattgctcatataaccctacaacatgcaaatatgttcaaggtgacgcggaaaaggaaatcaagaagaggcggggctcaatccatgctatcgatcttgaagagagagtttcctgatggaaattttcagagcctatttgaaggaacatcacgtgctgtatcctcttcttctgccagtatagctgctgatcctttactgtcttcattcatttcaccaatggctgatgactttttcatttctgagtcaagtctatgtgcagacacaagttctgccaagaaaacattgaatcagagtttgcctgaaaggaatgttgagaagcagtctctttcagcagaggatcacagagaaaagttgaaacagagcgagttcgttcaagggatattgagctctatgattcttgaagacggcttataaaggagaaacatattccggtaacttgtctacggttagatgattcagcgatggcgcgcc

SEQ ID NO: 441 - DNA, 1245 bp, Arabidopsis thaliana
ttaattaaactggtgagagtgtgagtgaaaaaacaaaaaaaacaattcaactgcaaaaatgagttccggaatcggaagtttagtgaaggtcatctttaagaacttcgatgtcatcgctgggtaatttaattagtattatttagcctgattatgattttttttctcgttttattttctccattaatttgatccttcttggtgtgcagacctgtgattagcttggtttatcctctgtaagtttcatacaagtatctctttattttcctgagaatatattatatatgtcaaatcttgagttctttttaatttggattttggtttacacagatatgcatcagtgagggcaatagagtcgaggagtcatggagacgacaagcaatggttgacgtattgggctctctattcacttatcaaactctttgagctcacttttttcagactcctcgaatggtaactttcacacaaaatctctaaacctttcttgattacgcaagctactacttatgaaaagagagtaaggtcacagtcacacacaatatgtttgtttctagggctcttaaaatttgtgataaaatcgatgacttggattttacctaccgaccttactatatgaaatttattaaaaagttggtttggggggtacatagatttacctttcttgtagtccaagtaaggtacttcaggtaacggatgagcttatgtttaacattcctagactgacttcaggagataaactgagctgtatgtaacggtggttcattgattcaattatatagactgaagtttcgagatttatggtatgatcaggatcccattatatccatacgcaaagctagccctaactagttggttggtcttaccgggcatgaacggtgctgcttatctctacgagcactatgtgcgttcattccttttaagcccacatactgttaacgtatggtacgtgccagccaagaaggatgacgacttgggagcaaccgctggcaaatttactccagtaaatgattccggtgcgcctcaggaaaagattgtgagctcggtatgacctcttaactctctattactctataagaccctatttgtgacctaatgttcgatctataaggcacatcaatctcttgaacgtttatattttcaggtggatacatcagcaaaatatgttggtcattcggcttttgatgacgcctatatctactaggctagtagctagtaaactacttccggctagttgtagctgggcgcgcc

SEQ ID NO: 442 - DNA, 1637 bp, Arabidopsis thaliana
ttaattaaatctcttcctatatatggccgactcgactcggccgcttctctcagatttcaactcgtccgagtcaaatcttccgccaccaagatcccttgaggagacgatagagcgatgcattggagacttcgggtgggcacagtttctccaagccgctttagtctcattcgcttggttcttcgacgctcaacaaacattcatcaccgtcttcaccgactcacaacccatgtggcactgtgacaactcggaccgagtcgactcagtatgcaacacatcctcctccaacctctgcaccttacccaaccaaacctggtcttgggacttgaacccacacgtttcaatcatttccgagtgggggctacaatgcgccggctcgttcctcaagggatttcctgcaagctcattcttcctcggctgtctaatcggcggcttagctctctctacactcgccgactcatcgctcggtcgtaagaacatgctcttgttgtcgtgtctcataatgtctctctcttccatgttaacagctttctcaacgagcatttgggtttatgcgtttttgagattcttgaacgggtgtggccgagccacgatcgggacttgcgcgcttgttctatcaacggagttagtcggtaaaaaatggcgaggacaagttggagcgatgggtttcttttgcttcacgctagggtttttatcgcttccgatgttaggttacattaatgaagggaattcttggaggaatctgtatgtttggacatcgataccgactttaatctattgctgtttagttcggagtttcgtccgggaatctcctagatggcttatcgtaaagggtcgtaaagaagaagccgtctcaattctccaaagcattgcttctaatgcaatcactatgagcttcacaaacttatgttttgaagtagaaaatgatcaatccaagtcaaatcctgatgtttatgatgcgttaaagatcttggtgaggaaaagttggtcgtttagaagattattagcggcaatggtggttggattcggtatcggtatggtttattatggaatgccattagctttaacgaatctaaacttcaatctttacttaggggttgtgttcaacgccttgtctgagttcccagcttttctgataacgtttttcttcattgataaaatcaataggagagatgcgttgatcggatttacagctctaagtggaatctctagcgctctaatcgcggtgttaggacaacaactagggtcattacagattgtgttagagctcgtttcgtttttcagcgcatgcaccgcatttaacatgacgcttatttacacaattgaaatgtttccgacatgtgtgaggaactcggcgatttcgatggtgaggcaagcattggtgtttggcggcgtgtttagtccagtgatggttgctgctggtcgggaaaatcagttttggtcgtatgggttgtttggtttgatcataggattgtgtggattgtttgtgtttggattgccggagactagaggaagtgttttatgcgacactatggacgaggaggagtataagactttggcaaaaagacaatttattggttgatacttgatactgttgtcttttgttgtaatggttaaaaagtttgcaggcttggcgcgcc

SEQ ID NO: 443 - DNA, 939 bp, Arabidopsis thaliana
atgccaccggccggagaactccgacatcaatctccatcaaaggagaaactatcttccgttacccaatccgatgaagcagaagcagcgtcagcagcgatatctgcggcagctgcagatgcggaagctgccggattatggacacagatcaaggcggaagctcgccgtgatgctgaggcggagccagctttagctagctatctatattcgacgattctttctcattcgtctcttgaacgatctatctcgtttcatctaggaaacaagctttgttcctcaacgcttttatccacacttttatacgatctgttcttaaacactttttcctccgatccttctcttcgtaacgccaccgtcgcagatctacgcgctgctcgtgttcgtgatcctgcttgtatctcgttctctcattgtctcctcaattacaaaggcttcttagctattcaggcgcatcgtgtatcacacaagctatggacacaatcacggaagccattagcattagctctacactcaagaatctccgatgtattcgctgttgatatccatccagcagcgaagatcggaaaagggatacttctagaccacgcaaccggagttgtagtcggagaaacagcggtgattgggaacaatgtttcaatccttcaccatgtgacactaggtggaacaggtaaagcttgtggagatagacatccgaagatcggtgacggttgtttgattggagctggagcgactattcttggaaatgtgaagattggtgcaggtgctaaagtaggagctggttctgttgtgctgattgacgtgccttgtcgaggtactgcggttgggaatccggcgagacttgtcggagggaaagagaagccaacgattcatgatgaggaatgtcctggagaatcgatggatcatacttcattcatctcggaatggtcagattacatcatataa

SEQ ID NO: 444 - DNA, 1445 bp, Arabidopsis thaliana
ttaattaaatggaatctgaaagactcgaatcacatcttctgaataagcaagaagaagaagcttcttccttcacttctggtcttcttctcagcacatccgtcgttgtcgctggatccttctgttatggctgcgccatgtcatattcgtcgcctgctcagtccaaaatcatggaagaactgggactttccgttgcagattattcgtttttcacttcggtaatgacattaggaggaatgattaccgccgtgttcagcggtaaaatctctgctctcgttggtcgtcgacagacaatgtggatctcagatgtttgctgtatttttggttggctcgctgtagcgtttgcacatgatattataatgcttaatactggacgactcttcttggggtttggggttggtctcattagttatgtggttcctgtgtatatagcagaaattacacccaaaacatttcgtggaggattttcttattccaatcagcttctacaatgtcttgggatttcactcatgttcttcaccggaaactttttccattggcgaacattagctcttttaagtgcaatcccaagtgctttccaagtgatatgtttattttttattcctgaatctcctagatggctggcgatgtatggtcaagatcaagagcttgaagtttcgttgaaaaaactaaggggagaaaatagtgatattctaaaggaagctgctgaaatcagagaaacagtggaaatatccagaaaagagtctcaaagtggaataagagacttgttccatatcggaaacgcacattcgttaatcattggattgggtttaatgctcttgcaacaattttgtgggagtgcggcgataagtgcttatgctgctcgaattttcgacaaagccggttttccaagcgacataggaacaaccatcctcgcagtgattctgataccgcaatctatagttgtcatgttaaccgttgaccgatggggacgccgaccacttcttatgatttcttctatcggaatgtgcatatgctcattttttattggcctttcatactaccttcagaagaatggtgaatttcagaagttatgttccgttatgttaatcgtcggtttagtgggttatgtctcatcctttggcattggcctaggtggattaccatgggttataatgtctgagatatttccggtgaatgtgaaaatcaccgccggtagccttgtaacgatgtcaaattggttttttaattggattatcatctatagttttaatttcatgatacagtggagcgcttccggaacatatttcatattttctggagtttctctggtgacgatcgtattcatatggacattggtgcctgagacgaaaggccgaacactcgaagagattcaaacatcattagtccgactttcgtaaaatctaagtatggattatacgtaatgttaagtctcttgaaggcgcgcc

SEQ ID NO: 445 - DNA, 2484 bp, Arabidopsis thaliana
agaatagttaacaagtgagaggaaagtcctttttgttgcttaaatagtttgatttctgttgttgagtttatgcgatatcccaactggtgaaactgtgtttattggttcagacagagataaatggcttcaaagattattgctggcaagccggatgataccgagtatgaaatcattgaaggtgagtctgagagcgctttagcagcggggacaagcccttggatgaattcatcaacgttgaagcttcgacatcgaattggaagaggtcccttcggtgatgtttggctggctactcatcatcagtcaactgaggactatgatgagcatcatgaagtggccatcaaaatgctttatcccatcaaggaagatcaaagaagggttgtggtagataagtttgaagatctcttctctaaatgtcaaggactagagaatgtctgtctgctcaggggagtctctagtatcaatggaaaggtaagtgaaacaaacatgtgtgtttctctagtttcaccgtattttcaatttttgtttaatagctgatttgtatcgtgtagatatgtgtcgtcatgaaattctacgagggctctcttggtgacaagatggctcggcttaaaggaggaaagctttcactgccagatgttttgaggtaattcttcattacacaagtaagaagctcattgtagtagcgtcttcttcattgtaatatagaatactaatgtctttcttatttatgtgaacctcgttttacagatacggggttgatctggctacagggatcctggagttgcactcaaaagggtttctcattctcaatctcaagccctctaactttcttctcagtgataacgacaaggccatcctcggggatgttgggatcccttatctccttcttagtatccctttaccaagttctgatatgacagagagacttggaactccaaactatatggcaccagaacagtggcaaccggatgtcagaggtcccatgtcctttgagactgattcttggggatttggttgcagcattgttgaaatgctgactggtgtacaaccttggtctgggagatctgccgatgaaatatatgatttggtggtgagaaagcaagaaaagcttagtatccccagtagcataccgcctcctctcgagaacctacttcggggttgctttatgtatgatcttcgaagccgaccttcgatgactgacatcttactcgtcttaaagaggtaaatcatatcttgacaccgttatatattcagtttgaacaagatcgatttagaagtgtttatatttcattatgtatggtcatagtatcttcggaaaatcccatagtttttatagtttcgtgtctgatgttttaatatttttttggaatccaatttctttattcttgatggaaattttaattggctacctttaattgtgatattgactggaaccgatttggcagcttgcagaactcggaggaggaacaggtcaggagaggcattgatagtagagaaatcaggaagagctcggctactcttggttatacagaatggtttctttcaaaggatcatctgcaagtgcgcgacaccgtgcgttcaagaaagcctgccaattcgtgtaagcatgagaacatggatgtgccagaaggaatggtggttggtttagaacgtgactccacagacccagatggatttgtgctagttaaagtccatggtgtacatgatccattaagggttcacgtatctgttcttgaacgggtaactaacggcttagcttctggagattgggtgcgtctgaaggtcaggaaagacaagaggcactctccggttggtgttctccattcaattgaccgtgagggaaatgtagctgttggatttattgggttgccaactctctggaaagggacatcatcgcagcttcagatggctaaagtatacagtgtgggtcaatttgtgaaactcaaagccaatgttgtcatcccgagattcaaatggatgcgtaaaggtagaggtatttgggcaactggcaggatctctcaggttctaccaaacggttgccttgaagtggacttccctggaatgttaccttttggagaggaacatggaagctatcttgcagatccggctgaagtagagattgtgaatttcaatacatgtcaaggagctgtggaaaaatatcaacatctggaggattttcattgggctgtgagacctttgcttattgctatgggtctattgacagcgatgaagttagggatctgtgtcaggaagaaaataggaaggtcaaaggatgggaaacaacgcgatggctcgactggacaaggtgactgtaagattccggatggtaagggctctgacaaatctaaatggcttgtgttcttttaggtctgctatgagacacagaccttgtctggtccatatattatactgttctagtcataataacgtttcatgtacataatgacgtttttcttttttgctctttaaaattaccaaaaagctttc

SEQ ID NO: 446 - DNA, 1367 bp, Arabidopsis thaliana
ttaattaacccttcaagattttcttctctctatctctctgtttctctctgtttctgagatgggtttgtttggaacgaagaagatcgggaagtatgagataggaagaacaatcggagaagggaatttcgcaaaagtgaaacttggttacgacacgaccaatggtacttacgtagctgtcaaaatcatagacaaggctttggttattcaaaagggtcttgagtctcaagtcaagagagagatacgaacgatgaagcttcttaaccatcccaacatcgtccaaatacacgaggtgattggaaccaagacaaagatctgtatagttatggaatacgtttcaggtggtcagctttcagacagacttggaagacagaaaatgaaagaatcagatgctagaaaacttttccaacaattgattgatgctgttgattattgtcataacagaggagtttatcatagagatcttaagccacaaaacttgttactagattcaaagggtaatctcaaagtttctgactttggattaagtgcagttcctaaatcgggggatatgctctctacagcttgtggctctccatgttatatagcaccagagttgattatgaacaaaggctactcaggagcagcagtagatgtatggtcttgtggagtgattctatttgaattgcttgctggttatccacctttcgatgatcatacacttccggttttgtataagaagatactcagagcagattacacgttcccacctggattcactggagagcagaagaggctaatctttaacattcttgacccaaatcctctaagtcgtataacactagctgagataatcatcaaagattcttggttcaagataggttatacaccagtttatcatcaactttcagactcaatcaaggacaatgtcgcggagataaatgcagcaaccgcgtcatcaaatttcataaatgcttttcagataatagcaatgtctagtgatctagatttgtcaggtctcttcgaagaaaatgatgataagagatataaaacaagaattgggtccaagaacacagcacaagaaacaatcaagaagattgaagctgcagcaacttatgttagtttatcagttgagagaataaagcacttcaaggttaagattcagccaaaggagataagatcaagatcttcttatgacttattatcagcagaggtgatagaggtgactccaacaaattgtgttatagaaatatcgaaatccgcaggcgagttaagactatacatggagttttgccagagcttatcaagcttacttaccgcggaagtaagctaagatagagagccatagattctcaagtaaaaatgttaaaacagaggaagcaaggcgcgcc

SEQ ID NO: 447 - DNA, 1491 bp, Arabidopsis thaliana
ttaattaaacaaatgggttgtttacattccaaaactgctaatcttccttcttctgatgatccatcagctccaaacaaaccagaatcagtaaatggggaccaagtggatcaggaaatccaaaatttcaaagaatttgaactaaatgagttgaggaaagctaccaatgggtttagtcctagctgcattgtctctgaaggtggagagaaagctcctaatgtcgtttacagagggaagcttgaagggaatcatcttgtagctatcaagcgattctctaggcaatcttggcctgatgctcaacagtttgtggtggaagcgactggtgttgggaagcttagaaacaagagaatagttagtttgatcggttgctgtgctgaaggagatgagaggttgttggtggcagagtatatgcccaatgatactctctcaaagcatctcttccactgggaaaagcagccacttccatgggatatgcgtgttcgaatcgcagactatattgcagaagcacttgattactgcaatattgagaaccgaaaaatctatcatgacctcaatgcatacagaatcctcttcgacgaggaaggtgatcctcgtctatctacttttggtcttatgaagaacagtagagatggcaaaagctatagcacaaacttagcttatactccacctgagtttttacggacaggtagagtcattcctgaaagtgtgatattcagttatggaactattcttttagatcttttaagcggcaaacacattccacctagccatgcccttgatatcataagagggaaaaatgctttgcttcttatggattcatctcttgaagggcaatatgcgaatgatgatgcgactaaattagttgatcttgcttcaaaatgccttcaatcagaggcaaaggatcgaccagataccaaatttcttctctctgcagtagcaccactacaaaagcaagaagaggttgcttctcatgtcttaatgggcttaccaaagaacacagtaatattaccaactatgctttctcctcttggaaaggcctgtgcaaagatggaccttgcgacatttcacgacattttgcttaaaaccggttacagagatgaagaaggtgcagaaaatgagctttcatttcaagaatggacacaacaagtgcaggagatgcttaacacaaaaaagttcggggacattgctttcagagacaaggatttcaagaactcaattgaatactactccaagttggtggggatgatgccggttccttctgcaacagttttcgctagacgggctttctcctacttaatgacagaccaacaggagcttgcactgagagatgcaatgcaggcacaggtgtgcataccagaatggccaacagctttttacttgcaggctttagcgctctcaaagctcggaatggagactgatgctcaagatatgctcaacgatggcgctgcatatgatgctaagcgacagaatagctggcgctgctaagggcgcgcc

SEQ ID NO: 448 - DNA, 915 bp, Arabidopsis thaliana
atgagaactttgagctcccaattatactccaatggtggtctcacttggttccagaagaagaatcagagctctctgttcatcaagcatctcagagtctctaaaccatcgagggttcagctcatatctgctgttcaattccgtccgtgcatcgatattcataagggaaaagtgaaacagatagttggatccacacttcgtgacttgaaagaggatggttcagttctcgttacgaattttgaatcggataagtctgcggaagagtatgcaaagatgtacaaagaagatgggcttacgggtggtcatgtgataatgcttggagcagaccctttaagccaagctgcagctattggagcattacatgcttatcctggcggtttgcaagttggaggtggaatcaattctgagaattgcatgagttatattgaggagggagcaagccatgtcattgtcacttcgtatgtatttaacaatggaaagattgatcttgaaagactcaaagatattgtgagcattgttgggaaacaaagactgatattggaccttagctgcagaaagaaggatggaagatacgcaattgttactgatagatggcagaagttcagcgacgtcatccttgacgagaaatcattggagtttcttggaggattttcagatgagtttctggtgcatggcgtagacgttgaaggaaagaagctagggatcgatgaagagcttgtagcattgcttggcaactactctccgattccagtaacttatgcgggaggtgtgacggtaatggatgatgtagagaggatcaaggacgcaggaaagggacgtgtagatgtaacagtgggaagtgccttagacattttcgggggaaatcttccatacaaagacgtcgtcgcttggcatcacaagcagcactcactccattga

SEQ ID NO: 449 - DNA, 1777 bp, Arabidopsis thaliana
ttaattaaatggcgtccactcgtaaacccagtggtcatggagctgaagtcgaagctcagaagcgctcctcttcgaatagtagtactaagtcagccaaagccgagacttttgagccgatgcaattacaaagatcagtaacaaacccaagagctgttggaattccggagagtaaacggttgccagagtcttttaggaagcgatctagcgacccggctgtttgtaaacccgatttcagctccctatccactgttcttgagcatgtagattcattgaccattgatgaaaagaaaacatctggctttggcagcgtcaagaccagctctgcttcagccaaattgagtgatggtacgagcagtcttggcaagactagtggaagtgccaagctaagtggccgccttgatttcatggagagtggcaagagcagtatctgcagaggaagcacaagcagtgatgtgagtgacgagagtagctgcagcagctttagtagcactgtcaacaaaccccacaaggccaatgacttaagatgggaagcaatccaggctgttagggttcgtgatgggcttttaggtcttagtcatttcaggctccttaagcggttaggctgcggggacatcgggagtgtttatctctctgagctgagcgggactaagtgttactttgctatgaaggttatggacaagacatcccttgccagtcgcaagaagcttctccgagctcagactgaaagagagattctccagtctttggatcatccatttctccctaccctctacactcactttgagactgagaaattctcatgcctggtgatggaattctgtcccggaggagatttgcatactctcaggcaacgccagccggggaaacatttttctgagcaagcggtaaaattttacatagcagagtcattgttagctttggaatacctgcacatgcttgggattgtgtatcgagatcttaagcctgaaaacgttctagttcgagaagacggacatataatgctctctgattttgacctttctctccgatgtcttgtcagcccgactctagtgaaatctgccgccatcgagtcagatcctttacggaaaaacgtttactgtgtgcagcccgcttgcattgagccctcctgcattcaaccgtcttgcaccgtccccaccacttgcttctccccacgtttgttctcaagcaaatctaagaaggaccgtaaacccaagaatgacaccgcaaatcaagttaggccattgccagagctggtagccgagccaaccgatgcacgttccatgtcatttgtgggcacacacgagtacttggccccagagatcatcaaaggcgaagggcatggcagtgcagtggattggtggacttttgggatattcctttacgagcttctctttgggagaacgcccttcaagggctcaggaaaccgacaaacactgttcaatgtggtgggtcagcctctgcggttcccagaaacgcctgtggtgagttttgcagcgagagacctcatccggggcttgctcatgaaggagccgcagcagcggctggggttcaaacggggagccactgaggttaagcagcaccctttcttcgaaggtgtgaactgggctttgattcggtgtgcgactcccccggaaataccaaagccggttgagctggaaaaaggagctgtgagtgttgcagaggcaccatcaagccagaagacagcagcgggtttggttctgaatgctcagaaagggtctgataactatttggaatttgatttcttctagggcgcgcc

SEQ ID NO: 450 - DNA, 1351 bp, Arabidopsis thaliana
ttaattaaaagaagaagaagaaagagaaggctcattagaaattgatgggtgcttgtatttcgttcttttcttcttcctctccttccaaaacaggtctccatagtcatgccacaacgaacaaccacagcaatggaacagagttctcgtcaaccaccggcgcgacaacaaacagcagcgtcggacaacagagccaattctccgatatttccactgggattataagtgattccggtaaactactggaatcgccaaatctcaaagtctataactttctggatctaaagacggcgacgaagaatttcaaaccggattcgatgttgggtcaaggaggtttcgggaaagtatacagaggttgggtcgatgccacgactcttgctccttccagagtcggttctggtatgatcgttgccatcaagagattgaattctgagagtgttcaaggatttgcagagtggcgttcagaagttaacttcttgggaatgctttcgcaccgaaatctggtgaagttattgggatactgtcgtgaagacaaagagcttctccttgtctacgagttcatgcccaaaggaagtcttgagagtcatctttttagacgaaacgatccttttccttgggatttaaggatcaagattgtgattggtgcagctcgtggccttgcgtttctacacagcttacaaagagaagtcatctatagagacttcaaagcttccaatatacttcttgattcgaactatgacgcaaagctttcagatttcggactagcaaagctaggaccagcagatgagaagtcacacgtcacgactaggatcatgggcacatatggttatgctgctcctgaatatatggcaacaggccatttatacgttaagagtgacgtattcgcctttggtgtggttttactagaaataatgaccggactgacggcgcacaacacaaaacggcccagaggacaagagagtcttgtcgactggttaagaccagaactctcaaacaaacacagagtgaaacaaataatggacaaaggaatcaaaggtcaatacacaaccaaggtcgcgaccgaaatggcacgcattacactctcttgtatcgagccagacccaaaaaaccgaccacacatgaaggaagtagtcgaagtcctcgaacacatccaagggcttaatgttgtccctaaccgttcttccactaaacaggccgttgctaactcttcacgttcttcgccacatcactatcgctataaagctggcgcacttggggctgaacgcaagagagcaacgcctggacggtttggatcagtagaaaaataaatagttgtttggtatcttttttttccggcggtatgaaatggcgcgcc

SEQ ID NO: 451 - DNA, 1594 bp, Arabidopsis thaliana
ttaattaaatggatgaagaggctacttcgtggattaggagggctaagttttctcaaacggtttcttatcgtttgaattcttcaaagttagcttctcttccttttatgataaaccaagataagttttctggattaaaagctatacctcagagatcatcttcttcgtcgtcggcatcatcatcggatcctaagttggtttcgagtaactcacagactacgggagatacttcgagtttggaagctgctgatgtatatgttgttgattcggaaatacagacaaacccggttactcataagcagagatctgtttctccttcgcctcagatggctgttcccgatgtgtttaaggaagcgaggtctgagcgtaagagattttctactccacatccaagaagagtggaatcggaaaagggaatgaagcctaagttatctcataaaaactcctttgacaagagatcatttaacttgcggtctccttcaggtcctatcagagatcttggcactttgagaattcaagagagggtcaagagcaagaaggacactggatggtctaagctttttgataatactggtcgtagagtgagtgctgtggaagcttctgaagagttccgtgttgatatgtcaaagctgttctttgggcttaagtttgctcatggtttatacagccggctatatcatggtaagtatgaagataaagctgttgccgtgaagcttatcactgtacctgatgatgacgataatggatgcttgggagctcgtttagagaaacagtttaccaaggaagtgacccttttgtctcgattgacccatccaaatgttataaagtttgttggagcgtacaaagatccgcctgtatattgtgtcctcacgcagtatttacctgaaggatctttaagatcttttctgcacaagcctgagaataggtctcttcctttgaaaaagcttatagagtttgctatagatattgctagagggatggaatatattcactcacgacgcataattcatcgggatcttaagccagaaaatgtattgatcgacgaagaattccatttgaagatcgctgactttggcatagcgtgcgaggaggagtactgtgacatgttggctgatgaccccggaacatataggtggatggcacctgaaatgataaaacggaaaccacatggacgtaaggccgatgtatacagctttggactcgttttatgggaaatggtagctggagcaatcccatatgaggacatgaatcctattcaagctgctttcgcagtcgtacataagaacattaggccagctatcccgggagattgtccagtagccatgaaagctctgatagagcagtgttggtcggttgcaccagataagagacccgagttctggcagatagtgaaagtgcttgaacagtttgcgatatcactggaacgtgaagggaacctgaatctgtcttcgagcaagatctgtaaggacccaaggaaaggtctgaaacactggatccagaagcttggaccagtccacgcaggaggaggcggtggcagcagcagcagcggccttggtggctcagccttgccgaagcctaaattcgcttgaggcgcgcc

SEQ ID NO: 452 - DNA, 580 bp, Arabidopsis thaliana
ttaattaaatgttagcaccgggggagagtgttctgatcccggcggaggagataagtctctccgctggtgatgttatctccttgtcggtgcacaatctaatagcttctgtttctagctaccgtccatggtggtcagaatttctagcattcggttccatcgaccgtccaagctctttctcccccgctgtttcgcgcgttaaacttaaccttcaccactttgcggttaactacgtacttttaaccgctgcttccatcacactcttcttgatcggtgatccgatggctcttgtcacggttgcatcctttgtagccatgtggctactcctatatttctatagagaccatccgttggtcttgtacggtcgacatattagcgaccgtgttatcgtctttgggttgattcttggctcgctttgggcattgtggttcattaatagcctccaatgcctgattcttggcgtcgttacaagtgtcttgctttgtttggtccacgcaatcatacggaattcagacgacctctttgtacaagagaaagatgttgttgttccttccaatttccttcattggagctgaggcgcgcc

SEQ ID NO: 453 - DNA, 1157 bp, Arabidopsis thaliana
gtttgttgattaacccttaattaagatgtctcaaaacgggaagataatcccaaatctggaccaaaacagtacgaggctcctcaatctcacagttctccagcggatcgatccatacatcgaggaaatcctcatcacagccgctcatgtcactttctatgaattcaacattgagctcagccaatggagtcgtaaggacgttgaaggatctttgtttgttgtcaaaagaagtacacaacctcgatttcagtttattgtgatgaatcgtcgtaatacagataatctggtggagaatctcctgggagattttgagtatgaagtacaaggtccatatttactttaccgtaatgcatctcaagaagtaaatggcatttggttctacaataaacgtgaatgcgaggaggtagcaactcttttcaacagaatactcagtgcatattccaaggttaaccagaagccaaaggcctcatcttcaaagagtgagtttgaggaattggaagctaagcctacaatggcagttatggatggtcctcttgaaccatcatcaactgctagggatgcccctgatgatcctgcttttgtcaacttctttagctcaacgatgaatcttgggaacactgcgagtgggtcagcaagtggaccttaccaatcatcagcgattcctcaccaacctcaccagcctcaccaacccaccattgctcctcctgtagcggcagcagcacctccacagatacaatcaccaccgcctctacaatcctcctctcctctgatgactctctttgacaacaaccctgaagttatcagcagcaactccaacattcacacagatttggtgacgccgtctttctttggccccccacgaatgatggcacagccacacctcattcctggtgtatctatgcccactgctcctcctctcaatcctaataatgcgagtcaccagcagcggtcatatggtactccggtgctccagcctttcccacccccaactccaccaccatcactcgctcctgcacccactggtccggttatcagcagagacaaagtgaaggaagcccttttatccctgttgcaggaggatgaattcattgacaagattacccgaactttacaaaatgcacttcaacaatgaagctgggcgcgccaaaaattggagctct

SEQ ID NO: 454 - DNA, 1094 bp, Arabidopsis thaliana
ttaattaatcttcttgataacctttcttcttctttgaaatgggttcttctgtggagcagaacattcttgttactggtggtgctggctttatcgggacgcatactgttgttcaacttctcaaagatggttttaaggtttcgatcatcgataattttgataactctgttatcgaagctgttgatagagttagggagcttgttggtcctgatctctccaagaagctcgacttcaatctgggtgatctaagaaacaaaggggacattgagaaactattctccaagcagagatttgatgctgtgattcattttgcgggtcttaaagctgtgggtgagagtgttgaaaaccctcgccgctactttgacaataacttggttggaacaatcaatctatatgagaccatggcaaagtacaactgcaaaatgatggtgttttcatcttctgccactgtttatggacaacctgaaaagattccatgcatggaagactttgaattaaaggctatgaatccttatggtcgtactaagctctttcttgaagaaatagctagagatattcaaaaggcagaaccggaatggagaattattctgctgaggtacttcaatcctgtaggagcacatgagagtggcagtattggtgaggatccaaaaggcatccccaataacctcatgccttacatccaacaagtggccgttggacgtttaccggaactcaatgtctatggacatgactatcccaccgaggatggtagtgcggtaagagactacatccatgtgatggatttagcagatggccatatcgctgcgctcaggaagctatttgctgatccaaagattggttgtactgcttacaatctagggactggtcaaggaacgtctgtgttagaaatggttgcagcttttgaaaaagcttccggcaagaaaatcccgattaagctctgtccgagaaggtcaggagatgcaacagcagtttatgcttcaacagagaaggctgagaaagaacttggctggaaggcaaaatatggagtggatgagatgtgcagagatcagtggaaatgggcaaacaataatccatggggttaccagaataagctttga

SEQ ID NO: 455 - DNA, 1080 bp, Arabidopsis thaliana
aaaacccggccgaaagaagaagacgatcactctcacaagcaaaaaaaattcactttttgtttttgttaacactcacgtgaaagcttcgttcttcttcaaaccttttgaacaatttctccgatgccggtaaatcaccggtttacgtttagctaccggttactcttcctcatcttccttttgagtttcgaaacggcacagcgtttggtcaccggtgacccaaacgacgaagcatgcttgacgaatctccgtcagagtttagaagatccagctaataatctccgtaactggacaaaatccttcttcataaatccttgctccggcttctcttcttatcttcatggagtcatttgcaacaatggcagaatttacaaactctccttaacaaatctctctctccgtggctcaatctctccgtttctctctaattgcacaaatctccaatccctagatctatcttccaaccagatctccggcgagatcccgccgcaattacagtttttcgttaacctagccgttcttaatctctcttctaatcgtctctccggtcaaatctcaccacaaatcgctctctgcgcttacttaaacgtcatcgatcttcacgataaccaactctccggtcaaattccgtttcagttcgggcttctcgctagattaacggcgtttgatgtctctaataacaaattatccggtcagattccctcgaatctggcgatgcgtaacggaaacttgccgagatttaatgcgagctcgtttatagggaacaagaaattgtttgggtatccgttggaggagatgaagaacaaaggattgtcgataatggcgattgttgggattggacttggaagtggaatcgcgagcttagtgattagcttcactggagtttgtatatggttgaagattacagagaaaaagatggaggaagaagaaggaaagataagtcactccatgcctgtttactaaacacaaacatttcgttttttttcttcttaagtataattaacggtttcttttatcacataattagttttttttttccattttgatcaaaagcatacagcaatagggagggttcattaagcg

SEQ ID NO: 456 - DNA, 1133 bp, Arabidopsis thaliana
ttaattaagaagtaaaattgagagagcgagagcgagctagaaacaagatgactcataatcatcatcatcaagctgttgacaatctgctaaatgttttctcaagagcttctcatgatcttactgttgttcattccaagctcgacaaggagtttcagcagatgtatcctgctaatgtaagcaaaattcgattcaatactttgaatccaagatctatgtaatctaatggattcaaattaaccatctttaggcgaatccgatgaagctgattcagcgaatcaagaagttgcaggaagatgtgactcttcttaaacaccaatgccttgacctattgtctgctaaacaggttcgtatctcgaagataagcttcggtttagctcgatgaacgatgcatctatgtaatttgaatcaaaggatgatttttaatctatcgcaaagaagaaaggttaaatttttcgtgttgagagttttttgcttaggctttgcaagatctgattcgactgtgactgttatagaaacgatttgtgtgtttttgttataatcaggatttgattgataaggcacagactacacttgttggaaactgtaaccttattcagaaaatgaatgcatcattaggagaatcaacgaatggcgataccgatgatgcattggctgattttaatcaggttcgtgctcttttcttcgttggtaatgcaatggagtttctttttggcttgaaatgtttgtcacattgttcagtgctttctctagctagtgcaatatctactgatactattggatagcggcaagaacattactaatgcaaaacaatccaaaattctacatataacaaaggacatgatctctttgcttttcgtttcttgtttttcaacagatcattgacgagtggacaatgcaagttagatccagaacaggtactgctcgtgtaaatgaaactgtgatatgtatttaaaactgttgtagtgttgtgttatattcctaaattatgcttcttttgtttctgatacagtgggagaaacagaggacgcagataaagaagacatcaataagatgcttttctcagctatttgtcataccaattgatgatattcattgttcatggttatgttaagacctacactaccaggcgcgcc

SEQ ID NO: 457 - DNA, 1375 bp, Bacillus subtilis subsp. subtilis str. 168
gctttcaaactctttgtttcttgtttgttgattaacccttaattaatccgggcgcgcctgatttatcacaagtttgtacaaaaaagcaggctcctgcagggaccatggaaataacaccgtccgatgtcatcaagacacttccaaggcaggagttttctctcgtttttcaaaaggtaaaggaaatggaaaaaacgggagcccatatcattaatctcggacaggggaaccctgaccttcccactccgccgcatattgtcgaggctttgcgggaggcttctctgaatccttcgtttcatggatacggccctttcaggggctatccttttttaaaggaagcgatcgccgctttctataaaagggaatacggagtgacaatcaatcctgaaacggaagtcgcgcttttcggaggcgggaaagccggattgtatgtgctgacacaatgcctgctcaatccgggagacatcgctttagtcccgaatccaggctatcctgaatatttatcagggattacgatggcgcgagctgagctttacgaaatgccgctgtatgaagaaaatggctatctgccggattttgaaaagattgatccagccgtgctggaaaaagcgaagcttatgtttttaaactatccgaacaaccccactggagctgtggctgatgcggctttttatgcaaaagctgctgcttttgcgaaagagcataacatccatttgattcatgattttgcatacggggcgtttgaattcgatcaaaaaccggccagctttcttgaggcagaggatgccaaaactgtcggagcagagctttattcattttcaaaaacatttaacatggccggctggagaatggcgtttgcggttgggaacgaaaaaatcattcaggccgtcaatgaatttcaggatcatgtatttgtcggcatgttcggcgggctgcagcaggcagcgagtgcggcgctttctggagatccggagcatacggaatcgttgaaacgaatttataaggaacgaattgacttttttacggcgctttgtgaaaaggaactgggctggaagatggaaaagccaaaaggaaccttttacgtatgggctgaaattccgaatacgtttgagacatctcaccaattttccgattacttgctggagcatgcccatgtcgtagtcacaccgggcgaaatttttggaagcaacggaaaaaggcatgtcagaatctcaatggtgtcgaagcaggaggatctgcgggaatttgtcacgcggattcaaaagctgaacctgccgttcgggtcattacaagaaacatcccgctaactcgagacccagctttcttgtacaaagtggtgataaattggagctctgcagagctttcgttcgtatcatcg

SEQ ID NO: 458 - DNA, 1547 bp, Pseudomonas fluorescens PfO-1
aactctttgtttcttgtttgttgattaacccttaattaatccgggcgcgcctgatttatcacaagtttgtacaaaaaagcaggctcctgcaggatcatgacggtacccccgcgtgccgttcagcttaacgaagcgaacgcgttccttaaggaacatcctgaggttctgtacgttgaccttctgattgcggatatgaatggtgtggtgcgcggcaagcgcatcgaacgcaccagcctccacaaggtttacgagaaaggcatcaacctgccggcctctctatttgctctggatatcaatggttcgacggtggaaagcaccggcctgggcctggacatcggcgacgccgaccgtatctgctatccaatccccgataccctgtgcaacgagccatggcagaagcgcccgaccgcgcaactgttgatgaccatgcacgaactcgaaggtgaccctttcttcgccgacccgcgcgaagtgctccgtcaagttgttgcaaagtttgacgagcttggcttgaccatctgcgccgcgttcgaactcgagttttacctgatcgaccaggaaaacgtgaacggccgccctcagccgccacgctcgccgatctccggcaaacgcccgcattcgactcaggtttacctgatcgacgacctcgacgaatacgtcgactgcctccaggacattctggaaggcgccaaagagcaaggtattccggccgacgccatcgtcaaggaaagtgccccggcgcagttcgaagtgaacctgcaccacgtcgccgacccgatcaaggcatgcgactacgcggtcctgctcaagcgtctgatcaagaacatcgcctacgaccatgaaatggacaccactttcatggccaagccgtacccgggccaggcaggcaacggtctgcacgtccacatttcggttctcgacaaagaaggcaaaaacatttttgccagcgaggatcccgagcagaacgccgcgctgcgtcacgcgatcggcggtgtgctcgagaccctgcccgcgcagatggctttcctctgcccgaacgtcaactcctaccgtcgtttcggcgcacagttctacgtgccgaactcgccgagctggggcctggacaaccgcaccgtggccctgcgcgtaccgaccggctccgccgacgcggtccgtctggaacaccgcgttgccggcgccgacgccaacccgtacctgctgatggcttcggtgctggcgggcgtgcaccacggtctgaccaacaagatcgagccaccggctccgaccgaaggcaacagctacgagcagaacgagcagagcctgccgaacaacttgcgcgatgccctgcgcgagctggacgacagcgaggtgatggccaagtacatcgatccgaaatacatcgatatcttcgtcgcctgcaaagagagcgaactggaggagttcgaacactccatctccgacctcgagtacaactggtacctgcacaccgtttaactcgagacccagctttcttgtacaaagtggtgataaattggagctctgcagagctttcgttcgtatcatcggtt

SEQ ID NO: 459 - DNA, 1340 bp, Pseudomonas syringae pv. tomato str. DC3000
aactctttgtttcttgtttgttgattaacccttaattaatccgggcgcgcctgatttatcacaagtttgtacaaaaaagcaggctcctgcaggaccatggtcatgaccgtcttgaagatgaccgacctcgatctgcaaggtaaacgtgtactgatccgcgaagacctcaacgtcccgataaaggacggcgttgtcagcagcgatgcacgtattcttgcttcgctgccgaccatcaggctggcgctggaaaaaggcgcggctgtcatggtctgctcgcaccttggccgtccgaccgagggcgagttttctgctgaaaacagcctcaagccggttgctgaatacctgagcaaggcattgggtcgtgacgttccgctggtcgccgattacctggacggcgttgacgtcaaggcgggcgatatcgtgctgttcgagaacgttcgcttcaacaagggcgagaaaaagaacgccgacgagctggcgcagaagtacgcggccctgtgcgacgtgttcgtgatggacgcttttggcaccgctcaccgcgctgaaggctcgacccacggcgtggccaaatacgccaaggttgccgctgctggcccgttgctggctgccgaactggaagcgctgggcaaggcgctgggcgctccggctcagccaatggctgctattgttgccggctccaaagtgtccaccaagctggacgtgctcaacagcctgagcgcgatctgcgatcagttgattgttggcggcgggattgccaacacctttctggctgcagccggtcacaaggtcggtaaatcgctttacgagccagacctgctcgacaccgcgcgcgccattgccgccaaggtcagcgtgccgttgccgactgacgtggtggttgccaaggaattcgccgagagtgccactgcaaccgtcaagctgatcgccgatgtggccgacgacgacatgattctggatattggtccacagactgctgcgcacttcgccgaactgttgaaatcttccgggactatcctgtggaacggtccggttggcgtgttcgaattcgaccagttcggtgaaggcaccaaaacgctggccaaggccattgctgaaagcaaagcgttctccatcgcgggtggtggcgacaccctggccgcgatcgacaagtacggtgtggcagatcagatttcctatatttcgaccggtggcggtgcgttcctcgaattcgtggaaggcaaggttctgccagcggttgaaatgctcgaacaacgtgccagggcctgactcgagacccagctttcttgtacaaagtggtgataaattggagctctgcagagctttcgttcgtatcatcggtt

SEQ ID NO: 460 - DNA, 1904 bp, Arabidopsis thaliana
ttaattaaaaaggaaggaacttggaatcatgaagcttgggcttttcactctctcgtttcttctgatcttgaatctagcaatgggtagattcgttgttgagaagaacaatctcaaagttacatcacctgattcgatcaaaggtatttacgaatgtgccattggtaatttcggagttcctcaatacggtggtactttagtcggcaccgtcgtctatcctaaatccaatcagaaagcttgtaaaagctactccgatttcgatatctccttcaaatccaaacctggacgattaccaacttttgtccttatcgatcgtggagattgttacttcactttgaaagcatggatagctcaacaagctggagcagcagcgatacttgtagctgatagtaaagctgagccattgattacaatggatacacctgaagaagataaatctgatgcggattatcttcagaacattaccattccttctgctctcattactaaaacattgggagacagtataaagtctgctctttccggtggtgatatggttaacatgaagctagattggactgagtcggttccacatcctgatgagcgtgtagagtatgaactgtggactaatagcaatgacgagtgtgggaagaagtgtgatactcagattgagtttctcaagaattttaaaggagctgctcagattcttgagaaaggtgggcatactcagttcacgccacattatattacttggtactgtcctgaagcgtttacgttgagtaaacagtgtaagtctcagtgcatcaaccatggaaggtattgtgcgcctgatcctgagcaggattttacgaaagggtatgatggaaaggatgttgttgttcagaatctacgtcaggcttgtgtctacagagtgatgaatgataccggtaagccgtgggtctggtgggactatgtgactgactttgctatccggtgtccaatgaaggagaagaagtacaccaaggaatgcgcagatggaattattaagtcccttggcattgatctcaaaaaggtggacaagtgtatcggagaccctgaagcagatgtggagaacccagttcttaaagcagagcaggagtcacagataggcaaaggttcccgtggagacgtgactatactcccaactcttgtcgtgaacaacagacaatacagaggtaaattggaaaagggggcagtgcttaaggctatgtgttcgggttttcaagagtcaacggaaccagctatctgtcttactgaagatttggaaactaatgaatgtttggaaaacaacggtggatgctggcaagacaaagctgccaacattactgcatgcagggatacttttaggggaagattgtgtgagtgccctactgttcaaggtgttaaattcgttggtgacggttacactcactgcaaagcctctggagctttgcattgtggtatcaacaatggaggatgctggagagaatcccgaggtggcttcacttactctgcttgcgtagatgatcattcaaaggattgcaaatgcccacttgggttcaagggcgatggagtgaagaactgtgaagatgtggacgagtgcaaagaaaaaacggtgtgccagtgcccagagtgtaaatgtaaaaacacttggggaagttatgaatgcagctgcagcaacggtttgctttacatgcgtgagcacgacacttgcataggttcaggcaaagttggaaccacaaaactcagctggagctttttgtggatccttataatcggggtgggtgttgcaggtctttctggatatgcagtctacaaatacagaatcaggagttacatggatgcggaaattagagggatcatggcacagtacatgccattggaaagtcaaccacccaacacaagtggtcaccatatggatatatgagtga

SEQ ID NO: 461 - DNA, 978 bp, Desulfitobacterium hafniense
gctttcaaactctttgtttcttgtttgttgattaacccttaattaatccgggcgcgcctgatttatcacaagtttgtacaaaaaagcaggctcctgcaggaccatgaaaaagatcagttttatcggggcaggaaacatggctgaggccattatcaaagggctgatggtgacgggaagctacgaaattcgggtgaccaatcgctctaaccaggctaagctggcccaaatgaaagaggactatggggtcattcccgtctcttttagggaagcggtcaaggattcggagatcatccttttagcagtgaaacccaaggatgttggggaagcgttggcccaaatcagggagggtataagctcaaaccagctcctgatcagcgtggcggcaggaattcccctggccttgctggaaaaacatttgcctcattgtcccattattcgggctatgcccaatacctcaagcgccgtcttgcattccatgaccggcttggtcaaaggtcagggtgtcaatgaagcgaagcagagggatgtggaagatatttttggggcagttgggaaatatatctggataactgaggaacagattaatcccctcatcgccatgagcggaagcgggccggcttatttttatctttttactgaggctttggtcaaggcaggggttgatatgggcttcagccaggaggtagccgagaacctggccaaagaaaccttaatgggagcagctaagatgctggctcagagcgggaaatcccccggtgaattgagggtggccgtaacctcgcccaaaggaaccacccaggaggctttggaggtcttccgggagcaggggttagaagagcttgtggcccaggccgctaaagcctgcaagcatcgtgcacaagcaatggaaagggagtatttggggtgactcgagacccagctttcttgtacaaagtggtgataaattggagctctgcagagctttcgttcgtatcatcg

SEQ ID NO: 462 - DNA, 1480 bp, Desulfitobacterium hafniense
aactctttgtttcttgtttgttgattaacccttaattaatccgggcgcgcctgatttatcacaagtttgtacaaaaaagcaggctcctgcaggaccatggaagggtttaagatcaaaagcgttaaggcacgtcaggttttcgattcccgggctaatccgactgtagaagttgatataaccctaaaggatgaaacagtcggacgtggcatcgtcccctccggcgcctcgacaggtctctttgaagcggtggaattaagagacggtgaggaaaccttcgacggtaaaggtgtaagcaaggctatccatcatgttaatgaacagctggcaccgctgcttctggatatagatgttcgcgaccaaaaagccattgacagcaggctgatagaaattgatgggacccctaacaaatcccgcctgggtgccaatgcgattctgggatgttctatggctgcttgctgggcaggtgctaattattataaagtacctctttacagatatctgggaggttcggcggcgaataagctgcccgtgcccatggttcagattataggtggaggcgcacatgccgacaacgccatagatattcaggattttctggtcatcccaaccagtgccccaacctttagtgagggctatgagatggtggtcaatgtctataacgccgctaagatgatctttaagggggccggcaaacctgtctctatagctgatgaaggtggtttatggcctacggggttccaatcaaacgaagaaggattaaaactcctctgtgaaagtatcgaattggccgggtatacgccgggtcaggatctggggatagcattagatatagcctccagtgaattttatgatccagagcggggcacctaccgtcttgagctggaagagaaaactctgaccaaggaagagatggtgggcatgctctctgattgggtggataaataccccatcatttccatagaagatggaatgagcgagctggactgggagggcaaccttcttttaacgcaaaaactgggcaaaaaaattcaattaatcggggacgacttgttcacaaccaatatagagcgcattagaaaaggcgttgagatgaaggttgacaatgccgttctgatcaaaatgaaccaaatcggaacgattacggaaaccatcgaaaccatcgaatttacacaaaaccatggttatttaccggttgtatcggccagaagcggagaaacggaggattgcaccatcgttcatcttgccattgccaccaatgccggacagctgaaagtagggtcggcagcccgcagtgagagaacagctaagtggaatgaagtgttgcgcatcgaggaggctttagggtcttcggcaagatatccatcgaaaggggtgtttgcagcagccggtatccaatttaaccaatattaactcgagacccagctttcttgtacaaagtggtgataaattggagctctgcagagctttcgttcgtatcatc

SEQ ID NO: 463 - DNA, 1365 bp, Nostoc punctiforme PCC 73102
tttatttgtcagctttcaaactctttgtttcttgtttgttgattaacccttaattaatccgggcgcgcctgatttatcacaagtttgtacaaaaaagcaggctcctgcaggaccatgaaagcagtctgctggaacggcgctaatgatgtccgggtacagtcggtaccagacccgacaattctcaacccgcgtgatgcaattattaaaattacttccacggcgatttgtggctccgatctacatatttatggcggctatatccccacagtgcaacagggtgatattatcggtcacgaatttatgggagaagtcgtggaagttggcagaggagtcaacaatttaaaaataggcgatcgcgtagttgttccttctaccattggctgtggtaattgccattattgccaacatgatatgtggtcattgtgtgataattccaatcctaaaggttggattgaagaaaaattatttggcaatatcacctcagccatttatgggtactcccacatgttaggtggttatgcaggcgcacaagcagaatatatccgtgtaccctttgctgatgtaggtgtcgtcaaagttccgccagacttaccggatgagatgttgttattcatctccgatgctattcccaccggttatatgggtgcagagttatgcgatatccaaccgggtgatactgtagcggtttggggttgcggtgctgttggacagtttgccatgattagcgcctacatgatgggagccgaaaaagtgatcgcaatcgatcgctttcccgaacgcctggaaatggcgaaaaagtttgccaaagcagaagtgattaactacgaagaagttaatgctggcgaagcgttgaaagagatgactggtggtcgtggccccgatgcttgcatcgatgctgttggtttagaagcacacggcgttggtttagaagacttctacgaccagacaaaacaaaagctcagattggaaaccgaccgtccccacgttctgcgggaaatgatggttgcctgtcgtaaaggcgggactctttcaatcatgggtgtttatggtggttttgtagacaaaatcccatttggtgctgccttcaacaagggtctaacttttaggatgggacaaatgcatggacaaaaatatatgcatttgttattgcagatgattttggatggaaaactcgatccatccttcgttgtcacccatcaattacctctagaacaagcaccccacgcctaccacatttttcaacaaaaaaaggacaactgcatcaaagttgttcttaaaccctgactcgagacccagctttcttgtacaaagtggtgataaattggagctctgcagagctttcgttcgtatcatcggttcgacaac

SEQ ID NO: 464 - DNA, 1013 bp, Pseudomonas syringae pv. tomato str. DC3000
gctttcaaactctttgtttcttgtttgttgattaacccttaattaatccgggcgcgcctgatttatcacaagtttgtacaaaaaagcaggctcctgcaggaccatgatcaagaaatgcttgttcccagcagccggttacggcactcgcttcctcccagcgaccaaggccatgcccaaggaaatgctgccggtggtcaacaagccactgatccagtacggtgttgaagaagcgctcgcggcaggtctgaccgaaatttccatcgtgactggccgtggcaagcgctctcttgaagatcactttgacattagctacgagcttgagcatcagatcaaaggcactgacaaagagaagtatctggtcggtattcgcaaattgatcgacgagtgcagcttctcctacacgcgtcagaccgaaatgaagggcctgggccacgctatcctcagcggtcgtccgctgatcggcaacgaagcgtttgccgtagtgctggccgatgacttgtgcgtcaaccttgaaggcgacggcgtgctggcgcagatggtcaagctacacaagcactatggctgctcgatcattgccattcaggaagtcgatccgtcggaaaccaacaagtacggcgtcatcgctggcgaagagatcaagccaggcttgttccgcgtgaccgacatggtcgaaaagccgaagcctgaagatgcaccgtccaacctggcgatcatcggccgttacattctgacgccggacatcttcgaaaaaatcgaacagaccgagccaggcaagggtggtgagatccagatcactgacgccctgatgaagcaggcagcggaaggtaacgtgctggcctacaagttcaagggcacgcgctttgactgtggcggcgctgaaggctacatcgaagcgaccaacttctgcttcgaacatttctacaaagctggcaaagcgcattgactcgagacccagtttcttgtacaaagtggtgataaattggagctctgcagagctttcgttcgtatcatcg

SEQ ID NO: 465 - DNA, 1271 bp, Cupriavidus metallidurans
aactctttgtttcttgtttgttgattaacccttaattaatccgggcgcgcctgatttatcacaagtttgtacaaaaaagcaggctcctgcaggaccatgaaagccgcagtgatggaaaaagcaggcgcgccgctcgtgatccatgacgttgccattgccgaaccgggtccgcgcgaggtgcgggtgcgaacggcggccgtggggttgtgccatagtgatcttcacatgatgcagggcacctatccgctaccactgcccgccgtgcttgggcacgaggtgtcgggcgtggtggaggccgttggcacgcaggtatccggactgaaggcgggcgatcatgtggtgggctgcctgtcggtctattgcggccactgctcggtatgcgcgtcgggccatcaggtgctgtgccagaacccggaggtgaagcttccgcccggcaaggccaaccgtctgcgcctggcggggaatccgctcagccaggtgttcaatctctccggtttcgccgaagagatcctcgtgcacgagaacgcgctggtgaagattcgcgacgatatgccgctcgatcgcgcggcgctgctcggctgcgcggtcatcaccggcactggcgcggtcttccatagcgcgaaggtgccgccgggcagcaccgtggtggtggtcggctgcggcggtgtcgggctgtccgtgatcaacggcgcggtgattgccggcgcgtcgcgtgtgatcgccgtggacatgctgcctgccaagctggaactggctcgcaagttcggggcgaccgacgttgtcaatgcgggcgatggggatccggtcgcgcaggtgatgcaactgaccggcggcggtgccgaattcgctttcgaatgcatcggcttgaagcagaccgccgagcagtgctacgcgatgctggcccccggtggcacggcgacggtgatcggcctgttccgtccggatgcgaggatcgaactgcccgcactcgacttcctgaaagagaagcgcatccagggctcgttcatgggttcgaaccgcctgagtctggatatccctcgactggtcgagttgtacatgcagggcaagctgctgctcgacgatctgatttcgcagcggatctcgctggaggatatcaatgaggggttcatcgccatgcagtcgggaagcgtggcgcgaagcgtgatcacattccctggggtaggcgggttgtaactcgagacccagctttcttgtacaaagtggtgataaattggagctctgcagagctttcgttcgtatcatcggtttcg

SEQ ID NO: 466 - DNA, 1771 bp, Bacillus subtilis subsp. subtilis str. 168
tattcatttatttgtcagctttcaaactctttgtttcttgtttgttgattaacccttaattaatccgggcgcgcctgatttatcacaagtttgtacaaaaaagcaggctcctgcaggaccatgagtaaaaaaccagctgcactcatcattcttgatgggttcggattacgtaacgaaacagtagggaacgcagtcgctttagcgaaaaaaccgaattttgaccgctattggaaccagtatcctcatcaaactttgactgcttcaggcgaggctgtaggtcttcctgaagggcaaatggggaactccgaagtaggtcacttaaatatcggtgcgggacgtattgtgtaccaaagcttaacacgcgtaaatgttgccattcgtgaaggagagttcgaacgcaatcaaacattccttgacgcgatcagcaacgcgaaagaaaacaacaaagccttgcacctgttcggtcttttatctgacggaggcgtgcacagccatatcaatcatttattcgcactgttaaagcttgcgaaaaaagaagggctgacaaaggtttatatccatggcttccttgacggccgtgatgtaggtccgcagacagcgaaaacgtacatcaaccagttgaacgatcaaatcaaggaaatcggtgtaggtgaaatcgccagcatttccggacgttactactctatggaccgcgacaaacgctgggaccgtgtagaaaaagcgtaccgcgcaatggcgtacggcgaaggcccatcttaccgcagcgccctggatgttgttgatgattcatatgcaaatggtatctacgatgaattcgtgattccatctgtcatcacaaaagaaaacggtgagcctgttgcgaaaatccaagacggcgattctgtgattttctataatttcagaccggaccgcgccatccagatttccaacacgttcacaaacaaagacttccgtgacttcgaccgcggcgagaattatccaaagaacctgtatttcgtctgcctgactcacttcagtgaaacagttgacggctatgtagcgtttaaaccgataaatcttgataacacagtcggagaagtattatctcagcacgggttaaaacagcttcgaattgcagaaactgaaaagtatccgcacgtcacgttctttatgagcggcggccgtgaagctgaattcccgggtgaagagcgtattctcatcaactcgcctaaagttgcaacgtatgacttgaagcctgagatgagtgcgtatgaagtgaaagacgcgcttgtcaaagaaattgaagctgacaagcatgacgcgatcattcttaacttcgcaaaccctgatatggtcggccactccggaatggttgaaccaacaattaaagcaattgaagcagtggacgaatgcttgggcgaagtcgttgacgcgatccttgctaaaggcggacacgctatcattaccgctgatcacggtaatgctgacattctgattacagaatcaggcgaaccgcacactgcgcatacaacaaacccagtccctgtgattgtaacgaaagaaggcattacgctgcgtgaaggcggaatcctaggcgaccttgcaccaacgttattagaccttcttggtgttgaaaaaccgaaagaaatgacaggaacatctttaattcaaaaataactcgagacccagctttcttgtacaaagtggtgataaattggagctctgcagagctttcgttcgtatcatcggtttcgacaacgttcgtcaagttcaatgcatcagtttcattgcg

SEQ ID NO: 467 - DNA, 1359 bp, Bacillus subtilis subsp. subtilis str. 168
gctttcaaactctttgtttcttgtttgttgattaacccttaattaatccgggcgcgcctgatttatcacaagtttgtacaaaaaagcaggctcctgcaggaccatggataaaaaaactctcaaagacatcgacgtaaaaggcaaagttgtattctgccgcgttgactttaacgttccaatgaaagacggggaagtaacagacgatacacgtatccgtgctgcgcttccaacaatcaaacaccttgcagaccaaggcgcaaaagtccttcttgcgagccacttaggccgcccgaaaggcgaagtggttgaggagcttcgtttaactcctgtcgctgcacgtctcggcgaactgcttggcaaagaagtgaaaaaagcggatgaagcatacggcgatgctgtaaaagcacaaatttctgagatgaaggacggagacgttcttgtattggaaaacgtacgtttctatcctggtgaagagaaaaatgatcctgagcttgcaaaagcatttgctgagcttgcagatgtatatgtaaatgacgcattcggtgctgcccaccgtgctcacgcatctacagctggaattgccgagcatctgccagcagttgcaggtttcttaatggaaaaagagcttgatgtacttggaaaagcggtttccaatcctgaccgcccgttcacagcgatcatcggcggagcgaaagtaaaagacaaaatcggtgtaatcgaaagtcttcttgataaagtagacaacctgatcatcggcggaggtcttgcttatactttcgtaaaagcgcttggctatgaagtcgggaaatctcttcttgaagaggataaaatcgagcttgcgaaatcatttatggaccgcgctaaagaaaaaggcgttaacttctacatgcctgaagatgtactcgttgcagatgatttctctaacgatgcaaacgtgaaaattgtgccgatctctgaaatccctagtgatttagaagcaatcgacattggtacgaaaacacgcgaaacgtatgctgacgtcatcaaaaacagcaaacttgtcgtgtggaacggaccaatgggcgtattcgaaatcgacttgttcgctcaaggaacaaaagcggttgcggaagcattggcagaggcgaaagatacatactctgtcatcggcggaggagactctgcggcagcggttgaaaaattcggccttgctgacaaaatgagccacatctcaacaggcggcggcgcatcccttgagtttatggaaggcaaagagcttccaggggtagctgcactgaacgataaataactcgagacccagctttcttgtacaaagtggtgataaattggagctctgcagagctttcgttcgtatcatcg

SEQ ID NO: 468 - DNA, 1871 bp, Saccharomyces cerevisiae
caaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacctgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaaatttaaatacccagcaaattggagctctgcagagctttcgttcgtatcatcggtttcgac

SEQ ID NO: 469 - DNA, 1431 bp, Sinorhizobium meliloti
ttcatttatttgtcagctttcaaactctttgtttcttgtttgttgattaacccttaattaatccgggcgcgcctgatttatcacaagtttgtacaaaaaagcaggctcctgcaggaccatggccatcaatgcaacggtcaaggaggcgggctttcagcccgcctcgcggatttcctcgatcggagtttcggaaatcctgaagatcggcgcccgcgccgccgccatgaagcgcgaaggcaagccggtgatcatcctcggcgccggcgagccggatttcgacacgccggaacacgtgaagcaggccgcctcggatgcgattcaccgcggcgagacgaaatacaccgcactcgacggcacgccggaactgaagaaggcgatccgcgagaaattccagcgcgagaacgggttggcctacgagctggacgagatcacggtcgcgaccggcgccaagcagatcctcttcaacgccatgatggcctcgctcgatccgggcgacgaggtcatcattccgacgccctactggacctcctattcggacattgtccatatctgcgagggcaagccggtcctgatcgcctgcgacgcatcttccggtttccgcctgacggcggaaaagcttgaggcggccatcacgccgcggacccgatgggtgctcttgaactcgccctccaatccgtcgggcgccgcctacagtgcggccgactaccggccgctgctcgaggtacttctgaggcacccgcatgtctggctgctcgtcgacgacatgtatgagcacatcgtctatgacggtttccgcttcgtcaccccggcgcagttggagccgggcctgaagaaccgcacgctgaccgtaaacggcgtctcgaaggcctatgcgatgaccggctggcggatcggctatgccggtggcccgcgcgagctcatcaaggcgatggccgtcgtccagagccaggcgacctcatgcccctcttcgataagccaggcggcttcggtcgcggcgctcaacgggccgcaggacttcctgaaagaacgaaccgagagcttccagcgccgccgcgatctcgtggtcaacggcctgaacgcgatcgacggcctcgactgccgcgttcccgagggtgccttctacaccttctccggctgcgccggcgtgctcggcaaggtgacgccatcaggcaagaggatcaaaacggatacggacttctgcgcctatcttctggaagacgcccatgtcgccgtcgtcccgggctcggccttcggcctctcaccctttttccgcatctcctatgcaacatcggaggcggagctgaaggaggcgctcgaacgaatcgctgcggcttgcgatcggctttcgtgactcgagacccagctttcttgtacaaagtggtgataaattggagctctgcagagctttcgttcgtatcatcggtttcgaca

SEQ ID NO: 470 - DNA, 1275 bp, Bacillus halodurans
gctttcaaactctttgtttcttgtttgttgattaacccttaattaatccgggcgcgcctgatttatcacaagtttgtacaaaaaagcaggctcctgcaggaccatgaaaatacaagcggctgtacttcataacaaaggggagccattttcgattgaagaagtggaactcgctgaaccgaaagctgatgaaattctcgtaaaaatagtggcttctggtgtttgtcataccgatgcggtcgccagggaacaattaatcccgattccgttacctgcggtgttaggccatgaaggatcaggggttgtagaagcggtcgggacccatgtgacatccgtgaagccaggcgatcatgttgtactcacctttacaacatgtggggagtgcgaaaattgccaaagcgggcatccatctttctgtacggaatttgcgccattaaactttttcggaaagatgtctgatcgaacgaaccgtattcagcaaaacggtaaagacgtttctaccttttttgggcaagcctcgtttggaacgtatgctattgcgaatgcacgaaatgttgtgaaggtggaccccgatgttgatctcgctttactaggaccgttagcgtgcggcatccaaacaggtgccggtaccgtcttaaataaattaaggccggagttcggatcatccgttgcgattttcgggtgcggtgccgtcggtttaagtgcggtgatggcagcaaaaattgtcggatgccaaaagattattgcgatcgatatccatgacagtcgcttagcgctagcaaaagagctcggagccacccatgtgtttaatgggaatgatagtcgcctagttgaagccattcaagcagtgacaaacggtggtaccaattatgccgttgaaacgacagggatatcccacgtctttcatcaatcaattaaggcgttaacaaccctcggagtcgttgctgtggtcggagtcgggggagacgtgacggtcaatatgaacgatgatattttatctcaaggaaaaacgatcaccggtgtaattgaaggagacgtagtgccacaattgtttataccaaagctgattgactattacaaggcgggtcatttcccttttgatcgcctagttaaactttatgaactagatgaaatcaatcaagcattcgaagattcaaaaaatggaagcgcggttaaaccgattattaaaatgaaccatcacatttagctcgagacccagctttcttgtacaaagtggtgataaattggagctctgcagagctttcgttcgtatcatcg

SEQ ID NO: 471 - DNA, 1505 bp, Bacillus halodurans
aactctttgtttcttgtttgttgattaacccttaattaatccgggcgcgcctgatttatcacaagtttgtacaaaaaagcaggctcctgcaggaccatggcaaaggatgaaagctatttaataaaaccactgcttgacagaaactatccgtgtgtttcctacgggaaaggagcagcgctttatgatatggatggaaagcgctatcttgacgcttgctctggagctgtcaccgcatcgatcggccatggggtggatgaagttgtccaggcgatgtacgaacaggctcgtaaagtatcgttcgtctatcgctctcagtttacgaatgaaccggcagagcggctcgcaatgaaattagcggaacagctgccagggcaattgaatcatagcttttttgtgaacagtggctcagaagcaaccgaaacagcaattaaaatctcaattcaatattggcaagagcgcggacgtcctgagaaaacgttaattctctctagatggatgagctatcacggaattacacaaggagcgctttcattgtcaggtcattatgaacggagacaacgatttgaaggaatgctagaccggctcccatttttatctcccccgtatccgtacagacaagtgagagaaatgtctggtgttgactatgccgaagagcttgatcacctgatcgagcagatcggacctcacaggatcgcagcttttatcgctgaaccgattgttggcgccgcgggaactgcattagtaccgggtgaatggtactatgaagcgctaaaacaagtgctcgatcagcatgacattttattcatatgcgatgaagtgatgacgggaatgggacggacagggaaggatctggcgattgaacattgggatgcgacgcctgacattgtcactttaggcaaagggttgtccgcagggtacgccccactcgctgcaaccgttgtcgccgaccatgtgcttgagccaattcaagcaggatcgaaccttattatgagcggtcatacgtttagcgccaatcctttatcctgtgcggctgggttagccgtactccactacgtaaaaaaacacgatctcgtaaaacgcgcagctacaattggtgaaaagttgatagaggatcttcaagagattcaaacggcctcggcgatcgtaggggatgtgagagggaaggggttgctcatcgggcttgagtttgtgaaaaataaagcgacaaaagcaccttttccgaaagatgctcaagtggcggctgttatcgtaaacgaggctcaacggcaaggccttttgctatatccatcagctgccggattaaagggggagggagctggttgtttaattgctccacctttcacgttgacgaaagaggaacgatgtgaattgttaggaaaattagcaaggacacttgaacgagtcgaaaaacagctgttgggggctgagaaatgactcgagacccagctttcttgtacaaagtggtgataaattggagctctgcagagctttcgttcgtatcatcg

SEQ ID NO: 472 - DNA, 1126 bp, Bacillus halodurans
gctttcaaactctttgtttcttgtttgttgattaacccttaattaatccgggcgcgcctgatttatcacaagtttgtacaaaaaagcaggctcctgcaggaccatggatgttgtcacgtttggggaaacaatggtcgtattcgaaccggtggagatgggcgccttacgctatgtggaccgctttaaaaaaggggtcggtggtgcggaatccaatgttgccattggtgtcgccaagctaggccattcggttggctgggttagcaaagtcgggaacgatgagcttggtaaatatgtgatttccgcgattcgcggggaaggggtcgatacatctcaagtcgtgttggatgacggggcaccaactggcctctacttaaaagaaaagcttcgtgacgatttcaatcgagtttattattatcgggcaggatcggccgcgagtcgtttaggcgtagaggacattaactgggcgtacatgaagcaggcaaaaattatccatatcactggaatcacgccattattgagtgattcttgctatgaactgtgtcatgctgtgctagactttgccaaagagaatgggattttcgcttcattcgatccgaacctgcgaatgaagctgctcgcaaatgttccagatgggaaggagaggctgctggcgttagcaagtaaggcagatctggtcatgccaggccgtgatgaagcagcgtttctatttgataccgatgagctagcgcaaatgttttcaaggctcttgaccggtcggacgacaagcgtcgtgattaaagatggggccaaaggggctcacttcatggaagaaggtaaagagccacaatttgtaccgagctgcccagtggataaggtcgttgatcccgttggggctggtgacgggtttgctgctggtgtccttgccagtttactcgaagggaagtcaatggaagaagccgtctcggtcggaacacaaattggtgcgctcgtcgtcatggcaaaaggtgacatggaaggactaccggagcgagagcagctggaagcattttcgcaagcccgttccgatgttttacgataactcgagacccactttcttgtacaaagtggtgataaattggagctctgcagagctttcgttcgtatcatc

SEQ ID NO: 473 - DNA, 1083 bp, Escherichia coli K12
gctttcaaactctttgtttcttgtttgttgattaacccttaattaatccgggcgcgcctgatttatcacaagtttgtacaaaaaagcaggctcctgcaggaccatggctgccattaatacgaaagtcaaaaaagccgttatccccgttgcgggattaggaaccaggatgttgccggcgacgaaagccatcccgaaagagatgctgccacttgtcgataagccattaattcaatacgtcgtgaatgaatgtattgcggctggcattactgaaattgtgctggttacacactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcagggtctggcgaaaggcctgggacacgcggtattgtgtgctcacccggtagtgggtgatgaaccggtagctgttattttgcctgatgttattctggatgaatatgaatccgatttgtcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggtgtggtagaaaaaccgaaagcggatgttgcgccgtctaatctcgctattgtgggtcgttacgtacttagcgcggatatttggccgttgctggcaaaaacccctccgggagctggtgatgaaattcagctcaccgacgcaattgatatgctgatcgaaaaagaaacggtggaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaactcgagacccagctttcttgtacaaagtggtgataaattggagctctgcagagctttcgttcgtatcatcg

SEQ ID NO: 474 - DNA, 659 bp, Pseudomonas putida
gctttcaaactctttgtttcttgtttgttgattaacccttaattaatccgggcgcgcctgatttatcacaagtttgtacaaaaaagcaggctcctgcaggaccatggctgttcaacgtactttctccatcatcaagcctgacgctgttgccaaaaacgtcatcggcaagatcaccactcgcttcgaagaagccggcctgaaaatcgttgcctcgaaaatgaagcaactgtccaaagccgaagccgaaggcttctacgctgagcacagcgagcgcggcttcttcggtgacctggttgccttcatgacttccggtccggtcgttgtccaggttctggaaggcgagaacgccattgccaagaaccgtgagctgatgggtgctaccaaccctaaagaagctgctgccggcaccatccgcgctgacttcgccgagtcgatcgacgccaacgccgttcacggttcggactccgaagctgctgctgctcgcgaaatcgcttacttcttcgctgctaccgaggtaaccactcgctaagcgaaagcttacgggtgagggtgaatccatgacgacatctactggcaaaatcaacctgtctcgagacccagctttcttgtacaaagtggtgataaattggagctctgcagagctttcgttcgtatcatcg

SEQ ID NO: 475 - DNA, 1112 bp, Pseudomonas syringae pv. tomato str. DC3000
gctttcaaactctttgtttcttgtttgttgattaacccttaattaatccgggcgcgcctgatttatcacaagtttgtacaaaaaagcaggctcctgcaggaccatgtttctggtttgcggcgaagcactgttcgatattttcacccgcgctgacgacggcggttccctgaacagactggggtttgacgccattgccggcggctcacccttcaatgtggccatcggtttgcgccggcttggcgtggaggcggcattttttgccgggctgtccaccgactatctggggcgccgcctgcgcgccgtgctggaacaggaaacggtcaatgccgagcacctgatcgaattcgatgcgcctaccacactggcgatggttgcggtgggcagcgacggttcgcctacctacagctttcgtggcgacggctgcgcagatcgacagttacgactggaacacttgccggaactcgatgagcgggtacgcgggattcatgtggggtcgttttcgctggtggtgcagccaattgccgacacgttgctggcactggtcgcccgtgagagcgccaggcgcctgatctcgctggaccccaatgtgcgtctgaacccggcaccggacatccagcgctggcgcacgcagattgccgcgttcgccgaacatgcgcatctgatcaaggtcagtgacgaagacttgcacctgctgtacccggacagtgatccacagcagatcgccgagggctggcttggcaagcgtacgcaactggtaatcgtcacccgtggcactcaaggcgccagcgtgtttacccgccagcacggcacctggtcagtgcccgccaaaaccgtggtgactgccgatacagtgggtgctggagacacgtttcaggccgcactgctgacctttctgagcgaacgtcagctggacacaccgcaaggcctgtcgacgctctcgcgagaaacgctggatgagatgctcaatttcgccgtcggcgcagccgcgctgacctgcaccaaagtcggcccggatctgccgtatcggcatcagttgggctgactcgagacccagctttcttgtacaaagtggtgataaattggagctctgcagagctttcgttcgtatcatc

SEQ ID NO: 476 - DNA, 2001 bp, Saccharomyces cerevisiae
gtcagctttcaaactctttgtttcttgtttgttgattaacccttaattaatccgggcgcgcctgatttatcacaagtttgtacaaaaaagcaggctcctgcaggaccatgcctagaaacccattgaaaaaggaatattgggcagatgtagttgacggattcaagccggctacttctccagccttcgagaatgaaaaagaatctactacatttgttaccgaactaacttccaaaaccgattctgcatttccattaagtagcaaggattcacctggcataaaccaaaccacaaacgatattacctcttcagatcgcttccgtcgtaatgaagacacagagcaggaagacatcaacaacaccaacctgagtaaagatctatccgtgagacatcttttaactctagctgtcgggggtgcaataggtactggtttatatgtgaatacgggtgctgctttatctacaggtggtccggccagtttagttattgattgggttattatcagtacatgtctttttactgtgattaactctcttggtgagctgtccgctgcttttcccgttgttggtgggttcaatgtttacagtatgcgttttattgagccttcatttgcattcgcagtgaacttaaactatttagcacaatggctagttcttctacccttggaattagtggccgcatctattactataaaatactggaatgataaaattaattccgacgcctgggttgctatcttttatgccaccattgcactggctaatatgttggatgttaagtcatttggtgagaccgaatttgtattgtccatgattaaaatcctctccatcattggctttactatcttaggtattgttttgtcctgtggtggtgggcctcacggcggttacattggtggtaaatactggcatgacccaggcgcttttgtagggcacagctcgggaactcagtttaaaggtttatgttcagtttttgttaccgctgccttttcttattccggtattgaaatgactgctgtctccgctgctgaaagtaaaaatccaagagaaaccattcccaaggcagcaaagagaactttttggctgattaccgcctcttatgtgactatattgactttgattggttgcttggttccatccaatgaccctaggttactaaacggttcaagttcagtggacgctgcctcatctcctctggttatcgcaattgaaaacgggggtattaaaggtctaccatcattaatgaacgccattattttgattgctgttgtttccgtggctaacagtgctgtttatgcatgttcaaggtgtatggtcgccatggctcatattggtaatttaccaaaatttttgaaccgtgttgacaaaaggggtagaccaatgaatgctatcttgttaactttgttttttggtttgctttcctttgtggcagcaagtgataagcaagctgaagtctttacatggttgagtgccttatctggtttatcgacaattttctgctggatggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgactcgagacccagctttcttgtacaaagtggtgataaattggagctctgcagagctttcgttcgtatcatcggtttcgacaac

SEQ ID NO: 477 - DNA, 1546 bp, Bacillus subtilis subsp. subtilis str. 168
gctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaaaaacaacgaatgctcgtactttttaccgcactattgtttgtttttaccggatgttcacattctcctgaaacaaaagaatccccgaaagaaaaagctcagacacaaaaagtctcttcggcttctgcctctgaaaaaaaggatctgccaaacattagaattttagcgacaggaggcacgatagctggtgccgatcaatcgaaaacctcaacaactgaatataaagcaggtgttgtcggcgttgaatcactgatcgaggcagttccagaaatgaaggacattgcaaacgtcagcggcgagcagattgttaacgtcggcagcacaaatattgataataaaatattgctgaagctggcgaaacgcatcaaccacttgctcgcttcagatgatgtagacggaatcgtcgtgactcatggaacagatacattggaggaaaccgcttattttttgaatcttaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaactacaacagatacatttaaatcagaagaaatgggcttcgtcggaacaattgcagatgatatctattttaataatgagattacccgtaagcatacgaaggacacggatttctcggtttctaatcttgatgagctgccgcaggttgacattatctatggataccaaaatgacggaagctacctgtttgacgctgctgtaaaagccggagcaaaggggattgtatttgccggttctgggaacgggtctttatctgatgcagccgaaaaaggggcggacagcgcagtcaaaaaaggcgttacagtggtgcgctctacccgcacgggaaatggtgtcgtcacaccaaaccaagactatgcggaaaaggacttgctggcatcgaactctttaaacccccaaaaagcacggatgttgctgatgcttgcgcttaccaaaacaaatgatcctcaaaaaatccaagcttatttcaatgagtattgactcgagacccactttcttgtacaaagttggcattataagaaagcattgcttatccccaaatacccagcaaattggagctctgcagagctttcgttcgtatcatcg

SEQ ID NO: 478 - DNA, 1592 bp, Bacillus subtilis subsp. subtilis str. 168
aactctttgtttcttgtttgttgattaacccttaattaatccgggcgcgcctgatttatcacaagtttgtacaaaaaagcaggctcctgcaggaccatgttcaattcgattggtgtcataggcttaggcgtaatgggaagcaacatcgccttaaacatggcaaataaaggcgaaaacgtcgctgtctataattacaccagagatttaacggaccagcttatccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaagaaggcgacgtcatcatggacggaggaaactcccactatgaagacacagaaagaagatatgacgagctgaaggaaaaagggatcggctacctgggagtcggcatttccggcggtgaagtcggtgcgttaacagggccttccatcatgccgggcggagatcgcgacgtctatgagaaagccgctcctatcctgacgaaaatcgcagcccaagtcggagatgacccttgctgtgtctatatcggaccaaaaggggcagggcactttacaaaaatggtgcacaacggcattgaatatgccgacatgcagctgattgcagaagcttatacgtttctaagagaaacgcttcgtctgccgctagatgaaattgcatctatttttgaaacatggaatcaaggtgagctgaaaagctatttaatagagattacagctgagattttacgcaaaaaagacgaaaaaacaggacagcctctgatcgatgtcatccttgataaaaccggccaaaaaggcaccggaaaatggacgagcatgcaggcgattgataacggcatcccgtccacgatcatcacagagtccttgttcgcccgctacttgtcatctttaaaagaagaacggatggcagctcaagatgtattagcaggcccggaagccgaagaaaaacacttggataaagacacttggattgaatacgtcagacaggctctttacatggggaaagtatgcgcctatgcacaaggctttgcccaatataagatgtcatctgagctttacggctggaatctgccgctcaaagacatcgccttgattttccgaggcggctgcatcatccgcgctgatttcctaaacgtgatcagcgaagcattcagtgagcagccaaatctggctaacctgctgatcgcgccttatttcacagataagctccatgcctatcaaacaggcctgcgaaaagtcgtttgcgagggtatcagcaccggaatctctttcccatgcttaactaccgcgctctcttattacgacggctaccgcacagggcgttccaatgcgaacctcttgcaggcacagcgcgattactttggcgctcacacgtacgaacggactgatatggacggcgtcttccatacgaattggtctgaataactcgagacccagctttcttgtacaaagtggtgataaattggagctctgcagagctttcgttcgtatcatcggtttcgacaacgttcgtc

SEQ ID NO: 479 - DNA, 1622 bp, Pseudomonas syringae pv. tomato str. DC3000
aactctttgtttcttgtttgttgattaacccttaattaatccgggcgcgcctgatttatcacaagtttgtacaaaaaagcaggctcctgcaggaccatgaccgttcgccgcaccaaaatcgtcgccacacttggccctgccagcaactcgccggaagtcatcgaacaactgatcctctcgggtctggacgttgctcgtctgaacttctctcacggtactccggatgagcacaaggcacgcgccaaactcatccgcgaaatcgccgccagacacgggcgcttcgtcgctctgctgggcgacctgcagggtcctaaaatccgtatcgcaaagttcaccgacaagcgaatcgagctgaaggtcggtgacaagttcaccttctcgactgctcacccgctgaccagtggcaaccagcagatcgtgggtatcgactacccggatctggtcaaggattgcggcgtaggcgacgagctgttgctcgacgacggtcgcgtggtcatgcgcgtcgacacccagaccgcacacgaactgcactgcaccgtgctgatcggcggtccgctgtccgaccacaaaggcatcaaccgtcgtggtggtggccttaccgctccggcgttgaccgaaaaagacaagcaggacatcaagctcgctgccgaaatggacctggattacctggccgtttccttcccgcgcgatgccgccgacatggaatatgctcgccagctgcgtgacgaatccggtggcactgcctggctggttgccaagatcgaacgcgctgaagcggtcgccaacgacgaagtgctcgatgcactgatccgtgccagtgacgctgtgatggttgcccgtggcgacctgggcgttgaaatcggcgacgccgaactggtcggtgttcaaaaacgcatcattctgcacgcacgtcgccacaacaaggcggtgatcgtcgccacgcagatgatggagtcgatgatctcaagccccatgccgacccgcgccgaagtgtccgatgtggccaacgccgtgctcgattacaccgacgccgtcatgctctcggcagaaagtgcggcaggttcctacccggtcgaagccgtacaggccatggcacgtatctgcgtaggcgctgaaaagcacccgaccggcaaaacgtccagccaccgtatcggtcactcgttcacgcgttgcgacgaaagcatcgcgctggccgccatgtacaccgccaaccacttccctggcgtgaaggcgatcatcgcactgaccgaaagcggctacaccccgctgatcatgtcgcgcatccgctcctcggtgccgatctacgcgttctctccgcaccgtggcactcaagcgcgcgctgcgatgttccgtggtgtctacaccgtgccgttcgacccgggagccctgccgccaggtcaggtcagccaggccgccgtcgacgaactgctcaagcgtggcctggtcgagcaaggtgactgggtcatcctgaccaagggcgacagctaccacaccatcggtggcaccaacggcatgaagatcctgcacgttggcgacccattggtctgactcgagacccagctttcttgtacaaagtggtgataaattggagctctgcagagctttcgttcgtatcatcggtt

SEQ ID NO: 480 - DNA, 1646 bp, Escherichia coli K12
actctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgactgacactcgccctgaacgtcgctttacgcgcattgatcgtctcccgccctacgtttttaacatcaccgctgaactgaaaatggctgcgcgtcggcgcggcgaagatattatcgatttcagcatgggtaacccggacggtgcgactccgccgcatatcgtcgaaaaattatgtactgtggcccagcgcccggacacgcatggttactccacttcacgcggcattccgcggttacgtcgcgccatttcccgctggtatcaggatcgctacgacgttgaaatcgacccggaatcagaagccatcgtcactattggttcgaaagagggcctggcgcatctgatgctggcgacgctggatcatggtgacacggtgctggtgccgaatccaagttacccgatccatatttatggcgcggtgattgccggggcgcaggtacgctcagtgccgctggtggaaggtgtcgatttcttcaacgaactggagcgagccattcgtgaaagttatccgaaaccgaagatgatgatcctcggcttcccgtcaaacccaaccgcgcaatgcgtggaactggagttcttcgaaaaagtagtggcgctggcgaaacgctacgatgtgctggtggtccatgacctggcctatgccgatatcgtctacgatggctggaaagcgccgtcaattatgcaggtaccgggtgcacgcgatgtggcagtcgagttctttacgctgtcgaaaagctacaacatggcgggctggcgtatcggctttatggttggcaacaaaacgctggtcagcgccctggctcgtattaaaagctatcacgattacggcacctttacgccgttgcaggtggcggcgattgcggcgctggagggcgatcaacagtgcgtgcgcgacattgccgaacagtacaaacgccgccgtgatgtattggttaaagggctgcatgaagcgggctggatggttgaaatgccgaaggcttcgatgtatgtctgggcgaaaatcccggaaccatatgcggccatgggatcgctggaatttgccaagaagctccttaacgaagcgaaggtttgtgtctcgccggggattggctttggcgactatggtgatacgcatgttcgctttgcactgattgaaaaccgcgaccgtattcgtcaggccatcagagggattaaagcgatgttccgtgccgacggtttactacccgccagcagcaaacatattcacgaaaacgcggaataactcgagacccagctttttgtacaaagttggcattataagaaagcattgcttatccaaatacccagcaaattggagctctgcagagctttcgttcgtatcatc

SEQ ID NO: 481 - DNA, 1746 bp, Escherichia coli K12
ttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggaatgaacagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaggtggtggccgcggtggaagcgcagttgaaaaaactgtcgcacacctgcttccaggtgctggcttacgagccgtatctggagctgtgcgagattatgaatcagaaggtgccgggcgatttcgccaagaaaacgctgctggttacgaccggttccgaagcggtggaaaacgcggtaaaaatcgcccgcgccgccaccaaacgtagcggcaccatcgcttttagcggcgcgtatcacgggcgcacgcattacacgctggcgctgaccggcaaggtgaatccgtactctgcgggcatggggctgatgccgggtcatgtttatcgcgcgctttatccttgcccgctgcacggcataagcgaggatgacgctatcgccagcatccaccggatcttcaaaaatgatgccgcgccggaagatatcgccgccatcgtgattgagccggttcagggcgaaggcggtttctacgcctcgtcgccagcctttatgcagcgtttacgcgctctgtgtgacgagcacgggatcatgctgattgccgatgaagtgcagagcggcgcggggcgtaccggcacgctgtttgcgatggagcagatgggcgttgcgccggatcttaccacctttgcgaaatcgatcgcgggcggcttcccgctggcgggcgtcaccgggcgcgcggaagtaatggatgccgtcgctccaggcggtctgggcggcacctatgcgggtaacccgattgcctgcgtggctgcgctggaagtgttgaaggtgtttgagcaggaaaatctgctgcaaaaagccaacgatctggggcagaagttgaaagacggattgctggcgatagccgaaaaacacccggagatcggcgacgtacgcgggctgggggcgatgatcgccattgagctgtttgaagacggcgatcacaacaagccggacgccaaactcaccgccgagatcgtggctcgcgcccgcgataaaggcctgattcttctctcctgcggcccgtattacaacgtgctgcgcatccttgtaccgctcaccattgaagacgctcagatccgtcagggtctggagatcatcagccagtgttttgatgaggcgaagcagtagcgccgctcctatgccggaggcgacgctgcgcgtcttgtccggcctacggctcgagacccagctttcttgtacaaagttggcattataagaaagcattgcttatcccccaaatacccagcaaattggagctctgcagagct

SEQ ID NO: 482 - DNA, 1561 bp, Desulfitobacterium hafniense
ttaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgagaaagaaagaatgcatcgccatgctgctggcgggagggcagggaagcaggctgggctgcctgactcgtaatattcctaaacctgccgtatcttttgccggcaaataccggattatcgattttagcctcagcaattgcagcaattccaatattgacacagtgggggttttgactcagtataagccctttgccttgaatacctacatcaatatgggttccgcttgggatctaaattgcttaaatggaggaatccatatccttcccccctttgtcggtgaagctcagggaagctggtacaaaggaactgccaacgccatctatcagaatatggattttatcaatttttacaacccggagtacatcctgatcctctccggtgatcacatctaccaaatggattattatgagatgctgtcctgccacaagcaaaagcatgcggaagtcactctctccgccattgctgtgccttgggaagaggcttcccgtttcggagttatggtgacggatgccgggggccggattatccggtttgaggaaaagcccccccgtccggaaagcaatttagcttccatgggcgtctatatctttaattgggatgtgcttaaggaagctctgctggaagacgagagggaccctcaatcggatcatgacttcggcaagaatgttctgccccggcttttgcagcaggggagacggctttactcttatctttttcatggctattggcgggatgtggggacgattgaaagctattacaatgccaatatggaagttctgcaggaagaaagggtggataagtttttcgagttgaagcagcgggttttctccaatgaagagattctcgctcctcaacaccttggtgagcgggcgaagatccacaatagtctcattggcaatgggtgcacgatcctgggagaggtccgcgactccgtcattgcctcaggagtctatgtgggggaagggagccttattgaacagtccatcttgctgcccaattcagaaatctatgaggatgtccgcctgcacaagaccatcctcggggagaatgccattgtccgggctcattgccggatcggtgataaaagggaaggaaatccgccccaggaaggcatcaccgtgattggcgaccatttacacatcccagagggcaccgtcattagcgaaggggaaaatgtgaggaaagacaccgcttgactcgagacccagctttcttgtacaaagttggcattataagaaagcattgcttatcccccaaatacccagcaaattggagctc

SEQ ID NO: 483 - DNA, 1832 bp, Bacillus halodurans
ttctggtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaagcgatctatacgcgtcagtttcttgccggagaatggattgaaggggctagtactcaaacgatcaccaactataatccgtatacaggagagaaaatacatgaaatcaaaggagctagtctggacgatttagatcaagcataccgcgccgcgaagaatgcgcaaaaagaatgggagcagacgctaccagcacaaaagcaagaggttcttgaaaaagcagcggctctacttgctgaacggaaagatgaagtgatcgaacggctcgtcaatgaagcaggcagttcaatcatcaaagcgagcattgagtggggggctactttgcaaacgataaaagtcgcggccaccttccctttgcgcatggagggaaaaattctcccatctaatatccctggaaaggaaaaccgcatttatcgatcagccaaaggggtcatcggtgtgattagcccttttaacttccccctcgtcttagcgatgcgttctgtagcacctgcacttgcaactgggaatgcggttgtacttaaatgttcgtctgatgcgccgatcacgtcaggtcttctcattgcagagctttttgaagaagccggtttaccgaaaggagttcttaacgtcgtagtcggaaaagcggctgagattggagatgctttcgttacgcatcctatcccaaaattaatctcgtttaccgggtcaacggaagtggggcgacacattgctcaattagcggctcgtgagttaaaggagacggctctagagcttggaggtaacaacgtgatgatcgtccttgatgatgctgatattgaaaaagcagcagaaaaggcagctgtcgggaaatttttacatcaggggcaaatatgtatggctttaaatcggatcatcgtagatgcgagtatttacgattcttttgttgaagtgtttaaagaaaaagtgagccagctacaaacaggaaacccagcagagcctgccacattgattgggcctctcattaattataagcaaatcggccgtatccaacagctagtcaaggaaagtgttgcccaaggagcggtaaaagtattggaaggacatgttcaaggtaatctaatgagccctacgattttatcagaagtgacaaacgatatgccagtggcaaaagaggaaatcttcggccctatcgctccaatcattaaagcgaaggacgaagcggaagcgatagcgattgccaacgattccccatatggcttaagcggctctatattcacaggctctcttcatcgaggtgttcaagtggcaaaacaaattgatactggcatgattcatgtcaacgaccagcctgttaatgaggaggcccatatttcatttggcggggaaaaagattctgggatcggacgttttggcggggaatgggtgttagataaattcacaactgttaagtggattagcattcaagagaaggagcgagtatacccgttttggggataactcgagacccagctttcaaatacccagcaaattggagctctgcagagctttcgttcgtatcatcggtttcgacaacgt

SEQ ID NO: 484 - DNA, 1885 bp, Xenorhabdus nematophila
actctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggtatcgtaggacattttattaacggcaaggttactgatatccattcacgcttacaggatatttataatcctgccactggcgaagtcagccgtcaggttgctattgcctccaaggctaccgctgaagaagcgattgcggcagcacaagcggctttccctgaatggcgtgatactccgccaataaagcgggcacgtattatgttccgttataagcaactgctggaagagcatgctgatgaaatttgtcgtttgattggtcaggagcatggcaagattattcatgatgcagcaggtgaactccaacgtggtatcgaaaatgttgagtatgcctgtggagcacctgaaatcttgaagggagagtttagtaaaaacgtagggccgggaatcaactcctggagcgacttccagccattgggtgttgttgcagggattaccccatttaacttcccggcgatggttcctctgtggatgtaccctctcgcactggtttgcggtaatacctttgtactgaaaccctcagaacgtgatccaagtgctcccctgtatattggccagttattaaaaaaagcggggctacccgatggtgtatttaacatcgtcaatggtgacaaagaagtggtggatacactactaactgacaaacgggtaaaagcagtcagttttgtgggatcaactcccgtcgcgcggtatatctacacgaccgctacagccaacggcaaacgttgccaagcacttggcggggctaaaaaccacgctatcgtcatgccagatgccgatatggagaatgtagtaaactcactcttaggggctgcatttggttcatcaggtgagcgttgtatggcactgtctgttgcagtggcaatcggtgatgaaattgctgatcagttggtcactcagctgcaagaacgcatgaagtccctgaccattggggttcatagtgataaaaataatgattttggccccgtcattacccgcgagcatcagcaaaaagtatgcggttatattacaagtgctgaacagcaaggcgccaaaattttggttgatggtcgtaacatgaaagtttctggttatgaaaatggcttctttgtcggtgccacattgattgatgatgtcactacagatatggatagctataaagcagaaatctttggccccgttttacaagtcgttcgcgttaaaaccatgcaggaagcgatggatattatcgatgaacacgaatatggcaacggcacttgtatctatacgcgtgatggagaggcagctaactattttgccgatcgtattcaggttggtatggttgggatcaatatcccgctgcccgtccctgtttcttaccatagctttggcggctggaaaaactcattgtttggtgatctctacgcctatggtcctgatggtgtgcggttctatactcgtcgtaaaactatcacgcaacgctggccatccgctaacctgcgtgaaggcgcagagttctcaatgccaacataaaattttcctacaataccctgttaactcgagacccagctttcaaatacccagcaaattggagctctgcagagctttcgttcgtatcatcg

SEQ ID NO: 485 - DNA, 1774 bp, Arabidopsis thaliana
ttaattaacgatacgtccctataaattagcaatgtcgctggttcgaacagtgacgatcgttctttttataatcgcgtttctgcaaaacgctgcggctcagaaaagacagcaaagtattgttaagtctcgcggtgcggttgcgacagatgatggacggtgttctgttatcgggatgcgtgttcttcgtgaaggaggaaacgcgattgatgcgtctgtggctgctgctctgtgtttgggcgttgtaagtcccgcgtctagcggtataggcggtggagcgtttacagtggttaagatagctggtgggaaagaaattgcttatgattctagagaaaccgctcctctaagagccactgagaatatgtatggaggtaatgttgacctaaagaagaaaggagccttatcagtaggcgttcccggggaagttgcaggtctattcacggcttggaaacaacatgggaagctaccgtggaagcggttagtgactcctgcagagaaacttgcagagggattcaagatttccaagtatctttatatgcagatgaacgcgactagaagcgatatcttagcagacaaaggtctctctgacctatttgtttcaaatggagagctcaagaaaccagggacgatttgccataacccaaaattggctttaaccttgaagctaattggagagtacggtccaaaagcattttacaatggcacagttggggttaacctagcgagagatatcaaaaaatctggaggaataataactttgaaagatctgcaaagttatagagttaagattaaagaaccgttgtctgcagacattcttggatatagagtccttggtatgcctcctccttcatctggtggcgctgcaatgatgcttgttttgaacattctttctcaatatgggattccatcaggtgtttcaggccctctcggtgttcatcgactaatcgaggctctgaaacatgcattcgcagttagaatgaacctcggggatccagatttcactgatgttaccaaggttgtttcggatatgttgtcgccaaagtttgcaaaagacttgaagagcaagataaacgaccaaaaaacctttgatccaaaatattacgggggcatgtggaatcagatcgacgaccacgggacaagtcatttatcgatcatagaccgcgagaggaacgctgtgtctatgactagtacaataaatggttactttggggcattgatgctatctccgagcacaggaatagttctgaacaacgaaatggacgatttctcaatccctacgaaatctaacggtaacttagatgttccaccaccagcaccagctaacttcatccgtcctggaaaacgacctttgtcctctatgtcacccaccattgtactcaaggacggtaaagtgaaagccgctgtgggtgcgagcggaggagccaacattattgccgggacaacggaagtttacttgaatcattttttcctcaagatggatcctctttcttccgtcttagctccaagaatctaccatcagctgataccaaacagagcttcgtacgagaactggacaacagtattcaatgatcatttcgagattcctaaagcaacaagagttgtgttggagaagaaaggtcatgtcctatctcctattgccggagggacgattgctcagttcatagttcaagaatccggtgagaactccggtggaagaagtgagcttgtggcagttagtgatcctcgaaaaggagggttcccttcaggatattgagaattttagatcgagatttatttg

SEQ ID NO: 486 - DNA, 1813 bp, Sinorhizobium meliloti
tcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctgagaattacgacgttatcgttgtcggttcgggtccgggcggatacgtgaccgccattcgttcggcgcagctgggcttgaagacggcgatcgtcgagcgggagcatctgggcgggatctgcctcaactggggctgcattccgaccaaggcgctgctgcgctccgccgaaattctcgaccatgccaaccatgccaagaactacggcctgaccctcgaaggcaagatcaccgccaacgtcaaggatgtcgttgcccgctcgcgcggcgtctccgcgcggctgaacggcggcgtcgccttcctgatgaagaagaacaaggtggacgtgatctggggtgaggcgaagctcaccaaacccggcgagatcgtcgtcggcgcgccgtccaagccagccgtccagccgcagaacccggttccgaagggcgtcaagggagagggtacctatacggccaaacacatcatcgtcgcaaccggcgcgcgcccgcgcgcgctccccggcatcgagccggacggcaagctgatctggacctatttcgaggcgatgaagccggaggaattcccgaagtcgctgctcgtcatgggctccggcgcgatcggcatcgaattcgcgagcttctaccgctcgatgggcgtcgacgtgaccgtcgtcgaactgctgccgcagatcatgccggtcgaggatgcggaaatttccgccttcgcccgtaagcagctcgaaaagcgcggcctgaagatcatcaccgatgccaaggtgacgaaggtcgagaagggcgcgaacgacgtcacggcgcatgtggagacgaaggacggcaaggtcacgccgatcaaggcggaccgtctgatctccgccgtcggcgttcagggcaacatcgagaacctcggcctcgaggctctcggcgtgaagaccgaccgcggctgcatcgtcaccgatggctacggaaagaccaatgtcgcgggcatctatgcgatcggcgacgtcgccggcccgccgatgctggcgcacaaggccgagcatgagggcgtcatctgcgtcgagaagattgccggggttcccggcgtgcacgcgctcgacaagggcaagatcccgggctgcacctattgcgacccgcaggtcgcctccgtgggcctcacggaagcgaaggccaaggaactcggccgcgacatccgcgtcggccgatacagcttcggcgcaaacggcaaggcgatcgcgctcggcgaagaccagggcctgatcaagaccatcttcgacaagaagaccggcgaactgatcggcgcgcacatggtaggggccgaagtgacggaactcatccagggcttcgtcgtcgccatgaacctggagacgaccgaagaggaactgatgcacacggtgttcccgcacccgaccctttcggagatgatgaaggaaagcgtgctcgatgcctacggcagagtattgaacgcctgaatttaaatacccagcaaatacccagcaaattggagctctgcagagctttcg

SEQ ID NO: 487 - DNA, 1741 bp, Xenorhabdus nematophila
tttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggtaaacattacgattatattgcaattggtggtggcagtggtggtattgcctccatgaaccgtgctgccatgtatgggcagaaatgcgccctgattgaagcgaaagcgctgggcggaacatgtgtgaatgtgggctgtgtaccaaagaaagtgatgtggcatgccgcccagattgcggaatctattcatcaatatggtcctgattatggttttgataccacggtaaatcgttttgactggaagacattgattgccagtcgtactgcctacattgatcgtactcatcagtcttatgagcgtgtgctgggcaataataaggtcgatgttattcatggatttgcccgttttgttgatgcacatacagtcgaggtcaatggagaaaaaatcaccgctaaccatatcctgattgctacgggtgggcgtccggtgtgtcctacgattccgggagcggaatatggtattgattctgatggtttctttgaactggatgaaatgccaaagcgtgttgctgtggtaggtgcaggttacatcgctgtggaaattgctggtgttttgaaggcgctgggcagtgaaacgcatctgtttgtgcgcaaacatgcgccgctgcgttctttcgatccgctgattgtcgagaccttgctggaagttatcaagaatgaagggccgacactgcatacggaagcgatattaaaagccgtgattaaacatgctgatggcagcctgacgttgcaattgcaggatggcagagagcagacggttgatacgttgatctgggcgattggtcgcgagccgatgaccgataatctgaatctggccgtcactggtgttgagttgaatgagaaaggttatattcaagtcgataaatatcagaataccaatgtcaaaggtgtgtatgcggtaggcgataacacgggcgcagtggaattgacgccggtggcaattgcggcaggtcgtcgtctatcggaacgtctgtttaataacaagccggaagagcatctggattacaccaatgtgccaacggtggtattcagccacccgccaatcggtacggtaggtctgacggagccgcaggcaagggaacagtatggtgatgatcaggttaaggtttatacttcgtcatttactgcgatgtatactgccgtgacgcaacatcgtcagccatgccggatgaaattggtttgtacgggagcggatgagaagattgtcggtattcatggtatcggctttggtatggatgaaatcctgcaaggttttgcggttgcgctgaaaatgggcgcgacgaagaaggattttgataataccgtggcgatccacccgacggcagcagaagaatttgtgacaatgagataaatttaaatacccagcaaatacccagcaaattggagctctgcagagctttcgttcgtatcatcgg

SEQ ID NO: 488 - DNA, 1826 bp, Nostoc punctiforme PCC 73102
tcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaaacagcagatgtaattgtgattggaagcggtcagggcggaattccacttgcagctgactttgcatcatcaggtcgaaacgtcgttctatttgagcgtgatgcgttgggcggcagttgcataaactatggctgtactccttctaaagcctttttagcctctgcccatgccgcaggtcgcgcaaggcaagcgacaaagttaggcatacacgcgcaggtcgaggtcgatttttctgcggtgatggagcgtgtgcgtagtattcgcagccagtttaaccagggtgtcaaacggcgactagacagtgcaggggttcgagtcgtctgcgctgaagctgctttcaccggagagcgaactgtgagtggaggaggtgtgactgtgcaggctccgctcatcgtcatcaatacagggacatcctccaccattcctgacttttcgggtttagttggaacgccttatctgaccaaccgaaatttctttgatttgcagcagattccgccccgcttgctggtggttggcggtggctatattgccttggagctagggcagggaatggcacgtttagggagccaaaccgaattgattgtgcggggtgaacggctgctggctcaagaagaatccgatgtcagtgctgtgcttgctgatgcttttgagcaagacggaattggactgcatttcaatgtgacggttcagcaggttgcttataccaatcgtgtgtttaccctaacgctgaacaatggtgaagtactagatggagaagcattgctgattgcgactgggcgcaaaccaaatactcaggcattaaattctgcggtgacaggtgttgaattagatgcacagggttttattaaaatcgacgagcaatttcaaacaacttgcgctgggatttatgcgatcggagacgctgccaaacagcctgcttttacgcatgtttcttgggaagactatcgtcgcttgaaagctattctgtgtggcgaacaccggacacgcaacgatcgggtattaggctatgccgtctacacagagccacaagtgggtcgagtgggtatgacgttagagcaggctcacaaacagggcattactgcgagcgaagtcaccctgccaatggctcacattgcccgtagcattgagtgggggcacgatctgggtttctaccgcatggtcatcgacacccagacgaatttgattttaggagcaacgctggttggttacgaaacggctgaactggtgcatgtctttttgtcacttatggaagctaaagcaacgtggcaggtacttgaacaatcggttcacattcacccaacatacggtgaggcattgcccagtctcgcaaggctactcgttggagatgatatgccaacctgtccgaacatgtaacaaagcagcaaccaataactactaacttaaagatgggcgatcgatttaaatacccagcaaatacccagcaaattggagctctgcagagctttcgttcgtatcatcggtttcgacaacgttcg

SEQ ID NO: 489 - DNA, 928 bp, Synechocystis sp.
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgattatacagcccatttacttaccccatctcctcaaacagccccgctgtacccaggtcctggccattgatcaggcgatcgccgacttgaagaccctaacgccggtgcgcggggaagtgtctgtgcgccatgggggaacctttttggaagtgaaagccgaagcggaaaccattgttaccctccactgtgaccgttgtgcccaaagctataaccaacggctagcattagataccaaggaaatactctggttggataaccaaggggaaaatacgatcccagtcttggaacgggaactaagttgggatgacttgtcggaagtgttgccccccgatggtcactttgatgtggaaacctggttatatgagcaatttaatttagctctgcccctgaaaaacttatgtggtaaagattgccaagctccccaggtgccggatgatggcacaggcaatggctttgatcgtcgttgggccgccctggcagatttgaaacagcaatggaattaaaatcaaccaacattgggatattcatccagcagttgttgagagtatttaaatacccagcaaatacccagcaaattggagctctgcagagctttcgttcgtatcatcggtttcgacaacg

SEQ ID NO: 490 - DNA, 2050 bp, Synechocystis sp.
tcaaatattattcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacattaatttcgttaactccccatcatggcatagatcccggtagtggccgaaaaaacacccccatgggactactcgaaacccaagttcaccacctgctcaaagcccaacagcgccaacaaaccattcccccctggccccattcgttaaccatgggtcgtttggtatcccgggccctgcgactacggcgatcggccttgattcaaactggttgtttgccccccacctacggccccagttatctattgccctgtttacttagtgatcagcccattcgcctggtcaccacccccaaacgtaagcaagatttggaaacggctattttgcccgctttgcaaatggccctacaaagtaatgatcccgatttggtcatcacctggccggaaattgttacgcctgaccaatggctacaagagaatttagggccattgccccatattgcccccgccttaacggcgatcgagcaggtagaacatttagaagattggaccagggattttctttcccatcacctagattggaacaccctccaacccctttttgcccaaactccccagggccaagaccaagttctaacccattggagccgcctcagtcagtccctctttgcccgccccatcaacccccatggtttttatcccttggatggagaagaattaaaggagttaaatcaggcggtaacggaacagttgacgattagtcagggtgaaaatgccattaagcaagaaaatattcagaaaattcagcagttttggcagttttggcaagaacaaaccgataaccatctcctctgggccgaagtggaccgacagcagggcagaatcagtctccacgtcagtccggtcaatgtacagccctggctacagccgatttggcaaagctccgatcaaggtcagggagattttattgatggaggccaagacagcgatcaagccgcctttgtcctcatcggcagttttttagacgctgagaaaaccgcccccacctattgcaaaactttgggtttgggaaatttactctgcttaaagttttctccccaccgtctccaggatgcgttaaccatttacctccccgatcgcctacccttacccaataccccagccttccaaaccactttgctaacggaaatcgaacgcattttgacagaaatcatggcggtgcaaccggacacctttgtggtgattttgcttgacgatttaccgctcaaagcccaattaggcagtcaactagcggccaaattaggctctggagtgaaagtggaaccgacccccaactttgctcctggtattttggtggcgggctggcaatattggtgtgctcaaagagaaaagtttcccccgccggccctgctaattctgggcactttgcccattccttccctggaaaatcccctggtggccaaacgagtacaacaccacaaacgccaccatcaagactggttccgggactatttactaccagtggcattgaaagatttacagcaggcagtgttacccctacgagagtccggcggttggttagctatcttggatgaccgggtcaattcccgcagttacggccgggaagtgctcaaagccctagcgccctacggcaaaaggaattattttgatccccaggatttgccccaggtgacaacagctcagaagtgaatttaaatacccagcaaatacccagcaaattggagctctgcagagctttcgttcgtatcatc

SEQ ID NO: 491 - DNA, 1866 bp, Synechocystis sp.
tattcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaaatccccccaggctcaacaaatcctagaccaggcccgccgtttgctctacgaaaaagccatggtcaaaatcaatgggcaatacgtggggacggtggcggccattccccaatcggatcaccatgatttgaactatacggaagttttcattcgggacaatgtgccggtgatgatcttcttgttactgcaaaatgaaacggaaattgtccaaaactttttggaaatttgcctcaccctccaaagtaagggctttcccacctacggcatttttcccactagttttgtggaaacggaaaaccatgaactcaaggcagactatggccaacgggcgatcggtcgagtttgctcggtggatgcgtccctctggtggcctattttggcctattactacgtgcaaagaaccggcaatgaagcctgggctagacaaacccatgtgcaattggggctacaaaagtttttaaacctcattctccatccagtctttcgggatgcacccactttgtttgtgcccgacggggcctttatgattgaccgccccatggatgtgtggggagcgccgttggaaatccaaaccctgctctacggagccctgaaaagtgcggcggggttactgttaatcgacctcaaggcgaagggttattgcagcaataaagaccatccttttgacagcttcacgatggagcagagtcatcaatttaacctgagtgtggattggctcaaaaaactccgcacctatctgctcaagcattattggattaattgcaatattgtccaagctctccgccgccgtcccacggaacagtacggtgaagaagccagcaacgaacataatgtccacacagaaaccattcccaactggctccaggattggctcggcgatcggggaggctatttaatcggcaatatccgcacgggtcgccccgattttcgctttttctccctgggtaattgcttgggggcaattttcgatgtcactagcttggcccagcaacgttcctttttccgtttggtattaaataatcagcgggagttatgtgcccaaatgcccctgaggatttgccatccccccctcaaagatgacgattggcgcagtaaaaccggctttgaccgcaaaaatttaccctggtgctaccacaacgccggccattggccctgtttattttggtttctggtggtggcggtgctccgccatagctgccattccaactacggcacggtggagtatgcggaaatggggaacctaattcgcaataactatgaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaatttaaatacccagcaaatacccagcaaattggagctctgcagagctttcgttcgtatcatcggtt

SEQ ID NO: 492 - DNA, 1678 bp, Agrobacterium tumefaciens
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcggaatttgttatcacgatgcccgatgtcggtgaaggcgtggcggaagccgagctggtggaatggaacgtcaagccgggcgatatcgtccatgaggacatggtgctggccgctgtcatgacggacaaggcgacggtggaaatcccctcgccggtggcggggatcatcacatggctcgccgtgactgtcggaaacacggtgccagtgaaagcaccgctcgtccgtatcgaaaccgatgtcgctgccgctgcacccaatggcagcgcgccggaggcggaggcgccaagccggatgacggaagaggaagcgcctgccgacatgacggaagcgccgccaccagtcgaaacccagccggcggctcgccagaccgaggaggcgccgtctgcgcccgtagccgagccgcatcataaaccgctggcatcccccgccgtccgccagcgtgccgacgatctcgatatcgatctcatcaaggtcaagggaacggggcccgacgggcatatcacccatgccgatctcgatgggtttttaacggtacgggcacggccggaacgtcccgagccgatgacgccgcacgatagcgcggtcgaggaagtgaaggtaacagggctgcggcgcaagattgccgagaagatggtgctctccgtctcgcgcattccccacatcacctatgtcgaggaaatcgacgtgacggagttggaggatttgcgcgcgacgatgaacggtaaccgtcgttccgggcagccgaaactgacgatcctgccgtttctgatgcgtgcgcttgtgaaagccgtagcggatcatcccggcatgaacgcgattttcgatgacgaaaaaggcgtcgtcagtcattacgaagcggtccatatcggcattgctacgcagacgcccgcgggcctgactgttccggtcgttcgccacgcggaaacgctcggcctctgggactgtgcggaagaagtcgcgcgcgtcgcggaagccgcccgcaccggcacggcgcatcgggaagagctgatgggttccaccattaccatcagttcgcttggagccttgggcggtgtggtttcgacgcccatcatcaatcatccggaggtggcgatcatcggcgtcaacaagatcatgacgcggccggtctgggacgggaaccggtttgtgccgcgcaagatgatgaacctgtcttcgagtttcgaccatcgtgtggtcgatggctgggatgccgcggtcttcattcaggccgtcaaagcgctgttggaaaagccggcactgattttcatcgagtgaggggccgtttttgatcggtgcgttttacgccctcatccctgtatttaaatacccagcaaatacccagcaaattggagctctgcagagctttcgttcgtatcatc

SEQ ID NO: 493 - DNA, 1752 bp, Escherichia coli K12
aaccgttaattaatcaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaatgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaaatttaaatacccagcaaatacccagcaaattggagctctgcaga

SEQ ID NO: 494 - DNA, 1046 bp, Xenorhabdus nematophila
tttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggagaaagattttctgattgccccatccattctatccgcagattttgcccgattaggtgaagataccgcaaaggttctggcagcaggcgctgatgttgtccactttgacgttatggataatcactatgtgccaaacctgaccattgggccaatggtctgccaggcgctgcgtgattatggcattacggcaccgatagacgttcatctgatggtaaaacctgtagatcgtattatccctgattttgccaaggcaggtgcaacctacatcactttccatcccgaagcgagcgagcatgttgaccgtaccctgcaactgatcaaagaacatggctgtaaggcaggtctagttttcaacccagcaacccctctcagttaccttgattatgtgctggataagctggacgtaattctgctgatgtccgttaacccgggtttcagtggccagtccttcattccagaaaccctgaacaagttacggcaggtacgcaaaatcattgacgacagcggatacgatattcgtcttgaagttgatggtggcatcaaggccaataatattagagaagccgctcaggcgggcgcagatatgtttgttgctggttctgctattttcagccagcctgactataaaacggtcattgatgagatgcgccgtgaattatcaaaggtggcataatggtaacaagtattaaatttaaatacccagcaaatacccagcaaattggagctctgcagagctttcgttcgtat

SEQ ID NO: 495 - DNA, 447 bp, Arabidopsis thaliana
atggcttccactgctctctcaagcgccatcgtcggaacttcattcatccgtcgttccccagctccaatcagtctccgttcccttccatcagccaacacacaatccctcttcggtctcaaatcaggcaccgctcgtggtggacgtgtcacagccatggctacatacaaggtcaagttcatcacaccagaaggtgagctagaggttgagtgtgacgacgacgtctacgttcttgatgctgctgaggaagctggaatcgatttgccttactcttgccgtgctggttcttgttcgagctgtgctggtaaagttgtgtctggatctgttgatcagtctgaccagagtttccttgatgatgaacagattggtgaagggtttgttctcacttgtgctgcttaccctacctctgatgttaccattgaaacccacaaagaagaagacattgtttaa

SEQ ID NO: 496 - DNA, 2104 bp, Bacillus subtilis subsp. subtilis str. 168
tttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggaaaaactaaaattgtttgtaccatcggtccggcaagtgaaagtattgaaatgcttacgaaattaatggagtcaggaatgaacgtggctcgattaaacttttctcacggagattttgaggagcacggtgcaagaattaaaaatatccgcgaagcaagtaaaaaacttggcaagaacgttggaattctgcttgatacaaaaggtcctgaaatccgcacacatacaatggaaaacggcggtattgagcttgaaacaggcaaagagctcattatttcaatggacgaggttgtaggaacaacagataaaatttcagtgacatatgaaggtttagtccatgacgttgaacaaggttcaacgattctgttagatgacggccttatcggtcttgaggtacttgatgtagatgccgctaaacgcgaaatcaaaacaaaagtattaaacaacggaacactcaaaaataaaaaaggtgttaacgtaccgggcgtaagtgtcaatcttccggggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctttctggtgaaactgctgccggaagttacccggttgaagcagttcaaacaatgcataacatcgcgtcccgttctgaagaagcattaaattataaagaaattctctcaaaacgcagagaccaagtgggcatgacaattacagacgcaattggacaatctgtcgcacatacggcgattaacctgaatgctgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagctggcactgtcggtgagtccggcactacgaacttaatgaaggttcatactgtcggcgatatcatcgctaaaggccaaggcattggacgcaaatcagcttacggtccggttgtcgttgcacaaaatgcaaaagaagctgagcaaaaaatgactgacggtgcagtacttgttaccaaaagcactgaccgtgatatgattgcatcccttgaaaaagcgtctgctcttattacagaagaaggcggtttgactagccatgctgcggtagtcggattaagccttggcatcccggttatcgtgggtctggaaaatgcgacatctattttgacagatggccaggatattacagttgacgcttccagaggcgcagtctatcaaggccgtgcgagcgttctttaatcgagacccagctttcaaatacccagcaaattggagctctgcaga

SEQ ID NO: 497 - DNA, 1432 bp, Rhodopseudomonas palustris
cttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggatcagggccaaacgctctcagttcttttggattcgtatgcggtcgatccgcagaaaaaagctgtcgccgccgcggtcggcgcgatcgccgcgggatcgatcgaaatctctgaactgatcgggcagggggctctcgccggcatcaccggcgccgcgcacggtggcagcaatgccgatggcgacgtgcagaaggatctcgacgtcaaggccgagcagatcatcgtcaagtcgctgaaggatgtgccgtacgccgcgctggcgtcggaagaatccgacaccctgctcgacggcgatccgaacgcgccgatttcgatcgcctacgatccgctcgacggctcgtccaacatcgacaccaacatgacggtggggacgatcttctcgatcatcccgaaccagccgggcgtgaagccgttcactgcggccggctcctgccagattgcggcgggcttcgtggtgtatgggccgcagacctcgctggtgctgacgctcggtgacggcgtcaacatcttcacgctcgaccgcaaggccaaggtttaccggctgatccgcgagcgcgtgaaggtgccggccgacaccgccgaatacgccgtcaacgcctccaaccatcgccattgggagcaaccgatccgcgacttcgtcgacgagtgcatcgccggcgccgacggcccgcgcgccaaggatttcaatatgcgctggatcggctctctggtggccgaggtgtatcggatcctcacccgtggcggcgtgttcctgtaccccggcgacaaccgcccgggctacggcaacggccggctgcggctgctctacgaaacccatccgatgtcgttcgtgatggagcaggccggtggcgccgcttcgaccgggcgcgagcgggtgctcgatctcaccgccaagacgatccaccagcggtcgccgctgatcatggggtcgatcgacaaggtcaagcgcatcgaactgctgcacaccgatccgagtgcggcctcgcgttcggcgccgctgttcgcccgccgcggcctgttccgcgtctgacgtcgtctctcccggttggaattggaagtaactcctcatgtctcgagacccagctttcaaatacccagcaaattggagctctgcagagctttcgttcgtatcatcg

SEQ ID NO: 498 - DNA, 1420 bp, Sinorhizobium meliloti
ttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgagcgaaagactggaagacattgcggttgccatggtcgccaatggccggggcctgctcgctgcagacgagtcgaccgcaacgatcaagaagcgcttcgacagcatcggcctggagtccaccgagacgtcgcgccgcgactatcgcgagatgctgctgcgctcggacgatgcgatgcgcgagtatatctccggcgtcatcctctatgaggaaacactgttccagaaggctgccgacggcacgcccctcgccgacgtcatccgcaacgcgggctcgatcccggggatcaaggtcgacaccggtgccaagccgatggcccatttcccgaatgaaacgataaccgaaggcctcgacgggctcgccgcccgcctcgccagatatcacgaggccggcgcccgcttcgccaaatggcggggcgtgatcgcgatttccgacgctctcccgacctggggcgcgatcagggccaatgcccatgcgctcgcccgttatgccgcgctctgccaggaggcgaagatcgtaccgatcgtggagccggaagtgctgatggatggcgcccccggcgatcactcgatcgagcgctcggaagaagtcaccgaatgggtcctgcgcacagtcttcgaggaacttggcgagctccgcgtcaggctcgaaggcatgatcctgaagccgagcatggtgatcgacggcaaaaaagcgcgcaaagcgtccgtcgacgaggtcgccgaacgcaccatcaaggtgctgaagcgcaccgttccggcggctgttccgggcatcgccttcctctccggcggccaatcgaccgaagaggcgacggcccacctttcggccatgaacgcagcgcacgacctgccctggaagcttaccttctcctatggccgggcactgcagcaggaagcgctcaatgcctggggcggaaagtcggaaaacgtcgccgccggtcagcgcgccttcgcccatcgcgccaagatgtgcagcctcgccgccaagggaagctggacgaaggacttcgaaaaggcagcctaagcgccaaaatagtcagagggagagaggagaggcccggtctcgagaccagctttcaaatacccagcaaattggagctctgcagagctttcgttcgtatcatc

SEQ ID NO: 499 - DNA, 1850 bp, Xenorhabdus nematophila
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggtcagaacgtttatcaatttatcgacttacagcgtgtcgatcctccgaaaaagccgttgaaaatccgcaaaatagaatttgtggaaatttatgaacctttttctgaaatgcaggttgaggcacaggcagatcgctgcctttcatgtgggaatccctattgtgagtggaaatgccctgtgcacaactatattccgaactggctgaaactcgcgaatgaaggccggattattgaagcggcggaactctcccaccggacgaatagcctgccagaagtctgcggacgagtctgtccgcaagatcgcctgtgtgaaggtgcctgtacgctgaatgatgactttggtgctgttaccatcggcaatattgaacgttacattaacgacaccgccattgcgatgggctggaagccggatatgtcagacgtgatcccgacaggcaaacgtgtggcagtgattggagccggccctgcggggctggcctgtgcagatgtcctaacccgcaacggcgtacaagcggtagtttacgatcgccaccctgaaattggcggcttgctcacgtttggcattcctgctttcaaactggaaaaagacgtgatgatccgccgccgtgaaattttctccgacatgggcatcgaattccgcttaaacacggaaataggcaaagacattacgcttgctgaactcaccgagcaatttgatgctgtatttctgggcgtgggtacttatcagtctattcatggcggacttgaaaacgaaggtgctgacggagtctatgatgccctgcccttcttaattgccaatacccgtcatttaatgggctaccccgctttaccggaacaaccttatgttgatatgaaaggtcagcgtgttctggtactcggaggcggtgatacagcaatggattgcctgcgcacttctgttcgccaaggcgcaacccatgttatctgtgcttatcggcgggatgaaggcaatatgccaggttctcgtcgagaagtgaaaaatgccaaggaagaaggtgtggattttcagtttaaccttcagccgctcagtattgagatcaatagcgcaggtcaagtttgcggcgtcaaagtcgcgaaaacacaacttggcgaaatggatgaaaaaggccgccgtcgagctgaaatcattcagggctccgaatttcggatcgaaaccgatgctgttatcacggcgtttggtttcaaacctcacaacctgcactggctgaatgcgcatcagatcaatctcgatcagcagggacgtattgttgctcctgaagccagcaacctgcccttccaaaccagtaatcctaaaatattcgcaggcggggacgctgttcgtggttctgatttagtggttactgcgattgcggaaggtagaaaggcggcatccggtattctcgactatctcgaggtttaatccctattcactgtttcttcaattacttctccggtcttttgacctcgagacccagctttaaatacccagcaaattggagctctgcagagctttcgttcgtatcatcggtttcgacaacgttcgtc

SEQ ID NO: 500 - DNA, 1582 bp, Xenorhabdus nematophila
cttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtgatacaagagaatcctttctcatcccgcattgctaacagggcaaagaacattaatgcctcagtggcagtagggctggcagatatcgttgccaaattgaaaagtgaaggccgtgacattattgggttgaatgaaggtgagctggatttcagtactggcgccactattgttaatgaaacccttcgggcattgatagatggcagaactcgttatagctggctcaacggtgaacctgaattaagagagaagatctgccaaaaagtatttgaagataaccggattaaagcgacgcctgaaaatgtcatcgtgaccaatggctccaaacaagttatttatgaaatattacagacagtcattaaccccggcgatgaagtgattattcccgtaccctgttgggcgacatatcttgaagctgtcaaattagccggagggaaagcggttttaattgaaaatattggtgttgatttggatgttgaaaaaatcaaacaggctatcactgacaataccaaacttatcattatcaatacgccgaataatccgaccggagccgtttactcaaaatccgcattacagacactgtgccaaatcgtcaaagaaaaacaaatattcgtgttatctgatgaagcctatgaacaaattgtatttgatgatgaacatcatagcttggctgccattgatgacaatgaatacattattacggtgcaaacattttcaaaaagctttgccatgacgggctaccgtattggctatatgatagcccatcctgaattaatctgcagagtctctgacctgcatggtcatatgaccgataatgtctgcacttttgcccagtatggtgcgattgcctcacttgaaaagcccaaggatttgtatcaagaaaggttagagatactcaaaaaacgacgtgatcgatcataccaatatgcccgcgaatttttcgaatgtgagcttcctgctggcgcattttacctgttccccaatgttgaaaaatacctcaatgaccgttgtcgtgatgccactcaattctgtgaatatctgctcacccatgcaggggtagccctgatcccggcagaagcctgtctttatcgtggacatgtacgaatttcttttgctgcgtcaatggatgctattgagcagggatttgaacggatcgcaaacgtattgcggtaattgatgaccataaggattaacaataatgaaccaatcgatatattccattgactcgagacccagctttcaaatacccagcaaattggagctctgcagagctttcgttcgtatcatc

SEQ ID NO: 501 - DNA, 373 bp, Arabidopsis thaliana
ttaattaatggaagaaactctagccactcccgacgccacgagacgctctctgtcaccgtcatgctcagccaccgtgaaatcacgcgccgctggtttcgagcgcagaaccaaacggagattgtcagagactaacgcaagcgtacgtgaagaccgagaagaagcagaagaagaagaagatgaggtcaaggaaaagattgaggcgttgcagaggattatccccggaggagcggcgcttggtgtggacgcgctcttcgaagagacagctggttacattctgtctctacaatgtcagatcaaaaccattaaagtccttacttcgtttcttcaacgcatagatcaagaagacatgaagttcggaggttgaaggcgcgcc

SEQ ID NO: 502 - DNA, 1619 bp, Arabidopsis thaliana
ttaattaatcttcttcgacaacaatcttctgggtatctccagaatgagctatcttcttaggaggaacaagttcgtagctttactcaaaagacagagtctcatctttccgattacttccactgaagctaaaaccctgataaacccagatcctaatatccctcaatttcaaaacccttgttcgattttcaggattgctcactatgcaacccaatcttcaaagtttccagagtacgagatgcctacagtcacatggggagttatacaagggaagaaagagaagctcgtgaatcgcgtcaaaatctgcgactatctcaagggtttggggataatcaccgatgaattggagagtattgagctaccttccaccattgaagtcatgtgtgagcgtgttgagttcttacagaagctagggttaacgattgacgatataaatgagtatcctttgatgttaggttgtagtgtgcgtaagaatttgattcctgtcttggcttacttagagaaaattggaatctcgagatcgaaattaggagaatttgttaagaactatcctcaggttctacacgcaagtgtggttgttgagcttgctcctgtggttaagtttcttagaggactcgatgtggagaagcaagatttgggttatgtattgatgaagtatcctgagctgctagggtttaagcttgaaggcacgatgagcacatcggttgcgtatttggtgagcattggtgtgagtcctagggacattggtccaatggtaactcagtatccttatcttttgggaatgagagttggaaccatgatcaagcctttagtagattatctaatttccattggtttgccaaagaaaattgtggctaggatgctagagaaacgttcatatatagttggatacaatctcgaggagactgttaaaccaaacgtagattgcttgattagttttggcgtcaagaaagaactactacctttgcttatagctcaatatcctcaaattctcgggttaccagtgaaagccaagatgtctacacaacagtactttttcagcttgaagctcaagattgatcctgaaggatttgctcgtgtggtagagaaaatgccacagattgtaagtcttaagcagaatgtgataatgaaacccattgagtttctcttgggcagggcatttcaagttgaggacattgcgaaaatggttgtgagatgtcctcagatcctctgttcccgagtggaactcatgaagaatagttactacttttacaagaccgagatggggagaccgatgaaagaactcgtggagtaccctgagtactttacttatagcttggagtcaagaatcaaaccgaggtaccaaaaactacagagcaaaggaatcaggagttcattgaactggttcctcaattgcagtgaccaaagattcgaggaacgattacaaggtaacttcattgatccagatactgaaggtccaacgtttgacatgggtgggaagttagaaatgcctggtggcgagatagtgactgatgaggaagaagatgagagtgatgatgaagttctctacagacgcactcttactttgtagaataatcaaaagtcttttagcttaattgagcttttgcatttagcggcgcgcc

SEQ ID NO: 503 - DNA, 2718 bp, Arabidopsis thaliana
ttaattaattctttgggttagctgagaaatggatgtaatgaagcttgatcacgacagtgtattaaaagagcttgagaggatcacctcgaaagctgctgaagttcaagataacattttacgtgggatcttggaaagaaacaaggacacagagtacttgagtaagtacatgaatggctctaaggatgttctggagtttaaacgcgctgtgccaatcatcatatacaaagatatctatccgtacattcagagaattgctaatggagaagactcatctcttattactggccattctattactgaaatattatgcaggtctgtatctgtttcagtctgaatctttgttagtcgctgccttctctgtctctgtgcatgtctttctttagctgatgaaaatgtaatcgctttcttgcatttcgcagctctgggacttctgctggagagccaaagctaatgccaaccattcctgaagatcttgatcgccgcacttttctctacaatcttatcattccaatcgtgaacaagtcagtgaattcctcctttgattcctctaataattagttctcctagatgctgtttaaaatcctaagggcaagtcaggctctttttctactttctgaaatctttagagttaaaagagatatacgtcttgtgtgcacataagtatttacttaataagtgaccatcatgctcaaaacaaagaaaaatgggtgatctcatattccataaaagaaccactaggactgttcctctagttgtaggataatggatatgtctccaaagccaatctatggaaatggaaggacatcacatcaaattctgcaatgttatccattactattgaaaatcttgaaagaattatcaattttcttacctcagtgtgactatggtttcataatcattgtaccactaacatatggaaattagtacatacagtacctaacactcataagaggtactgtccgtggtagtgtggtaccaatatattcatcacaatgggtttcgcacttaggaagaaaatgaagtttgctttcttcttaaagtttttgttttttttggggacaattagtggtatcatgtcatgtactataaagtttgcttccatcatcttttatccacacgccaattttgatgtccccactaaagattctctaagaattttgaacatgcactcactaaacctaaagaatctttcatatccgttgaggttacctcttttaccatcttcttcttgctctgtttttaacctttttacaacaggtacataacaggacttgacaaaggaaaagcaatgtacctaaatttcgtaaaggctgaaacatcaactccttgtggtttaccaatcagagctgtcctcactagttactacaaaagcaagcatttccagtgcagaccttatgatccattcaacgacttaaccagtcctatccaaaccatcctttgtgaagacagcaaccaaagcatgtactgtcagttactagccggtctgattcaccgtcacaaggtgatgcgtttaggagcagtctttgcttcagcgtttctccgtgcaatctcttatctcgagaagaaatggagtcagctctgtgaagacatccgcaccggtagtctcaaccccatgatcaccgatccaggttgccaaatggcaatgtcttgtcttttaatgtcgccgaatccagagttagctagcgagatcgaagagatctgtgggcggtcgtcgtggaaagggattctgtgtcagctctggcctaaggcaaagttcatcgaagcagtagtgacgggctcaatggctcaatacatacctgcacttgagttttttagccaggggaagattccattggtttgtccaatgtatgcttcctctgagacttactttggagtcaacgtggaaccactctccaaaccatctgacgtcgttttcactctcttgcctaacatgtgctacttcgagtttatccctctcggcaaaaacgggacactctcttttgatctagacgacgatgaacaagtcccctgtgataaagtcgttgacttggtcaatgtcaaactcggccgctactatgaactggtcgtcacaactttcgcaggtatttaaagaaacgttcttttaattagtgttttggattggttgatgattgattcatgcgcaagcaggattgtaccgttaccgaatcggcgacgttcttcaagtggcgggtttctacaacggagcaccacagttccggtttatctgcaggagaaacgtggttctaagcatcgacttagacaaaaccaacgaagaagatctacacaggagcataacgttagccaagaagaagcttggaagcaacgcattcctggcggagtacacgagctacgcggacacgtcatcagtgccaggtcactacgtgctattctgggagatccaaggtcatctcgagccgaaactgatggaagagtgttgcgttgcggtggaggaagagctggactacatatacagacagtgcaggacgaaagagagatcgataggggcattagagatcagagtggtgaaaccaggaacgttcgagaaactgatggatctgattataagccaaggagggtcgtttaatcagtataaaacgccgagatgtgtcaagtccaacagtgcaacgttcaagctcttgaacggacacgtaatggcttctttctttagccctcgtgacccgacttgggttccatgatcccaagacttttaggcgcgcc

SEQ ID NO: 504 - DNA, 853 bp, Arabidopsis thaliana
ttaattaattcttggataaatggcagaagtccataatcaactagagatcaagtttcggttaaccgatggttcggatatcggtcctaaagcattccctgatgctacaactgtttcggctttgaaggaaactgttatttctgaatggccaagaggtcagtttttttttatgcttatttactcttatggctaataaattgtaatatccttaggcactgtgttttgagattgtaaaggcttgaatcttcttggaacaatggttttgctagttatgaaaatcatgtcccaatactatatcttatgcaaaagaaacttcacaaattttttgagtagatcaattcgcacaatgttactcaccatccgtagagttgtacctgttcctgtgattgcttacttgttctgttatcggtgagcctaacatgaacctgtgttcaactctttgtactgatcatactacttgtcattttgttctcttgtgtttgactaatgatagagaaggagaatgggccgaaaacagtgaaagaggtgaagttgataagcgcagggaaggtattggagaacagcaagacggttaaagactaccgaagtcctgtctctaatctcgcaggcgctgtcaccacaatgcacgttatcatccaagctccggttacggaaaaaggtaaaacattctttagattattctcttgttttcttagctccttcatattcaaagagacagcagcctctagtgtaggatcaaaatctgttgtggacctcctgacagagagatggtgttgtgtttgaaacagaaaagaagcctaaaggtgacccgaagatgaacaaatgcgtctgttcagtcatgtaagagaggcgcgcc

SEQ ID NO: 505 - DNA, 350 bp, Arabidopsis thaliana
ttaattaatggaatccaacagaggtcaaggttcgatccaacagttgcttgctgctgaggtagaagctcaacacattgtcaatgctgcaaggaccgcaaaaatggcaagactgaagcaagctaaggaagaggcagagaaagagattgccgaatacaaagctcaaacagagcaagacttccagaggaaacttgaggagacaagcggagactctggtgcgaatgtgaagaggctggagcaagagactgataccaaaatcgagcagttgaagaacgaagcatcgaggatttccaaagatgttgtcgaaatgcttctgaaacatgtgaccacagtgaagaactgagaggcgcgcc

SEQ ID NO: 506 - DNA, 455 bp, Arabidopsis thaliana
ttaattaagccttaaatggagacgcagaaaactcaagctgaaaacccgccaaaaccggccacgtcttcatgtcgaaagaagacaaaggatgatgccaatttcctagaagacgtcaaggatcacatcgatgatttcattaatgcttccatggatgatcacaagaactgtttcaacaaaaccatcaagaaggtttgtctttcttcatgatttactaaacacgtaatagatcttgatcactgagccactacttgtgattttgctaatagtaagttattttgcctttttcagatgtttgggttgtcaaaggctgttgcggataagcagcaaagtgaggctaaaggaggagtcgagagttatttgcctcttcagacaacagtctcagattagagaaactgatgatagaatcaagctaacaagatcttgtttcggtttactttttgttggtttggcgcgcc

SEQ ID NO: 507 - DNA, 329 bp, Arabidopsis thaliana
ttaattaatggttaatgcaatcaaaggagtgttcgtctcttggtacttcttaccgttgttacgattcctaagcaaatcttgatgaacacaattgaatcattcattgtttctttgtatcttttgtttgtttgcagcgatattccgatgacacaattcatagtgaacatgaacaattcgatgcctccgtctcagaaattcataattcatgtacttgatagtactcacttgttcgtgcaaccacatgtagagcagatgatccgcagcgccatttctgattttagagatcaaaactcttacgagaagcccacttcttagatcacaggcgcgcc

SEQ ID NO: 508 - DNA, 1569 bp, Arabidopsis thaliana
ttaattaagagttatgatgccgaaagctgcgtgggaaccagaataccacagagtatttgtggacttatgcgtcgagcaaaagatgttagggaatcaacctggaacgcagcatatattgaaaccttttctacaaagaactggcgctaggttcaccagaaaccagcttaagaatcactgggatacaatgatcaagcagtggaagatttggtgtagacttgttcaatgcagtgatatgcaatgggatcctcagactaacacttttggtgctaatgatcaagactgggccaactatttacatgtacaatttatcttctgtgttgattttggttgtttcttgagtctataataaaactcatgattggatttgtgacaggtgaatcctgaggctgggcagtatcggttgaatcctccatcgttcctcgagaaacttgagcttatctttgaagatagtaacttagatgatgaaggtacttcaggtagcaaaaggaagcgaatagccaagcatcgtgatgaagataatgataatactggagatgaagaagacacgcaaagcgcttctaatttctcgagtcctcagtcgaaaggatactggtcaccgtcttcacatgagctgtttgttgatttgttgttccaagaggctttaaaaggaaacagacctgactcacattatccaaaggaaacttggaaaatgatccttgagactatcaatcagaataccggtaaaagcttcaccagaccgcaactcaagaatcattgggattgcaccaggaaatcgtggaagatctggtgtcaagtgattggtgctcctgtcatgaaatgggatgcaacttctcgaacatttggtgctactgatgaagactggaaaaactacttgaaggtataaacgctactcgactttttatattagttgattaagtttgcagcttaacattggttctttgattaacaggagaatcatagagcagcaccattcagaaggaaacaacttcctcacgcggataaactagcaaccatcttcaaaggacttatagaaccaggaaaagcctatttccgttcttatcgcaggagagtgcttgatcatcattccgaatcaccacagctacatgacccaactccattatcaacactttacacaaacgagccagtctcaggtagtgaaggtggagctgatgaagatgacaatgatgacgatgatgagcagcctactccgcagcaccggagatttaacagtgttggttttgcagagtctcggttacaagatgttgaaattgtaactccgggatgccacaggttaaaaactgagctgatgaaggagagtccagtgagtgcatcggttaggcagtacgagtataccattggggaatgcattgagtgtttggactccatggaagaggttgagcaaggtagtgatctttacttgtttgcgttggatttgtttgtgaagaaagagtacagagagattttcttgctgttgaagaactcaagtttgagaatgtcttggctgcttagacttcgatctggtggccttaccattgctgcctaagatcgtcatattctcccaggcgcgcc

SEQ ID NO: 509 - DNA, 903 bp, Arabidopsis thaliana
ttaattaataatgggaatgagtctcgatttcgatgttgatcttgagaaaggaatcatagattgcgacaatgtttatacaaaatcaccggagaagccgatgtctcctgataacaaaccggtaataaccggagaagaaagtgttggttcgttagagaatgatacaagtccggttcaatgtggaatcaataaaccgggatgggggagaagcgatcggaaggagaaacggaagaaatctgcgtcgaagcctcctcgaccgccgcgtggaccgtcgctagacgcggcggatcagaaacttattagagagatcgctgaattggcgatgttgaaacgcgcgagaatcgaacgtatgagagctttgaagaaatcaagagcggctaaagctgcgtctgccgcttcttctttaggcaatgtattggccactcttttcaccgctattttcttctttgtcctcgttttccaaggtatgatttgattccacgattgcgtttgcgttttggtgattttaccagttttggttaaatcttatgtgtgtgtgttttattggattttttcaggattgtcaccgagagcagccggtagctccgggaaatctcacttagtagtcgccggcaaagccaatggtggttttgtttcggttcaatatgcgggaaatccgtcggcgagcgaaccggatggaggttataccggaccagttttagcacagagaccaaagtaagttgcttcactatctaatttcactaactggcgtaactgcttatctgaattaatctctaatccggtttgttgtacttacagtttactaaaaccggtgtccggtttggagaatgaaaagaagagttcacagtgaaagcgtaacgaaatggttaagaattggacagttccatactggtttgctggcgcgcc

SEQ ID NO: 510 - DNA, 2112 bp, Arabidopsis thaliana
cgcgaactcagaaaaatcaaatctttctctctctctctctcgttgaaaacccatttctgtattgtgttgaagctacgttactactaagaagaagtgaagcaaaaacagaggtttttgaaaatggagaaaaaacaaggctttttctctgctctcagacacgaagttgtgagaggtctttcgccgtcacgatccagagcaaggtctcgttccgttagtcccgctaggtctagttcacccatgtcagctctcacttggggaagaaagaacttaactggaggaggcggtggtggtggtggcggaggttactatttagcgcaaccagagcagttaattgggagatccggaagtttgagacctgtaatggaaggtcctgatccagatgaaggaggaggaggtggtaatataggagaatctaaacgactcgggtcgggtttaggtcactgggttaaagggcagctgtctcgtgctccgtctgttgctgcgacggcggcttatcggagaaatgatctgagacttcttcttggtgtaatgggagctcctcttgctcctattcatgtctcttcctctgatcctttgcctcatcttagtatcaaaaacactccaatcgttagtctcactctctcctccttcttcttccttgtaaagttcagatttttcatcattttccttcagatttgcaagttcatgactttgaaatcttttttagtggtggttggttttattaatcgaattttctttacttgagaatgtttttcattggtcgttggttggtggaaattgatgtcatattctttggtgggatttgatttttcttacaaaccattggagtattaaaccaaagttttgatttttcttctttggtttcttcttctgagccttatttgaacactttactgtttatcatttttactgaatcttctttgttcttactatttcttgcaggaaacatcatctgctcagtatattcttcaacagtacactgcagcttctggtggtcagaagctacaaaactccattaaaaacgcttatgcgatggggaagctcaagatgattacttcagagcttgaaactgctacaagaaccgttaggaatcgaaacccatctaaggctgagactggaggttttgttctttggcagatgaatccagacatgtggtatgttgagcttgctgttgggggtagtaaggttcgtgctggctgcaatggcaagcttgtatggagacacactccttggctcggatctcatactgctaaaggacctgtcagacctctccgccgtggacttcaggtaaaagtcttgactttttaggtgttttagtagttcgagagatcaaagagatccttaagtgttttttggatgattcagggactagatccgagaacaactgctgcaatgtttgcggaagcgaagtgtataggagagaagaaggtgaatggtgaagattgcttcattttgaagttatgcactgaccctgaaacactaaaagcgaggagcgaaggaccggctgagatcattaggcatgtcctctttggctacttcagtcagaaaacagggctcttggttcacattgaggattcacatttgacccggattcaatctaacggtggagagactgttttctgggagaccacatacaactcgtccctagacgattaccgtcaggtcgaaggaatcatgattgctcactcgggacattcagttgtgacactattcagatttggggaagtggcgacgagccatacgaggacaaagatggaagaaagctggacgattgaggaagttgcgtttaacgttcctggtctgtctctcgattgctttataccaccagctgatcttaagaccggttctttaaccgaatcctgcgagtacccacaagaggaaagaggcaagaacaacacactcgcattgtctgcagctcacagggccaaagttgcagccttggagaacgggagcttggaagatcaccgcccggtttggcatactgatgtctaacgcttaaagagagagcttatgactaaaaacaacctttgaaggtagcattagccaaggatgattctcaaagatcagatgcaatgtgtttatatgccggtaactcaagctaaccccttttag

SEQ ID NO: 511 - DNA, 964 bp, Arabidopsis thaliana
ttaattaatcgtctcaagtcgcattagctctttcaaaaatccgatagtttctggctgcgatgccgccgaagagaaatttcaggaagcgtagcttcgaggaggaagaagaagataatgatgtaaacaaagccgcaatttcagaggaagaagagaagcgaagattggcgttagaggaggtgaagtttttgcagaagctgcgagagaggaaattaggtatcccagctttatcttctacggcgcaatctagcatcggaaaagtgaaaccagtggagaaaactgaaactgaaggagagaaagaggagcttgtgttgcaagatacttttgctcaagagactgctgttttgattgaagatcccaacatggtaaagtacattgaacaagaattggcgaagaaacggggaagaaatattgatgatgcagaggaggttgagaacgaattgaagcgagtggaagatgagttatataagatacctgatcatcttaaagtcaagaagcgtagctcggaagagagctcgacgcagtggactaccggaatagcagaagtccaactcccaattgaatacaagctgaagaacattgaagaaactgaagctgccaagaagcttttgcaagagaggagacttatgggtcggccaaagtcagagtttagtatcccgtctagttatagtgcggattacttccaacgcgggaaagattatgctgagaagcttaggagagagcatcctgagctatacaaagatagaggaggacctcaagcggacggtgaagcagctaaaccttctactagcagtagtactaataataatgctgattcagggaaaagcagacaagcagcaactgatcaaatcatgttggaacgatttcgcaagagagagcgtaaccgtgtaatgcgaagataaaagtaaaaacatgtttgcagacttcatccttgaccgggtaacaacactcttttggatggcgcgcc

SEQ ID NO: 512 - DNA, 1916 bp, Arabidopsis thaliana
ttaattaaccagggaaaaatgttgcagaagatttctcagtctatttctttatgtaacggcgatcaatttaagccgttaatatacctcgccggagctccgacgaacttcatctcttcccctctctcaggttgttctctactttactttgtttgtttcgtcaaatttcatgtttaggtttcgagaaaattgattgtgaaggaattagtagaactttgattggactaatgatttttttttggaatctatatatgaatcatgattttgggtttatgtattgttttgtttcaggcaagaagaaatcatcttctctgagaattaaaaggtatataaaaacaaaactaaatttacatgaaggtgaaattttagtatatagttttaatttgatacattttattttgtaggatacaacaacttcaaagtacattagaagatagaataaatccaccactagtatgtggaacagtatcgccacgtcttagtgttcctgatcatatactaaagcctctatatgttgagtctagcaaagttccagagatatcaagtgaattacagattcctgactctataggcattgtgaaaatgaagaaagcgtgtgagctcgcggctcgtgtattagactatgcaggaactttggttagagtaagttacttttgaatctctaactatgattgaatctctttgttgtaatggtttttttgttttgttgttgcagccgtttgttactacagatgaaattgataaagcagtgcatcagatggttattgagtttggtgcatatccttcacctcttggatatggtggatttcctaaaagtgtttgtacatcggttaatgaatgtatgtttcacgggattcccgattctcgtccgctacaggtttggagtagcatgagaattctcttttgtagtatatatgtaacaccccggtttcaggaatatggtggtgcatgcggagaggtttataatatatcactaatcaacaacttcttgtattcagaatggagatattataaacatcgatgttgcggtttacttggatgtaagtatatatttctaagtttcttttgctaatctcattcagattttaaacttcggatggatgtaacactttgaaataggggtatcatggagatacgtcaaagactttcttatgtggagacgtcaatggaagccttaaacaacttgtcaaggttaatgtgtgcctctaactttcgaactcttaggaacctgttagaagctgacatagttattgttcttaaaggtcacagaagaatgcttggagaaaggtatatcggtttgtaaagatggagcaagcttcaaacaaatcgggaagataatcaggtactaaatagtactaatcccattcaagggaagttaggaggatcagttttaattatattttcaacagtgagcatgctgcaaagtatggctataatatggagcgattcatcggtcatggtgtaggaacggtattacactcggaacctcttatatatcttcatagtaactgtaagtaatataaactggctttttctgtaagaactcttcattatgatggagttttttttgctgaaaaactctgttttgtgcagatgattatgaacttgaatatatgattgaaggtcaaacttttacgctcggttagtattatctatatagaatttgatgaatgcatttatactcttttatgaagtgtttggttcctattttttttcacagaaccaattctcaccattggaacaacagagtttgtaacatggcctgacaaatggacaattgtgaccgcagatggtggtccggccgcacagtttgagcatacaattcttattaccaccactggtgcagaaattctcaccatatcatcatgaattatatcacaatgttacggaatttacattatgaaccatccaggcgcgcc

SEQ ID NO: 513 - DNA, 789 bp, Arabidopsis thaliana
ttaattaatatccatggctttaccttcgtgcttaaagactggagctttaatgtctccggccactggatttaatttttccggcagtcttatgaagtcagacagcggcttcgccgttccgacaaagttacagagtactcgaaaaggtgatcgagagagattgagagtccaagctattttcagtttccctcctgcgtttctgacaagaaacggtcgagctgagaaacagaaacagctcaaacaagaacttcttgaagccattgagcctcttgaacgtggtgctacggcctcgcctgatgaccagcttcggattgatcagttagcgcgtaaagtggaagcagttaatcccaccaaggagcctttgaagtctgatttggtcaatggaaaatgggagctcatttatacaacctctgcttcgattttgcaggcaaagaaaccaaggttcttaagatcaataaccaactaccaatctatcaatgtggatacacttaaggtgcaaaacatggagacttggcctttctataactcggtaactggagacataaaacccctcaattcgaagaaggttgctgtgaaactccaagtgtttaaaattctcggatttattcctataaaagcacctgatagcgcccgcggtgaacttgagattacctatgtggacgaggaactacggttatcaagaggtgacaaagggaacttgtttatattgaagatgtttgatcccacttatcgaatccctctttgatctaccaaacaaatggtaccgagccatccatcatacataggcgcgcc

SEQ ID NO: 514 - DNA, 2566 bp, Arabidopsis thaliana
ttaattaattcttaattgttgccacgaaaatggcaatgccaccacctggaaatgttactactccgtctgagaaattgcagtttcctcctccggcaaattggatcccagacgagcgagatgggtttatctcctggcttcgtgcggagttcgctgcggctaacgcgatcatcgattcgctttgtcagcatctacaagcggttggggatcacaacgagtacgaatccgtgatcggaagcattcatcatcgtcgcttagcctggtctcaagtgcttactatgcagcagtttttcccagttgcagatgtttcttacaatcttcagcagattgcttggaaaaggcaacagcaaatgccacctcaaaggcattacaattctgatcaagttgggaaatttggagcaaggagatcagggcctgggtttaacaagcatcatggtggtggtgggggttacagaggagctgattcgatggcgagaaatgggcataatttcaatggcgttaacagtgatcgtgttgagcatcgggaggaagctaagttggcaagtgatgttaaggcattgtctgttgcagaagagaagagaggtaatcaaattgtctttgttttggcttcaatgctttgcttgcttgtaaggaaagtaaacttgtttgttgtgaaatcctatctgcaattgtttctgagaaagttcattgtatgttgctgaacatgatgagagtggaagatttgggtttaatctgtggtttagtctctagactctctgctttagtgaaaatgtaagttttttgtttgtttgtgggatagatggtagcgagaaaccgaggagtgatagtaaagttgagaaaaaattggaagaatctgaaactcaagaggagatagtgaagaaccataagtgtaactcgggttctaaaggtactttggaagacctgacttctcggttttacacctgatattagactttgttgaaatgttctgattatgtgttgcttcttgctttcagataacagtctcatttctgagcaaaagcaggaggagaacgataaagagtgtcctgcaagcatggcaaagacttttgtggttcaagagatgtatgatgcaaaaatggtgagttggttttcttttatatatctgtttagagtttatgcctacgacacctaattccttagttttgttgagtaggttaatgttgtcgaaggattgaagctatacgacaaaatgcttgacgcaaacgaagtttctcaactcgtttctcttgtaaccaatctgagacttgctggaagaagaggtcaacttcaaagtaagaatcttgtttgccctacaataatgatttaacttgttttagtcaggtattaaacccttggttaatgggaaacaggtgaggcatatgtgggttataaacggccaaatagaggacatggacgtgagatgatccaactcggtcttcctatagctgatacgccgcctgatgatgatagtatcaaaggcaagtcctttaaaatgttatttacttataatttctgtgtattggttaacatgagatatgggctttatgcagatcgaagaatagagccaatcccatcagctctttcagacatcattgaacgtttggtctcaaagcaaatcatacctgtgaaaccagacgcatgcatcattgatttcttcagcgaggttaaactgattgctaaattctttgcaacccctaaaactatctgtttctgttttcttaacaaagtagaagttttcttgtgtcttctctgttattgtgaaccatagggagatcactcgcagcctcatatgtttgttccctggtttggacgacccatcagtgtcttgtccttgtctgaatgtgattatacatttggaagagtcattgtctctgaaaatcccggcgactacaaaggctctctcaagctgtctctcactcccgggtaaccgatccatatcacttattctgtaaaatcaagatctttcaatccttttatcatcaattatatttggtactttgaactttgaacagatcggttcttttggtggaaggcaaatccgcaaatcttgctaagtatgcaattcacgcaacccgaaagcaacggatactcattagcttcatcaaatctaaaccgagaaactctaactggggaccaccgccgagcagatcgccaaatcagcacatccgtcacccaaccggcccacctaaacactaccctgttgttatcccgtccactggtgtcttgcccactccgtctcaccgcccaccaaacggagctgttcaaccgattttcatccctccttctcctccacttgcctctccaatgccgttcccaggtggtgtaccaaccgggccgcctgtctggccactgctgccacctcatccacgacaccagacagcaccacaacctcgaatgcccatcccaggcactggtgtgttcctcccacccggttcaaatcaagaactggctgacaacagcaacggaacagaaggaaaattagatttgaaggcgaaagaagaagctcgtaacggatttggtgaaggggaatgcgatggcagtaacggtaaacagagcaattaggcgcgcc

SEQ ID NO: 515 - DNA, 552 bp, Arabidopsis thaliana
ttaattaaaaacaatgacaagctccgatcaatctccatcgcacgacgtcttcgtctacggcagtttccaagaaccagccgttgttaatttaattctcgaatgtgctccggtcatggtttccgctcaactccacggctatcacttgtatagacttaaaggtcgtttgcatccatgtatttctccttccgacaatggattaatcaatggcaagatactaactggattaacagattctcagttagagagtttagatatgattgaaggaactgaatatgtgaggaagactgttgaagttgttttgactgatactttggagaagaagcaagttgaaacaattgtatgggcaaacaaggatgatcctaatatgtatggagaatgggatttcgaggaatggaagaggcttcatatggagaaatttatagaggcggcgacgaaattcatggagtggaagaagaatccgaatgggagaagtagggaagagtttgagaagtttgtacaagatgattcttctccggcttcggcttgaagaagttgtttgcgttttggcgcgcc

SEQ ID NO: 516 - DNA, 2743 bp, Arabidopsis thaliana
gaagaaagaaaaaaaattcgaacttttctgaaccaaatcattccaagcctttgccgcttaatcctcgcaatccgatttctagggtttagaaattagattttgggtttggatctcttaatcatgccgaggcagaataaagatgaaaaatttgtttttgatgacggagaagacgaagacagagaagatccagtagccattacagaagtcgacaacggcgaagaagaagatgatgatgaagctaatgaagatctaagcttgaagattttagagaaagcattatcgaggcgtgatgttgggaacaagcttgattctgatctctcctccgattctggtgtagttagtactgtgatggttaatggagtaaagtctaaggttaaaaagtctgagagtagtaagaagatgaagagaaataagcttgaagctgaccatgaaattgtaagtatgaacgattctcttctatatcttcttctcattacagtttcaattattgtcgtattaattgctttatagatttgagaatcagtagtctttgatttgcaataggaaagattgatttgagaatcagtagtgtttaatgcttatcggtttttgtataacagcctattgtttggaatgaccaagatgaagagaaagtggtggaggagatagtaaaaggtgaaggagaggatgatgaggttgagagatctgatgaaccaaaaactgaagaaacagctagcaatttggttctgaaaaagcttcttgtgagttgattgaattgttgctcttatctcaaaattgtgtaacttgtttgtgatgatgaccattgttggggtcttgttgttgttgttgttagcgtggagcaagatactttgaccctcctgatgctggttgggtgagttgttatagttgtggggagcaaggtcatacaagtttcaattgtccaactcctactaagcgtagaaagccttgctttatatgtgggagtttggaacatggtgcaaagcagtgttcaaaggtgcggttttaagtttgatggtagacccatggaaggtttaggactagtcttattttactgcatatggttgctgagtaaagttttcgttgttttgacagggacatgattgttatatatgcaaaaaaactggacatcgagctaaagattgtccggataagtacaaaaacgggtctaaaggagctgtatgtttaagatgtggagactttggacatgacatgattttgtgcaagtatgagtactctaaggaagatttgaaggtaactttgctgatgatttctttcatataccttactgttttgtttttaaaaatttagtcaaaacaaactctgtttaaacgaaaaggaactgatcatgaccatgtttggatttatcattttttttcctgagtttccttaacttgaggagatatatcttctacacacagctggtttcacctttcttgagtttctggttgctttgctataagatagatcatatggtaatgctattttgctgtattttctttgaccaggatgtacaatgctatatctgtaaaagctttggccatctatgctgtgttgaacctggtaattcactgtcatgggctgtatcttgctacagatgtggtcaactgggtcatagtggactggtaagttattgagattctgattttgaattatccacactgtggattgagttttcctctctaaacagaatgtcattttagttaaaataaatatgcctaaaatgattctgccactccagactcaagtaattttctctctaggcatgtggtagacactatgaagaaagcaacgaaaatgattctgccactccagaaaggctttttaacagtagggaagccagtgaatgctataggtgtggggaagaagggcatttcgcacgtgaatgtccgaattcgtcgagcataagcacttcacatggcagagagtcacaaactttatgctacagatgtaatggatcaggacatttcgctcgtgaatgccccaattcctcccaggtaggctctatctctctctacatttggtgctttgaggtcttcacttctttcctttctctcacatgttatgactcacagcgtttccgtttttcttcatataggtttctaagagagaccgtgaaacatctacaacatcacataaatctcgcaagaaaaacaaagagaactcagaacacgattctactccccatgagtccaatggaaagacaaagaagaagaagaagaagaaaacacataaagaagaacagccccagacttcaccaaggaaacgaaaacacagaggcggttggatcacagaggaaccggaagaagaatctttccaaagaggaaagatgagaaggccaaagtctcccattacaccatcgggttataacaggtcaccctctacacatattggtcataactatagatcgccaaaattcaattctggtgggcattacccgggttctcagtctagtaggcatcactcgggtccttcaccttcaaggtggcagccttctcatcagcatcatcatcatcatcagcatcttcatcatcatcatcagaatcacagttatgaacctgcaccaccaaggcatggaagagctaaccgctatagtgagtttgcagggaactatgaacggtggtagtatcaattatatgatgatcaatgatcaaggtcaaagctggagactatctagcatgaaatctattatgcttgatggtgtgtttcctgggatcaaaggtagcttccctagacctcttgtatt

SEQ ID NO: 517 - DNA, 1676 bp, Arabidopsis thaliana
ttaattaatcgattttgtttttctctcatgtccaaagacaaagtctcttctcccaccgccgatctcatcccgcagcttgctgctacactcgtcgctgctcttggcgctcaatgctaccgcctcacactaccgccgtctcctccgcccagaatcctgacgccgcaagtgccaccttcgtctgctaccatggcttcctccttcaatcctacccgaatccttgaccatcgcgcgagctctcaccggaatcgtcgtggggcttttccggctagcaaacgtcgccgtctggtcgatgagcccatcgattacccggatctctccaacccggcttaccaggttctctccactccgcttttcgcctctggaattgggtcgattcgcgagcttctgtcgtcctctcctccgccgacgacgtcttctcagcctccgtctgtctcgattccaccaccgtccgctccaccgctcgttctcagcgattctaaggatgccgaacccgctggtctcaccaatccgtctgctcctccgtccccgttggctcccaaaaacatcactccggttgcttcaccggtcgcagacgtcccgatgcctgatcctctgatttcgcccaccgctgagactgcagagggtgctagtgtgccagatgcggctgtctcttatgctgctcgtgctgcagctcatcgtcaggtttttgccgagagagatgaactggatagaactcttcgtcgccctttggtgccgccacacaccaagcgttttttgtctgccgctgctgctgaaaggtacaaacacatcgctaaacgcgatttcatattccagaaaactctgcccttagatcctgaggtcctgaccgccaccaagtattttctggaacactcgggtatggctcagactgtcgttgcggtggaacagtttgtcccagaagttgttcgtgaattctatgcgaatctgccagagatggaatatcgagaatgtggtcttgatctggtgtatgttcggggcaagatgtatgagttctcgcctgctcttatcaatcacatgttctcgattgatgactccgctttagatccagaggctccggttaccctctctacagcttctcgtgatgatcttgctctcatgatgacaggtgggactacacgacgttggctccgcttgcaacctgctgatcatctagataccatgaagatgctgcacaaggtttgctgtggaaattggtttccaacgaccaataccagcactcttcgggttgaccgtctccggttgattgacatggggactcatggtaagagtttcaacctgggcaaattggtggtaactcataccatgagtttggcacgtttgggacccctttcttcacatcgtctggcttacccaaatctgatctaccagctgctcacctttcagcgtgatgtgcgctctcgtcctcgtgatactctctctgacgaaccgggtgtctttgtcaacgatccgccacccacgcagcctacccaagcaccacctccgatgggtcataaactccttcttgaagacattaatgatcttcttgagatagggaagcgcatacgacgtcgcttgacaggtaagttgttttcttgcttcatgtggtgctttgcttattgtgttcttgccttgtgttttctggaattttgatgttgtggctcctgtagttgaggcgcgcc

SEQ ID NO: 518 - DNA, 906 bp, Arabidopsis thaliana
ttaattaatcgtttgtctgtgcagagagagagagagagaaaatgaggttgttcgatccatggccagtgttcttcaagagagaatggaaacgttgctggccattcctcaccggtttcgccgtcaccggcgttctcatcaccaagctaaccgccggactcactggtaaactcttcgtcggatctcaccgattttaaacatctaacttctcccatttcagctgtatttatttgattcagatcggatgtttatttctgtaatcatttctcaattttgattttgattttggaaaaccctaatttccgtaaaatggtgattgatttgcagaggaagatgctaagaactccaagttcgtccagcaacacagaaggtatcaccaatcttgaaaattctcacgttgaaattgaaatttcttggttttggcatatgatttagattttagagcattttggaatcaatggatgattttaaattgaaattcttggtttggtatatgatttgatcatagagcattttgtagaatcgatgtagttaaatagctcttgaggttttagggttgttaccaatggatgattattcgtgtcttaaggtggtattatgtcataaatcccaaatcaaattcgaaattattcgtgagtcctcactttttgattgattcatagtgagaaattcaagtcttaccgctaaaataggttcattgccaagtagatgaatctccattagatgttcttttgttgttcttgcgctgttgtgtgatatcaaggaataatagtgttgattgctacattggtattgactatgtttaaactcttagccaaactctaaaggtttcaacttgtttgttatttcaggtgattcactgaagcaaaatgtagaagctgacaaggcatatagattgggaggcgcgcc

SEQ ID NO: 519 - DNA, 1469 bp, Arabidopsis thaliana
ttaattaagggtttcttccgatgttagatttgcagccgtcagatcggcgtcatggagctccgagtagtagcggcggtgttagtggtggtgatgagctgatcagaacttataaaggctggaaaggcaataacgtgttcttccttggaggaaggctcgtgtttggacctgatgctcgatctattctcatcaccgtcttcttaattacagctcctgtcattgtattctgtatttttgttggcagaaaatttatcgatgattttcctcaccatagaggagtatcagttttagctgttgctgttggtctgattttattagatctagtatttcttcttctaacctccgcgagagacccagggataataccacgtaatctgtatcctcctgaaccagagagtaatgaaggcaatggagaaccacgtcttgctcatactcctcagagtcggttgcctcggacaaaggatatgattgtaaatggaattactgtcaagatcaaatactgtgacacatgcatgctttacagaccgccccgtgcttctcattgttcgatttgcaacaactgcgtcgagaagtttgatcaccactgtccttggcttggtcagtgcattggattgagaaactataggttctacttcatgtttgtgttgtgctcaactcttctctgcatttatgtccatgtgttctgctggatctacgtcaagcggataatggatagtgagaacataaacatctggaaatcgtttctcaagactcctgcttccattgcactaataatctacactttcatttgcgtctggtttgttggtgggcttacctgtttccacttgtacctaatgagtaccaatcagtcaacttacgaaaactttaggtatcggtatgatagacatgagaaccccttcaacaaaggaatagtggggaactttatggaagttttctgcacaaatgttgccgtatctcagaacagtttcagagaaaaggtttcaaaggagccagcaataccaccaaggacagtaaatggagggatgtcaagcccgagcttacagaaagtttccaacgacatagagatggggagaaaaccagtgtggcacgagacagtagaagaagagctcggtgacatcgaaaaggacatggaagcaggggttgcatcacgggatttgagcagaatgcttcctccagaagaatctgaaggacgagggattatgcattcaagagagtcaagcaggggacgcgggattatgcattcaagagagtcaagcaggggaagaagaggagggagctgggaattgtcaagccgtgtaaacgaagatttaagaaccagagatgagtctgtgtcaagagtcggtgaagacagctcagagtcttcagacaatgatgcttcaagagatttacatgttgagatatatgatgcagtaacaagtagaggaagaaccggaactggtatagggcggttatagtctccggtttggcgcgcc

SEQ ID NO: 520 - DNA, 2751 bp, Arabidopsis thaliana
ttcttctgtagttttttttcttctcatacatatatcaatcaatcaagatcaccaccacaaggcaaaatctaaactctctctgcaaaatttctgctaacttcttcctcccattttcttgccatggaaatcgattccgccaccaacggaaactctgacaccgtcatgacggaatccgccgctacgatcactccgtcgccggtcgtcgtctcgtcttcgagatcgaatcaatttacggaatctctcaagcttgagcaccagctcctccgcgttcctttcgagcattacaagaagacgatccgtaccaatcaccgttctttcgagaaagaggtctcaaccattgttaacggcgtcggagaattggctgattccgattggtctaaagacgataccgtttcgcgtcttacttgccttgttactcgattacaaggcctcaaacgaaaggttgatttttccgtctctctccctctgtgatcggtgttttaaattatgtagacgaaactgaatcaattaatttagcgattaaagtttctgattttgctaaatgatatccacttatctgtaaaaaatttgatcttcgatgttgaagatcaaagtaaagtatctgtctttggcaattatgtctcactagacattggatctcgatgaattcaatgtagtggtggagttggttcattggaacttcccatctgactatttgcattgtcttctaaatttttatcatttgggatagtttctatatcttctggagtaacatcacatggatatggcctggcttacgtatttttttggttttgtatctcagttggaagaagggagcaatgtggagaatttgcaagcccagagatgtcgtgctcgcatcgatcatttggattcagtagatgtggaaaatattactgaatggaataataccaaactgaaacggattcttgtagactacatgctgcggatgtcatatttcgagactgctacaaagctttcggaaagcagcaatattatggtttctctcatcctcttgacactcattatatcacactattatgctatattgctgtcttggttaatatatcagaacatattctttgctgtttcgtttttacaagcagtgaaacagatttgttgatttgtactgcatctctatgaaatgctaattataaatatctcatcttttcaggaccttgtcgacattgacatatttcgagaagctaagaaggtgattgatgcccttaaaaatagggaggtagcttctgcattgacatggtgtgctgataacaaaacgcggttgaaaaagtcaaaggtacgtgctctatgtactctcatggttaagttttactttcattttttatgaactccatgtggtttggctaaagtatccaattttttaccagaactctatgtataattgttcattgctaattatatattttccttttcataacagagcaaatttgagttccaactaaggctgcaagaattcatcgagttggtacgagttgatacagctgagagctacaaaaaagcaatccagtatgctcgaaagcatctggcatcatggggaacaacccatatgaaagaattgcagcatgttctggccactttggcttttaaaagtaccacagaatgctcaaaatataaggtgaagttttccttcttttgattatataactgttgaaaattgacgcttcaacttgtatcttttcctaatgattgattttgtctgaaatggcccaaaaacgtggatatagatttcactgtttctttcatacaccaggctgcttcagtaatctttttcgtctttgtttattgccgaattagttgtgttactttcaactcttgtcgaatcttaattgatcattgcatgtatttaggctaatcaactaacagatatgtttttcttttttctcaggttttgtttgaactacgacagtgggatgttttagttgatcagtttaaacaagaattttgcaagttatatggcatgacgatggaacccttattgaacatctacttacaggcaggcttgtctgcgctgaaaactccgtaacgatcaaactctatcaaaattgatgtttttgattgtctattttctgcatctgataaaggggcagaaagtaagttttcgaaatgacaccctaatgtgattcttactggtgggttgcgtttgtaccttgatatgactcagatatggtttagaagaaggttgtaccaaagaggaccctctctcacaagagaactttcggaagctagctttgcctttaccgttctccaagcagcaccattcaaagcttgtttgctatatttctaaggagctaatggacacagagaacccaccacaggtgctgcccaatggctacgtctacagcaccaaggtttgattctgttcttgtacaacttcagcttctctgttctttttctctttttagaatctttttctattagcttgatcagttacatcagtctatcctatacagttcaaaaaatttaaagttgggttactttttttatttatttgatgggtaaatgaacttgcaggctctcaaggaaatggcggaaaagaatggaggtaaaataacatgtccaaggacagggcttgtctgcaactacacggagttagttaaggcatatatatcatgaacccatatgctcataatcctcactttggtcaccttttcaatggatgactgggaggacagtattaaggccaaagaaactgaaatttccaactttctccattactctttgtgaatatgcact

SEQ ID NO: 521 - DNA, 702 bp, Arabidopsis thaliana
ttaattaagggagacaaaaatggaagtgaaagggaaagagacagcttcggttctgtgtctgagcaaatacgtggatctatcgagtgaagagagtcatagatactatcttgcgcggcgaaatggcttgcagatgctccgagacagaggctacgaagtctccgacgaagatatcaatctctcccttcacgattttcgaactgtttacggtgaacgtcccgatgttgatcgtcttcgcatctccgctctgcatcgctccgattctaccaaaaaggtaaaaattgtcttttttggtactagtatggttaaagtcaacgcaatccgcagtgtagtagcggatatacttagccaagaaaccataactgggctgatattggttctgcaaaaccatgtaaccaatcaagccttgaaagccattgaacttttttctttcaaggtcgagatattccagataacggatctgctagtcaacataaccaaacattcactgaagccacaacatcaggtgttgaatgatgaagagaagacaacacttctcaagaagttcagcattgaggaaaaacagcttcctcggatttcaaagaaagatgctatcgtccggtactacggattagagaaagggcaagttgtgaaggtgaattacagaggcgaactcacggaatcgcatgttgccttccgatgtgtgtggtgaagaaacggcgcgcc

SEQ ID NO: 522 - DNA, 1072 bp, Arabidopsis thaliana
ttaattaatttagggacattcttgtggtggagaaatgggagacgaccagctagatttcgagctcccagaagaggttttgtcggtgattccgatggacccttttgagcagctggatctcgcgaggaagattacatcaatggcgatagcttcaagggtgtcgaatctggactctgaggtggttgaattgagacagaagcttctgggtaaggaaagtgttgtccgtgagcttgaggagaaagcgtctcgcctggagagagactgccgcgaggctgattcgagattgaaggtcgttctcgaagataatatgaacctgacaaaggagaaggattcactggcaatgactgtaacgaaactcacccgtgatttggctaagctggagacattcaagcggcagttaatcaaatccctgagcgatgagagtggtccgcaaacagaacctgttgatattaggacatgcgaccagccaggatcatatccaggcaaagatggaaggatcaatgcacactcaattaaacaagcttacagtggatctacagacacgaacaatccagttgttgaagcttcaaaatacactggaaacaaattttcaatgacatcatacatatctccacgtcttaccccaaccgcaacaccaaagatcatctccacaagtgtgtctcctcgaggctattctgcagcaggttctcctaaaagaacatcaggtgcagtttctcccacaaaggcaacactctggtacccgtcaagtcagcaatcatcggctgcgaattctcctcctcgcaaccgcacactcccagctcgtacaccgcggatggatggtaaagaattcttccggcaagccaggagccgattatcctatgaacaattcagttccttcttagctaacatcaaagagctcaacgcccagaagcaaacccgagaggaaactctgaggaaagcagatgagatatttggggaagagaacaaagatctttatttatctttccaaggtctccttaacagaaacatgcgttaaactttcataagccgttatcttgaatctgggccaatgtgataggatggatattggcgcgcc

SEQ ID NO: 523 - DNA, 482 bp, Arabidopsis thaliana
ttaattaattctgtacttgtatacccggcggagcagaagatgaagcaaccggcgacaccaaacgcggcggaggaaaccaaatcagaacaaaagcagaaatcgaagaaattcccaactccgacggaactaatctctcactaccagaaacgagggctggaaccagcagaagcttcaataaaggtcatcgaagatttacaaaacgcgctcgtccgagtagtttcgtcctccagaaacgcctcgagcaaggataagcttgtaaccgacgcgaggaaaatcgacgccattaacgggaggcttgccgtcgtcgacgcgaagctggagacgaaacctggatacgttgagactttcgcgttagggttagcttctggtgcgacacttaacggaattagcgccgtttggcctcacgttaccagaggcattggtcaaatttggtccgccgttaggatcgggacggatccttcatctacctcttgaggcgcgcc

SEQ ID NO: 524 - DNA, 1532 bp, Arabidopsis thaliana
ttaattaatggaagccaaagaagaaaccccgtggagctctattttagttccttctgttcaggagatggtgaaggataagatgatcacgaccgttcctcccagatatgttcggtatgatcaagacaaaactgaagtcgtcgtccatgattctggcctcatatccgagatccccatcatcgacatgaatcggttgtgttcttctaccgccgtggactctgaggttgagaaactcgactttgcttgcaaagaatatggatttttccaggcaaaatctcaaacttcactttttttacaaaattatctatgttagacctaacgtggagcttattacccttgtttccatgcaagtatcagaattaaatagattacgtttgatgaaattattcagaaaaaatcgtttcttacaactatgttaaagccaaaatggagcctaaaactttccgtttcaaatttatttatttggttatgtctttgtatggtccttaacagcttgtaaaccatggaatagacccaagtttcttggacaaaataaagtcagagattcaagatttcttcaaccttcccatggaagaaaaaaagaagttgtggcagacaccagcggtgatggaagggtttggacaagcttttgtggtttcagaagatcagaaactcgactgggcagatttattcttccttataatgcaacctgttcaattacgcaagcgtcacttgttccccaagctacctcttccctttaggttttgcatgcataaaaaaaagtgttaacattctcaactaacaccacaaagtctctctatttacattttggttaatgtttttcagggatacgttagatatgtattccactcgagtaaagagtatagctaagatcttactagcgaaaatggcgaaagccttgcagatcaagccagaggaggtagaagaaatatttggtgatgatatgatgcagagtatgaggatgaactactatcccccgtgtccacaacctaatctggttacgggtctaattccgcattccgatgcagtcgggctcaccatacttttgcaggtgaatgaagttgacggtctccaaatcaagaaaaatggcaagtggttttttgtcaaacctctccaaaatgctttcattgtcaatgttggggacgtgttagaggtaagccatactatatagatgttttgatgaatttggtcgggctaaaccctgatagactttatggcagctaatcgctagtcataaatattttgatgatgggtgttgggccgtttgtaatgcagatcataacgaacgggacataccgaagcatcgagcaccgggcaatggtgaacttggagaaagagaggctctccattgcgacatttcacaacacgggaatggataaagaaattggtccggcgagaagccttgttcaaagacaagaggctgcaaagtttagaagcctgaaaactaaagactacttgaatggcttgttttcccgtgaactcaaaggaaaggcttatcttgatgctatgagaattgaagggaagtgaggcgcgcc

SEQ ID NO: 525 - DNA, 1211 bp, Arabidopsis thaliana
ttaattaagatggatgctgaaaagaagagtgcccattttcgccaaatctcatcttataaaccacaattacttgtcctctcctcaatccaagaaaacccttcttcaaaaatctcagaaaaagccaatatcaaagctgacaatgacgccgagattggagttttcggagcagaaaagtacttcagcatgaagctagatcatgttgattccacggcggatatcaccaagcaacatgaaaaggaaaacacacatgatcatcctaatgctaatcctaatcctaatcctaatcctcatcctcatcctcatccccagttgacgaaaacgacgtcgtcaagatcaaaaacaagccgacatggaacgccaagtgtaagatccgagtcaagttgcaacagtcaaacctttctcatgaggattaacaaccacaatgaaaataagcaacggaaaatgaacgatacgagcatctcttttggtgggtttagatgttacggtccctgctctggggtcaaaaccgtccataccgacccaaaaaactcctgtaaaagtagaaattccgatcgggattttgttgcttacgacgcaagaaagcacaacgacaaaccaagactccattttgaagccaagaaagcggattttcatgcgcaagagaagatttcattacctattcaaaggtccgatatcgccatgaacctcgagagaaagctctctctgcttacatgggacgcaataccaaaccaactctctaccaagaacaacaatcacaacaataatggtaataactcttcaatgagtagcaacacgcaagaggaagagacagcaagtgtagcaagttctgatttgttcgagattgagaacataacgagcagtgtctatgagccgagtgaggccagcattggatggagtgtggtaacgggaagtatggcagatcaatcggtgatttcggatttcgatatgatgaagagggtcacgagaaatggtccggtggttaaaaccaaaccggtgattggtgagaaagtccggtcggctgggtttttgtcgggttgtaagagtcacaaagctgtctcggttgttgatagttctagaaaagtgaaagaaacagccaaggttgatcatcacgagatgtctcatcagaagaagtttaaaactgagattaggattcaagacttgagctttctttaataaacaatgtttgtgtatgtgtgtgttcttggcgcgcc

SEQ ID NO: 526 - DNA, 575 bp, Arabidopsis thaliana
ttaattaatttggattgggaatcgagaagtttaaaaatggaggaggatagagagaatgcaaagagagtagtgtttgtaactgtaggaacaacgagtttcgatgctcttgtgaaagcagtggttagtcaaaatgttaaagacgaactgcagaagagaggatttactcatcttcttattcaaatgggtcgaggaatctttttcccaactaagtgtgatggagcggatggatcattagttgtggattacttcacattttcctcaagtatcgctgattatattcgatctgcatctcttgttattagtcacgctggatctggaagtatatttgagacactgaaactagggaaaccattgattgtggtagtgaacgaagatctgatggacaatcatcaatgtgaattagctgaagcacttgaagagaggaagcacttgtactacactcgtcctcactcccttcatcaaaccttgacgaaaatggagttggggtctctggttcagtatactccaggtgatggaactcctgttgctcgcattatcgacaggttccttggattccctgatgattaaacaggcgc

SEQ ID NO: 527 - DNA, 412 bp, Arabidopsis thaliana
ttaattaatcagagagaagtcaacggatatgccggaggaagaatcgatagatatcaaattcaggttgtacgatggctccgatatcgggccttttcggtattctgcggcttctactgttgactttttgaagcagagggtcgtctctgattggcccaaaggcaaaacagttgttccaaaggggataaacgaagtgaagctgataagctcgggtaagatcttggagaacaacaagactgttgggcagtgtaagacaccatttggagatattgctggtggagtcattgtgatgcatgttgttgtacagccttctctagctaaatccaaaacagagaagaaggttgataaagcaccaaaggcagtaatctgcacatgcaccattttgtgaagggaggaagaccaatgtaggcgcgcc

SEQ ID NO: 528 - DNA, 602 bp, Arabidopsis thaliana
ttaattaatggaaacaatagcagttcaaaatgcaccgggtaaacaagtttcgggtttgagaccattcaagaaccctaaaagaaggagttctcgtggttctctttcaagatccggaggaagtttggctcttcctcttaatccaacgtcgtcttggggatcttctccggcatatccgccgccgcatagttactctcagcctcctcttctccctctaccacgtgtcaacagctcaactgttcctctgcaacgcgtcaacagctctcgaccacgtgtcaacaacaactcttctctcaatcgcgttgctcagacaaaagctatttctgaaacacacatgaagaaagcagagttcatcgaatctgcgagactgactcgaaccggttcagtgccgatccaggcgaaccagttgcgtgattttcctgaaggattcgatggctaccccggtccagcgatcatgttattatctccgccaccgagtagtttgcccatgcctaggttttcgatcaaaccgaagcttcgttgcaacgtagaagctgctgggaaaagtgacgtagctaccaataacatccggcgagttttacagctccggtgaaaggtggcgcgcc

SEQ ID NO: 529 - DNA, 2313 bp, Arabidopsis thaliana
tcgaacaaagttttcgaattttccaactctctctagtgaatttagggttctgatttcgacattagtgtaaagatttgttttttatccgaggggtgcgattgtgtagtcaaaccagatcaaatgtcggcatcaacggtgtcgatcaccgctaatacggcggcagcgactagacggacgccgattcttgccggagagaaaaaatcaaactttgattaccctcaaagcgaatcgcttgcgaacggtggtgttggggaagccggtggtacgagtagagatctgagccgcggtgaagctacccttgatcgatctcagggacaagatttgggtcctgtgacgagaaggtctgtttccgctgcgacggggactaataccaccgctacgcagcgccggacgcggaaggttgcgactcctaagtctgagaaagcgcggtggaagacagtggtgaggatatttgcgaagcagcttggtgcgcttttgatcattgttgggttaattcaattgacgaggaagatgattctcaaggcttcttctccgtcctctccgatttcttcttatgaaacggagatggcgttttcgggattggaaagccgaattgcggaagtagatggtcttgttaaggctacgacgaattcgatgcaggttcaagttgaattgcttgataagaaaatggagagggaagcaaaagtgcttaggcaagaaatcgagaggaaagcttctgcatttcagagtgagttgaagaagatagaatctagaactgagtcactagagaagtctgtagatgaagtaaatgctaaaccttgggtgacgaaagatgagttagagaggatttatgaggaactgaagaaggggaatgttgatgattctgcttttagtgagattagcattgatgaattgagggcttatgctcgtgatattatggagaaagagattgaaaagcatgctgctgatggccttggccgagttgattatgcattggcttctggtggtgcttttgtgatggagcattcagatccttatcttgttggtaaagggagtagctggtttgcgactaccatgcggcgcgctcatacgaatgcggttaagatgttatctccgagcttcggtgagcctggacaatgttttcctctgaaaggtagcgagggctatgtgcaaatcaggctgagaggaccaatcataccagaggctttcacattggagcatgtagctaaggtaatgatactcttgtactgcaaactatttgtgttggtatcagttttctttcttgtgtgctcttattactacctttggtgtttgcatttacaatggtttgatattgagatgcctggaaaaaatgacgccattttctttgtgactgttgatggcatgaaattgtttgaatgaggcttgagattagtttagatcggttgctgcaaaagatctgaactgaagaggattatggttacttaataagtttcgtcatcatccagtaggtctcgtcatagttctccaattctgtgtgtgccatatgccattgacctttaggagtttgtttaagatctgtttttttctggcattatcttttgaaattgattacacaataccactctatcgaagtatctcaaacctttgtcaaagagttcaatagtatgcataaatagatcctttgagggttttgggttatcttctgtttctatttgcaacgactggaactagactattttgtttgtttggggttatttcaatgacaataaccgagtaaaatgaaataaagaagacatttggatacgctcattacttactgtctctggacatttttgggtcattcttattttggggattatatatgtacactgacctgatggattgatgcattgtgaaaatgaacagagtgtagcctacgacagatcgagtgctccaaaagattgccgtgtatcaggatccctgcaaggaccggaatcctcagcggagacagagaacatgcaacttctaacagagttcacttacgacctagacaggtcgaacgcacaaacattcaacatcttagagtcatcaagctctggtctaatcgatactgtcaggctagacttcacctcgaaccacggaagcgactcgcacacttgcatctaccggttcagggttcatgggcgtgcgccagacccggttcctgttgtgggaacgaatcttgatcaggactcttcacctgaaagtgaataaaacctcttctgttttgtaacattccttcatccacatctcttttgttgcctgtgttttttatggaaagaaaaagaaagcatcagattctgtgattagactagtagagagttgtttgatttg

SEQ ID NO: 530 - DNA, 971 bp, Arabidopsis thaliana
ttaattaagctccattgggtttagagattctggtgtataaactgctaatgacgagtaaccttttccagccaccatcaatggcagcttcacgaggagcaatctcgagaagaacaggaaacgtgaaagtattagtctctttcaccagttctaatggcaaaacgctgagttttagtgacaactcatttaggctcagacccatgttcatcgggaaagtcacagaacagagttcttgttcctccccaaatgaacaacaacaagatgaagaacaagaacaagaacaagaagagattacagtttctcatataaaagaagagctctacgaagctctcaaaggtgattagattcgctcctttcagattcctttcgactatcagaatctttaattcgaaactcattagctcgtagttcaaattttgattttaaatgctttgattctgttatctgattgtattgggattaaagggatcaatagagggatattcggagttaagtcggataaaaagacagagatcgagggactggtgaagcttttggaatgtcggaatccgacaccggagccgactggagagttagacaagatcggaggttgctggaaactcatttacagtacaatcactgtattgggttctaaacgaactaaattgggtcttcgagatttcgtctctcttggtgatcttcttcaacagattgacattgctcaggtagataaaaaagaaattgatcagttcagctttttagtgatgacgtttttaatgtgtttctttttcaattaacgaagggcaaaacggtccatgtgttgaaattcgatgtccggggattgaatctactcgacggcgagtttagaatcgtcgcttccttcaagatctcgtccaaatcggtacattaccgttttcttgacgtttttaggttttttagattcttggaaaaatcgcgttttgacggaattgcgtttgtttgtttgtaggcgcgcc

SEQ ID NO: 531 - DNA, 1749 bp, Arabidopsis thaliana
ttaattaatatggccggacttctagcttgggctgccgatgtcgtcggtaaaaatggaaaagaaggagacgatgagaaggatcggatcccattggttttcacggaggagcagcagaaatacgtcgatgagcttggccgaaaagcgacaaacctcagccgttcgatccaagatctgcggctcagattgcctccaccggatatctcccagcgtctacctgaccttcatgctcactcccttgcgtccaatgccgctctcactcttcagcttgattcgcactccgctactcgtgaacaggtttgagttattgaaatactatagctgatttgggaattgtgtttttgcgttataggattagtcttcaatggatatggctttggctgatgttgaagtgatcctaatggttcttcttttggtattgcaactaggcacacatgagagagcagacactgctggaagaaaatagtgcatatgagaatgcaatatcaacctgtgagacaaaaatagaagagaagaggaatgaagcagattctcttcttagaaagttgaaggtgagttatcagataattgttcttttcttgtctgtgatcttgttcagatatgtatgttggtcctgttaccatttgggttctgcctgatattagatggtttgcaggagctagaagctgtagaggaaaacttgaaaactgagcaggataatgcacaagcttctctagatgcaaggcagtccaaaagctctagtgaaactgttattcagcctgatgggaatggaaaagatggagcagatacagaggccatgaagtcctttatgctagagaagttggagagcaaaaagaacgatatggttagttttcattttacgtttcatgggtatggattggaatagtcgatttggctgtatatctgatggcagtgtaagttatattttccatttagagtttaatggaagaaaaagttcaggatttagagaggagttgggctgttatacaggaaagagcactgaagcagccttctccaggtacttttttttgtcatcaattctgattagttagtaaattactattttatcaccattcagaaccatcacgtcttcaatatatatgaaacaaaaaaaaaattgttttacatagcttattttcagtaagaattcaatagagatctgttttttggttccgttagataggttgatagcgtgaaaaatttcattcacattatctgactggaaaggtttttctttcacagctcagagagagaagacactggataaacaacttcatagcctaatcgagcaattagctgcaaagcaggtccatcacaacccaaattaatctacacttttccctttagactgtttcttaacagaaactttgatatgcttatcaggcacaagcagaggggattgttggtgagattcatctaaatgagatggagttagagagactaaacaatttatggagaagatatgaaagctttaacgttgaagggaacgctgcgaggaacagattcaagagaacaaattcagatagagaatttacatcagaccacgaagttgatggtcattcctaccttccatattcatctgctacaagaaatgggacccaaacaaggcttatgtatctcaggtcagcttttgtcgtctacattttggctttgcaagtcctggttttcatcagaatttccttttgagaagttgtgtacacgagtagtctgttctgcttttagtttgcgcaagggagtcaaaataggcgcgcc

SEQ ID NO: 532 - DNA, 1229 bp, Arabidopsis thaliana
ttaattaataaatccgatcgaaacaactgttgggttagtttctaatttccaagaatggcgcaagatcacgacgagacggagaataaaacctttgccgacgttgtcggtggcgatgatgtcggcgaaattgtcaacggaggaacaaagaatggctatcgtaaaccggactctgtggagaaggaagatgatgaggatttgaagagtctctattccttgatttgtctcacgatcggttcgattctgtttccagattcgaaaaccggtgatgcgtcttcgtttcttgaacgtgtaagaaactccgtcgctgaaaatgggcctaagcttcgagaagcttctgaaagaacaggacgcgagattcttctctggactcgtagaggcagctcgcttcgtgctctgcttgtcatcactgtaagtagaatgattgaacctaattagagactgaatttcattttcaatctagccttccattatcttcaattcgatttcctcaagtaaattaacgtattgtgccctaaatcgtcttggttctgtaactctttaccattgatgaaaagtttggtactttattgaaaagtttagtgctttattgaacccatttgagccaaatttcgtgggtgtctgagactatatgttgattagttattatcttgttattgttgttgcagatgggaacaatagttcttttgacaacaatggctttggttgtattcacactcttctttgtagctgcaacagccaatgctatcataatctctcttctgatttcacttgctgttgctggtggcttcttggcactcttctttctctgcttgactggtgtttacattggagccttatccgttgctgcattcgtcatctctaccgctacagtttctgctgtcgtttctgtcttaatagcttcaggttggttatatactctgctctgattctgttttggaatcttgtaatgagtgacactccaagttacttcctatatgtattgaagaatgaaatgaatttggtattggatcaggttggattgggtttttctatgcggtgtggttgggaacaagaggaagcctacgcttggctaagcaatcggtttcagtggtgggatcagccatttcaggtaacactatcagtcgtcatcaacaccaagaccgggaggtaaacatcgaatcaaccaactgagaatccgtccttaccgcgtttgtaaataaaccccgacttttggttgttaatggcgcgcc

SEQ ID NO: 533 - DNA, 1643 bp, Arabidopsis thaliana
ttaattaacagagatggataaaatgaatcaggctattgagaagatgaagatgttggttggtatggaggttgaagacgagcaacaagctgctgatgaagaaagctcgctctcattcatggaagatcttaatcgcaattgcgctttaactaccaaacaggttcttaacttccccagattcttcgatcaagtcctctgaatttggtaatttttgtaatttcacatgcggactaggtattcgtccaattagagaagttaggctcgtaagctcactgaggtagaaatgtaaatgagttcctattgaatgcatatgatgtgatcaataacatacaagagattttgagataagtgtttagcagttctatgattttttggaggagaaggattataaaattccatgtggtatgataacagtttgattaataggactaagttttggcttgctactacaaaaaattaggacgctacttggatttagctcctctatgaacctgtagtgttgtctcgtttacaagaatctgttaaattatcttgaattgggtttgtctttggctaatatctcgttttttttgtttatgaaaacagagattttatggctttgcaatttgcttgtcagcaggtttgacctgtacacttttggtaagtataactctcaagtcttagcaatgttagaaagcactatccttatttctgcattgaaaggaatcatttgattggtttagctgtattcttcttctgtactttgggttgtcttagctcttttactggtgatataactctttatctcttatttgtttgacgatgcagtcgatgcttgttttctttaatccggtcaagtttggcatcacattcactctgggaaatttgatggcactcgggaggttcgtattggaattttgtgtagcttcttgttatattgcattggtgtcgcaattctgtgtgtacagtatttctccatttttctctctttgttcctggattttaagtttcatgtcacttttgtatggcagcacagcattccttataggcccacagcggcaggtgactatgatgcttgacccagctcgtatctacgctactgcattgtatctagcaagcattatcattgccttgttttgtgctctttatgtaagtggggtttctcaattcaaaatactggatgcacaacattgcttatgttcagttaaaactaggtagtgaaaatgccttgttggactaaatataatctgtcatcatctttctgtacaggttcgcaacaagcttctgacactgctggctatcattcttgagttcactggtctaatttggtatgctaaaacttgctttcaagctcttacatttttatcctaactttcttagtaatacaattacatgatatatactcttcgaatagtatattatcccgagtggacctaatgctccttatacggtttctgagtttgtcacaaaagctgtcaacattcatcttggagaatgaatcccttgtgttctttaaaactgcaggtatagcttgagctacatcccttttgcaagaaccatggtctcaaagatcttcatgacttgttttgacaccgagttttaagctacagtttacacacatcaggtcaaagatttcttgttccaaaaccttgatgctctggcgcgcc

SEQ ID NO: 534 - DNA, 271 bp, Arabidopsis thaliana
ttaattaagtaaaagagatgcatgattgggctgcaccgttgatagcttcggctttgttcgcgtttctgtcgccagggttgatactgcagtttccggggaaagaatctccggtgggtttcatgaacatgaagacgacggtagcttctattttcgttcacactgttctctatggtctctttcttatcctctttctcgttgttctcaacgtccatgtctatgcatagctcatttattacactcatgtatgtgcctctctgctttgtggcgcgcc

SEQ ID NO: 535 - DNA, 236 bp, Arabidopsis thaliana
ttaattaagactaggaaaatgacggagtggcttccggtggtggtcgcgacggtgttgtttgtggtgctgagcccgggattgttgtttcaggttccgggaaacaacaactttgtagacttcgggaagatggaaacgagcggatactcaatccttctccacgccttcctttactttggccttgtcactgtcttcaccgtcgtcatccactttccgggcacttaattctatggcgcgcc

SEQ ID NO: 536 - DNA, 327 bp, Arabidopsis thaliana
ttaattaactccctcaaatcgttttctccagttttcttgggataaatcttcctcctttctgcagacgccatgtcggacaaaggtcgtcccttgccaaaatttggtgaatgggatgtgaatgatccagcatcagcagaaggttttacagtgatattcaacaaagctagggatgagaaaaagaccggtggcaaaccgggatcacccggtaaatccagtgagggtcatgttaaatctggaggaggagatcctagtaaacctcagcctaaaaaatggctctgctgcatgcaagctccagctgtggactcttgacagacacaaaggcgcgcc

SEQ ID NO: 537 - DNA, 298 bp, Arabidopsis thaliana
ttaattaactcgcgatcgtcatttcaatttctaattagctttcctggtgtttcttctccggcgtaatcatgacaacctcaaaaagactagcagacaggaagattgagaaattcgacaaaaacattttaaagagaggatttgttcctgagaccaccaccaagaagggcaaggattatcccgttggtcccatccttcttggcttctttgtctttgttgtcattggatcatctctctttcagatcattaggactgcaactagcggaggcatggcataaaccaaaacacagtcaggcgcgcc

SEQ ID NO: 538 - DNA, 1426 bp, Arabidopsis thaliana
ctctctctctctctctcgagccaccaaatctgaattagggtttttgagaatattcatcttttgatttcaaattcttcacccactgtgtaatttcactcgtcaggattcatctgcggaatcatgattacagattcgatcaccaacgcttctgctacttcagctccgagagattccggaaagaagaagagggtaacgttatcctctttgataaatctcattcctttctctgaaattgattcaaagttttgatttttaatggttttgttattgcattacgttttgcagaacaataagtcggctaagatgaagcagaacaagcttggtctccgtcgtgagcaatggctttctcaaggttaaaacttcatctttctctcctttaatgtttcaattctgcctgattcgtttggttagatttggttgtctatgtattgattttgggtttttgattttgatattagttgcggtgagcaataaggaagttaaagaggagaggagtgttaatcgtagtcaaaagcctcatcatgagagttcagataaggtgcgtagagaagaggataacaatggtgggaataatcttcttcatcatgagagttttatggagtcaccttcaaatagctctgttggtggtacatattcgagcactaacttcagtgggagaagtagcaggagtagtagtagcagcagtggcttttgctctggtaatataacagaagaggaaaatgtagacgatgatgatgatgggtgtgtggatgattgggaagctgttgctgatgcgttagcggctgaggaagagattgagaaaaagagtcgtcctcttgagtctgtgaaagagcaagtgagtgttggacaatcagcttctaatgtgtgtgattcgtcgattagtgatgcatcagatgttgtgggtgttgaagatccaaagcaggaatgcttgagagtgtcatcaaggaagcagactagtaatagagcttggaggctagatgatgaccttcgcccacaggggttacctaatttggcgaagcagcttagttttccggagttagacaagcgttttagctctgtggcgattccgtcttcatgtcccatatgctacgaagacttggacttgacggattcgaatttcctcccctgtccttgtggatttcggctctgtctgttctgccacaagaccatttgcgatggagatgggcgttgtccaggctgcaggaaaccctatgaacggaatatggtcaaggctgagactagtattcaaggtggtggtctaacaattcggttggctcgttcgtctagcatgttttgcaagttttaaaaggagaggtgcggttttctcaaccatgttgtcttttggaactcgagaacttaagctctgttttctatgtcatctatggttctaagtctgaaacactgtggtgatgatgtagaatgtgat

SEQ ID NO: 539 - DNA, 1319 bp, Arabidopsis thaliana
ttaattaacgacccatcaaccttcagatgactaaaggtggacttggaatagccgcgatgtcatacgtggtaatcgattacatgcgttacgtgtcaccggtgtggcattctcgtcttatgccagttctttggtctgttcttgctatcgccgtcgtcactcgtgttctgttctataaacactggtctaaagagctacgagcagctattcctttccttggttctatcgtattccttctctgtgctcttctctttgaagctctttgtgttcgctctgttactgctgttcttggcttagattggcaccgggaaacacctccacttcctgatacaggccaatggttcttacttgcactaaacgagagccttcccgggacacttgtggaaatcctaagagcacatatcattggattgcatcattttcttatgttgtttataatgttgggtttctcggtggtgttcgactcagtgaaagctccaggtttaggattaggcgcgagatacatattcacgatgggagttggacgtcttttaagagctataacctttgtatcaactatattaccttcagctagaccttggtgtgcttcagcccggtttaacaatgtaccttctcagcctcatcgttgggctcagaaatattatgtcccttatgctaatgatcctgctgcaattagaaagctccttcattgggatgcagcttatgctgatccaggaagttacattggtgactatagagctgattggggttcaatgagcttccttagtgagttcttgagaccgagttactctgaagggtcttcttggtttgctctattaaagaaagccggaggtggttgtaatgatctcatgtatagtggtcatatgcttgtagctgtcttaaccgctatggcttggacggaggcttatggaggtttctcttctgcaatgatatggttgttcgtggcacacagcgcacagagagaaatacgagagcgacaccattacacagtagactgtattgtggcgatatatgttggtatccttctctggaaaatgacgggttttatctggtcagccgagagaaaaacgaagcagacgaaactagagaagattcagaatagtctgattcacgctgcaaaggatggagacatagagactgtaaggagacttgtggaggagatagaggtaagctctagggtggagaagcagagtaaagtcatctcgaaccggacaatgactgtgtttgcgtgtgccacagtgatcacaacactcactatagtgattctggcattgactttgacaagcgacggctaaaagagaccttcgagggtttggcgcgcc

SEQ ID NO: 540 - DNA, 1218 bp, Arabidopsis thaliana
ttaattaagaagtgaagaacaatgggagctgaaaagaaatggcttttcacactcttctctgtagtattcctctcagtgttccttctcttactttattctatctctgctttcacctctaaaccattcccttcttcaattcgtcacggtgctcattacccacctgcttttgcttattacataaccggtggtcgtggagataatgaccggatctctcggttattgcttgcggtttatcatcctaggaatcggtatcttatccatctgggtgctgaagctactgatgcagagaggctagctcttctctctgatttgaaatctgttcctgctgtgaatgcttttgggaatgttgatgttttagggaaagttgatcgtttgtctgagaatggtgcttctaagattgcttctactcttcacgctgtttctattcttcttaagcttgatcctacttggaattggtttattgagcttagtgctttggattatcctctcataactcaagatgacctatctcatgtgtttgcctcggtgaacagaagtctcaattttattgatcacactagtgaccttgcttggaaagaatctcagagaatcaagcctattgttgttgatccagcactttacttagctagaagaactcagctcttcactgctaccgaaaagcgaccaacaccagatgcattcaaagtctttacaggctcgccttggattgtactaagcagacctttcctagaatactgcatcttcggttgggataatttaccaagaatccttctcatgtattttaacaatgtcattctctctgaagaatgctacttccacacggtgatatgcaacgcaccggagttcagtaacacgacagtcaacggggacttacgatacatgatatgggacagtccaccaaaaatggaaccacatttccttactatatcggatttcgaccaaatggctcaaagcggagcagctttcgctagacaattcaagaaagatgatccagtactcgacatggtcgatagagagatcctgaaacgtggacgttacagagtcactcctggcgcttggtgctcgagccacagtagctggtggacagatccttgctcggagtgggatgaagtaaacattgtcaaagctggacctcaagctaagaagctagacgaaacaataacgaattttcttgatgatttgaattcacaatcgaatcaatgcaagtgatggcgcgcc

SEQ ID NO: 541 - DNA, 595 bp, Arabidopsis thaliana
ttaattaacgcttacataaaaacgcgacctttgagaattttgtccggcgacagaaatggcggggttagggttacggctaaaggcggcaaaatggacgttgaggagcggatcaggtgctgtatcgagagaatggtcgtcggagatggggaaaggtgttcgtcgattctctactgaaacagagaacgatgttccaacttcaggaatcagtagaccactcgctgagattctcaaggagcttaacaaaaaggttccagattcagtcatccgaactcgagttgaagatgggtgctccatcaaatacatcccttggcacattgtgaatcggatcatgaatatgcatgctccagaatggtcaggagaagttcgaagtgtcacttactctcctgatggcaacactgttactgtggcttatcgtgtgactctctacggcactgatgctgagatatttagggaatcaacaggtaccacatctgtagatgacaaaggctatggtgatgctgtgcaaaaggcggaagcaatggcatttcgccgtgcgtgtgcaagatttggattagggcttcatctttatcacgaggatgctttgtaaaggcgcgcc

SEQ ID NO: 542 - DNA, 3338 bp, Arabidopsis thaliana
ttttatacgttcagtacaaatttgagagcttttatgttgacttcaatttgtaaccagtgtatcaattctgggattttaattttcatcattgcattatatattaggtgtatcaagtaagcaatgagttcttcaccgtcgttggagattttaggtacatatctctgaaactcaatttcattcttcgagttatgtttaaatgtctctctcttatctaaagtcgcttttctgtgtagttagagaagctgaaggcttcactgtgtggaatggtcctccatttactaatggccagcccactctcaagcttgaacgagtttcatgctctaacacgaagttcagtgttgatggatcgaagttaatggcgatgaaatctgatggagttattagtatctatgatgccaccagcttgacagaagtgcggtcattcactatagcaaatgttacagctgctgagctatctccatgtgggacttatcttcagacttttcaaaaacccactactccccaagagaagaatgtctccatttggaatactgagacaggggatctagcacacagtcattaccaaaaatccattactaaagcctcatggtaagcaggtctcagtgctttattggcatcatatatgatgcatcaattatagatagtccttgtgcttattatgctgcttttataataacgagtgtttctgtggttgctctataggccatcaattcgcttctgtcctgatgaatcttctgcgtgccggttagctacaaatgaggtccaattctttgacccgaaagatttctcgaaaggaataacatcccggatcagagttcctgggattgctgcatttgagctttctaaaacgccagcttcccatgttgctgtgtttgttccagaatcaaaggtacttttcactgcttgggctatcgcattatacttttgaatagcaaaaaaagacatcttttcttctatatgttaaatctgttgcagtcttctctctcacaaagtagtctattttcattcctgaagttgcagaacatcatgtgtataaatgtttcctctatagacaagcaactctaacatgttaattcattcatatataggggagtccaggcagtgtccagatttttggatgtggggaagaattgcagagccagccaagtgctcgacgtagctttttccgatgttcctctgtgcagtttagttggaaccatggttccactggactcctagtggttgtacaatcagatgttgacaagaccaaccaaagttactatggggaaacgaagctacactaccttacaatagacggcacacatgagggccttgttccattacgtaagtcctaagctttatgtatctgctgttgtgattgttggttgtactgactctttggtgctttaacaggtaaagaaggaccagttcatgatgttcagtggtccttttcgggttcagagtttgctgttgtatatggctgtatcctttttccatcagctataacgacttatctctacgagttcatttaggaataatgttttttcattgacatgttaatatcattgtgttcttgttaagatgttatttcgatttggatctatatactccttctggcattgctttccctcaactccgacttcagttatgcctgcttgtgtgacaatctttgacaagaattgtaaaccattgatggaacttggcgaaggtccttataacactcttcgatggaacccaaaagggagaggtatgatgcttttcttcatccctgttttctgttgtcctctcgtttttgtttcttcttaaacagaggatttctgtacatacctgtttttgtaactttcaatcgatgttccacagttttatgtgtggctggattcggtaacttgcctggtgatatggtaaataacgatcccttgtgttgttcatatttttcagttctcgggtgacaataagtcagcaattgacattctaaacgattctttctaaatggttatatttcaggccttctgggatgttgtaaataagaagcagctaggaagtaataaagccgagtggtctgtgacaagtgaatggtctccagacgggcgttatttcttgactgcctcaacagcaccaagacgtcaaattgacaatgggtatgttaatacttcttccctcataattgagtgatacaatgagtactatgcatcgtgcatcaattgtttgttttcatacccgcctattttaatccatcacttttgacttatgaaccaaccagtcagagatggtattattctttttttctccttggtttaaagttgtgttctatatctttcgtctttgtcctgactgaaggatgaaaatcttcaactacgacggaaagcgttattataagaagatgtttgagaggctgtatcaggtatgtgtctcttaaacagctttgaaaagcatacattgattattataattgtcttactggagtgctatgatttttacctgcaggctgaatggaaaccagagtctccagagaggttcggtgacatcagtgaacttatcaagtcagttgaatcattgaaactcggcgagggcaaatcgcaaggtcggaaattcttggttcaaatgcttgaaactgtctctaattatgagatatttttgttaacttatcatgttcttaaccaatttctacttatctatcttaggacaaggatcagctcagaagaaaactattgcccccaatcctattgcacagaaaccggccgcatatcgacctccgcatgctaagcatgcagctgctgttcaagccgaggtaactcaacaacttttcaataatcacccgtgatatcaaattactaattattaaccatacagtcatgattctgtctcatacttgaaacaaaaaacgaaaataactcaagtttctctcaatgagcccttaaatatgcgtgtccataaccatatggccttaaatatacactgctactaccgttttcgattgaacatttggcatcacatatcattatgtctctgatagtttttattatttgaaattgcagttacttggaataagcacaacagggtaagtctctatcttgtaatacatacataaatctcaaaaactgtcgctcttatgttgatggagactcctctggtgttaatacagagagatgagcaagaacgctcttaaaaacaagaagaagagggagaataagaaagcggctgcggctgcggctgctgcttctggatctaacaacgcctgattgaagaaatcacactccgatatcaaattcaatggagatcacagttttgaaattcatttgatggtaataaagattctatagaagacagaaaacattatgtaaacagttgttttttttttg

SEQ ID NO: 543 - DNA, 356 bp, Arabidopsis thaliana
ttaattaattatccgccgtgctaatctgaatctcctcccccgtcggaaaaaatggccactggtggaaaagtctccttcaaagtcactctgacttcggatcctaagcttcctttcaaagttttcagcgtaccagaaggagctccgttcacggcggttctgaaattcgcagcagaagagttcaaggttcctccacaaaccagcgccatcatcactaatgatgggatcgggatcaatcctcaacagagtgcaggaaacgtttttctgaagcacggatctgaactaagattgatcccgcgtgatagagttggagctgtgtttgtgatggatccatagatgatgtgtaagcaaggcgcgcc

SEQ ID NO: 544 - DNA, 1083 bp, Arabidopsis thaliana
ttaattaattgggttttgaaagaagagcaatgagcaattatgcagccgggctcggtaaacctggctcaggtaatgacagattctttcttttgtgtggtgaagaattctatagatttagagaaatttctagacttttttatgttttcatggcgtcacaatggttctgattatgttgtgactcaatccacattgtgtgtttaacaggtaaaaggagaatcagagatcttttaaatcaacctgataaccgagtctgcgctgattgtggcgcttctgttcctaaatgggcgtaagtcatcgcttctaagcctctttttttcttatcttattgtagttttgctgataaacaacatgtcatttagtatagctaatcttatgataatacaatgtctttggttctgtatgttctctgttcatttaggggttaatctacaacgtcaaaactctgatagagttgttgaaaatctcacatttctttaccataactgaaagttacttattcgcattatgtgattagagcttcatctacatgttcttgtgtctttagttatattagcatactccagagcagaagtctatttatgcttggtgtagttcttacatgtaagcacgcattatgcgattagagcttcatctacatgttcttgtgtctttagttatgtatctttgtgtttgttcttatattgaataatcagttagtagcttgttttcagatcagcaaatatcagagtattcatttgcttaaaagttgcggtgtgcacagaagcctcggcactcatattttaaaggtgacatatcttctttgctttattacattttggtttcattgtgtactcattgtttggtttctccaggttttgtctgtgacacttgatgaatggtcagatgaggaagtcgattccatgattgaaactggaggaaatgcgtctgctaattcaatttatgaagcttttgtacctgacacatgctctaagcctggacctgatgttaatcatgaccagcgtatgagattcattaggtaagatttgaaaccatctgtgttgaaatttgaatctatgccttctcttcccttgaactcggcgcgcc

SEQ ID NO: 545 - DNA, 694 bp, Arabidopsis thaliana
ttaattaattttttgttctacatgggagccagattttcacgtatagcgaaaaggtttcttcctaaaagtaaagtaaggattttgatggttggtcttgatggttcagggaagactaccatcctttacaagttgaagcttggagaagttgtcacaacagtgcctactattggtttcaacctcgagacagtagaatacaaaggcatcaatttcactgtatgggatataggaggacaagagaagattcgcaaattgtggagacactatttccagaacgcgcaggggctcatctttgtagtggacagcagcgatagtgaaaggttatcagaagctcgaaacgagctgcatcgcatactaaccgataatgaactagaaggtgcatgtgtacttgtctttgcgaacaagcaagattcgagaaatgctttacctgtagccgaggttgccaacaaacttggtctacacagcctatccaaacgttgttggcttatacaaggaacctcagctatctctgggcaaggattatacgaaggacttgagtggctatcgacaacaatccccaacaaacccgaacggtctacttcggttagtagtttccggagtgattcctatgagaggaagctggtccgaggtccgaggtattaaaaggctttaaatggttactccaacgtaaaaaacagaacgcaccagaaggcgcgcc

SEQ ID NO: 546 - DNA, 1789 bp, Arabidopsis thaliana
gttcaaagtgaaaacagaaatagtgttgattctcttattactgttgtctcaggagattctttcctacataggaattgagtttaaggtggaattcttctgttattttgttgttgcacgaaaatggaggacattgagaacatagaagaagatgagtatgggttttcaagaaactacttcttggcaaaagaattgggtggggcgagtaagcgttctgcccacaagctctctgatatacatattgttgatgagcaggtgagttttgttgggtatgctcttttaaattatgcttttggtaatagatactttccttgacaagttgatggagaagcattgtgtgtttacaggagcttagagaaacggcttctacaattgaaatgaagcactcgaaagagatatctgagcttatgagtgattacaagactatgtactcaaagtgggtctttgagctcaggtgagaaaagctcttacttttgaagctagaacctgaatattttagtttgtctatatacttctggtgttctcaattcttgttgctgcttccaggtgtggctttggccttctaatgtatggctttggatctaagaaagctttagttgaagattttgcttctgcttctttgactgactattctgttgtggtcatcaatggctacctcccttccgtaaatctaaagcaggtactcttttgtcagtttggatgcagcaattttttctcttgcgcagctctatgttcttcaggttggaaaagaagtagttttaaatgatgactaattgttcttttctgtgttgcaaatttaggttcttttggcattagctgaacttctatccgagcttttgaaatgtaaaagaaagagttccgggagtttgtctaaaggtcaagaaacatttccttcacgctccatggatgatattctttcctttctacatggtccacagtctggagataaagactgcttcatatgcgttgttgttcataacattgacggccctgctctaagagatcccgaatcacaacaaactcttgcccggctttcttcttgttcacacatacgcttggttgcctctattgaccatgtcaacgctccattatgtaagcactattctctatctctcctgctaattgcttatcatggctgaggtctattgcaaaaaaattctgttcactgctatctgtcaaagacttctaagaccttatgtactgcttatttgacctgaggctatgtttcttgtgtccattggcagtgtgggacaagaaaatggtgcacaaacagtttaactggctatggcaccatgttccaacatttgcaccatacaatgtcgaaggtgtattcttcccgttggttcttgcacagggaagcacagcccaaaccgccaaaacagcagccattgttttacagagtttaacaccaaacggtcagaatgtcttcaagattcttgctgagtaccaactttcacacccagatgaagatgggatgcccactgatgatctgtattcagcgtctcgggaacgcttctttgtgagcagtcaagtgactttaaactctcatctcacggaatttaaagaccacgaactggttaagaccaagagaaactccgatggtcaagagtgtttgaatataccgctcacttcggatgcaattcgacagcttttgcttgatctcaatcagtagcctgaaattgtatttctgatatgattcatttttattgcttgaacgagttattatagttcacacagtttacatgtttaattgaatgttatagtcagcactcacagctcttattatataatc

SEQ ID NO: 547 - DNA, 1146 bp, Arabidopsis thaliana
cctttgatcaattcaagtttgacacgcttctctcgaatccttctaacatataatagatccatcggatcctccaaaaccacaagttaaaaaaattattcaagaaacacgagaacaaaaacaatggcgaaattattcatcaagcaagcagagcaatatgcagcagcccgacccagttaccccaccaaactcttcgaatatatcgcatcgaaaacaccgtgccacgaccttgcctgggacgttggcgccggaagcggccaagcctcacgatcggtataatagtgttgttcaaatctccaaataactcatgttagtctttcaatcttgattcaaaattctatatcattttaatcttgtccttcttttcagctagccggaatctacaagaacgtgattgctacagacacgagctcaaagcaacttgaatttgctgcaaagcttcccaacgtccgttacgagatcactccaccgacgatgtcttcatcggagatcgagaagctagtagcacctgaatcatcagttgatttagtcaccgtcgctcaagcccttcattggttcgacctcacgaacttttacagcaacgtgaaacacgtgctcaagaaacccaacggagtaatcgccgcctggtgctacaccaatccggaagttaacgacgccgtggacaaggtctttcaacggttttacgatgagaaacttggtcctcattgggatctagcgcgacggcttgtggaggatgggtacagaggaattgagtttccgttcgagaaagtggataatgatgagtcaacggaaagtcaaagttttccggtgaggtttgtaacggagaaagaaatggtgtttgaagagtatatgacgtatctgaggtcatcttcggcgtatcagacggctaaggagaaaggtttagagcttttgacggctgagatggaaggagagtttgctggttcgtggaaagaagatgggaaagagaagaaagttgttaggtatccgatttatctgttgatcggaagagttgcagaagaacgtgtataaattgatatctctcagttaggcatttcgtcgaacaccttgtgcttacacacaagaagacattagttttgattggttcaatgtaaaaataaaactttgtcgttccagcattcctggggatct

SEQ ID NO: 548 - DNA, 1394 bp, Escherichia coli K12
aaaaaagcaggctcctgcaggaccatggatcagacatattctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaactcgagacccagctttcttgtacaaa

SEQ ID NO: 549 - DNA, 1327 bp, Escherichia coli K12
aaaaaagcaggctcctgcaggaccatggcgcaacaaaattatctggatgaactcactccggcttttacgtctttactggcgattaaagaagcctctcgctgtttattatgtcacgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacccgtgccggtgttgatgctcccattgatatcggccgcttacagcgttttgttactgattttgaacaacaaaccggaatggaaatttatcagcccggtactaaaacgctcggcaaagtcgcgattattggcgcaggtcctgccggattgcaggccagtgtgacactgacaaaccagggttatgacgtcacgatttatgagaaagaagcgcaccccggtggctggttgcgtaacggtattccgcaattccggttaccgcaatcagtgctggatgcagagatcgcccgtattgaaaaaatgggcgtgaccattaagtgcaacaacgaagtcggtaacacactcacccttgagcagctgaaagcagaaaaccgcgcggtactggtcaccgtggggttatcaagcggttccgggctaccgctgtttgagcatagtgacgttgagattgccgtcgacttcttgcaacgtgcacgacaggcgcaaggcgatatcagcattccacaaagcgcattaattatcggcggcggtgatgtcgcgatggacgtagccagcacgctgaaagttctcggctgtcaggcggtaacttgcgtagcgcgtgaagagttagatgagtttccggcaagcgaaaaagagtttaccagcgcccgggagctgggcgtttcgatcatcgatggattcacgccagtagccgtggaaggcaataaagtcacgtttaagcatgtacggttatcgggcgaactgacgatggcggcagataaaattattctcgccgtcggtcagcatgccagactagatgcctttgcggagttagagccgcagcgtaacaccatcaaaacacaaaattaccagacccgcgacccgcaagtctttgctgctggcgatattgttgagggtgacaaaaccgtggtctatgccgtgaaaaccgggaaagaagccgccgaggcgattcatcactatttagagggagcttgctcatgttaacgaaagatctttcgattactttttgcggcgtgaagtttctcgagacccagctttcttgtacaaa

SEQ ID NO: 550 - DNA, 1070 bp, Escherichia coli K12
aaaaaagcaggctcctgcaggttcatgaccgtacgcgtagcgataaatggcttcggtcgcatcgggcgtaatgtggttcgtgctttgtatgaatccggacgccgggcggaaattaccgtggtggcaatcaacgaactggcggatgctgcgggcatggcgcatttgttgaaatatgacaccagccatggccgttttgcatgggaagtacgacaggaacgcgatcaactttttgttggtgatgacgccatccgcgtattgcatgaacgttcactgcaatcgctcccctggcgtgaacttggcgttgatgtagtcctcgactgcaccggcgtatatggctcccgcgagcatggcgaagcgcatattgccgccggggccaaaaaagtgctcttttcacatcctggcagtaacgatctcgacgcgaccgttgtttacggcgtcaatcaggatcaacttcgtgcggaacaccgcatcgtttctaacgcttcctgtaccacgaattgcataattcccgtcatcaaattgttagatgatgcgtacggtattgagtccggcactgtgaccacaattcactccgccatgcacgatcaacaggttattgatgcataccatcctgacctgcgtcgcacccgggcagccagccagtcgatcattccggtcgatactaaactggccgccggtatcacacgattttttccgcaatttaacgatcgctttgaagcgattgcggtacgtgtgccaaccataaatgtgacggcaatcgatttaagcgtgacggtgaagaaacctgtaaaagccaatgaagtcaacctgttgctgcaaaaagcagcacaaggtgcatttcatggtatagttgactatacggaattgccgttggtctctgtagattttaaccacgatccgcacagtgccattgtcgatggcacccaaacccgggtcagtggcgcacacctgatcaaaacgttggtctggtgcgataacgaatggggctttgctaaccgaatgctcgacacgacgttagctatggctactgttgctttcaggtaactcgagacccagctttcttgtacaaa

SEQ ID NO: 551 - DNA, 615 bp, Saccharomyces cerevisiae
ttcttgtttgttgattaacccttaattaatccgggcgcgcctgatttatcacaagtttgtacaaaaaagcaggctcctgcaggaccatgtggtttcctcaaatcattgctgggatggctgctgggggtgccgctagtgctatgactccaggcaaggttctctttactaatgctttgggtttaggctgttccagatctagggggttgtttttggaaatgtttggtactgctgtgttgtgtttaacagttttgatgactgctgttgaaaaacgtgaaactaactttatggctgcgcttccaattggtatttctttattcatggctcacatggctttgaccggttacactggtaccggtgtcaaccctgcaagatctctgggtgccgccgttgctgccagatatttccctcattaccactggatctactggattagcccacttttgggtgccttcttagcctggtcagtgtggcaattattacaaatccttgattacactacatacgttaatgccgaaaaggcggcaggtcaaaagaaggaagactgactcgagacccagctttcttgtacaaagtggtgataaattggagctctgcagagctttcgttcgtatcatc

SEQ ID NO: 552 - DNA, 1436 bp, Saccharomyces cerevisiae
ttcttgtttgttgattaacccttaattaatccgggcgcgcctgatttatcacaagtttgtacaaaaaagcaggctcctgcaggaccatgtcgcaccaaaaccagcttattccacaagcttatatttctaactttcataacagattgacaaacgaagatgatggtatccccatctttacaatggctcaacaaacaaggcagcataaaagggctaaagtggtcaactatgcggaatatgacaacgatctctttgatgaattcaatatgaacggttctaatttcaacaatgctgatacacactataaagataatgcagtgtctcatgaaaatactccggcacttacaaatggtgttaccatggacggttccgaatacaatgtcctagagaacatgaatggagctgatagtattatctctaacaacaaatacgatgcgggttcaaacatggttgtggaatctttatccggtttgaatagcaataacaacgccagcaatggtccgagcaacaaagcgcaggcacaggatattggaaacgccgttctaccggatctgcaagaccaacaccacaaccccttcaacatattgagataccctaaaataagagatactttcattaacggaaaagtggtgtctccatatagactcaacactgatcaagaaacgaaggcaaacgccaattctggagaggcaatcatgataccaattactttggatatagaacatatgggtcataccataaaagaccagtttctctggaactacaatgacgactccatatctccggaggaatttgcctctatatactgtaaagatcttgatatgacttccgctaccttacaaactcaaattgcgaatataataaaagagcagttgaaagacctcgaaaatattgcagccactgagataatgtctgacctccacgtgataatcaacctaacctgcaacttacaagacagattttttgaagataacttccagtggaacttgaacgacaaatcacttactccagaaagatttgctacatccattgtacaggaccttggcttaacaagagagttcatccccttaatatctcaatcgcttcatgaaactatcttgaagataaagaaggactgggtagatggccacttgattcaggaccatgtcccaaacgatgccgcatttgggtacttatctggtataaggctggatattgatgaactgggctccaattggtgcccaagggtggaaatattaacaaaagaagaaatacaaaagagagaaattgaaaaagaaagaaacttaagaagattgaaaagagaaactgatagattatctagaaggggcaggagaagattagatgacttagaaaccacaatgagaatgtagctcgagacccagctttcttgtacaaagtggtgataaattggagctctgcagagctttcgttcgtatcat

SEQ ID NO: 553 - DNA, 1205 bp, Zea mays
aactctttgtttcttgtttgttgattaacccttaattaatccgggcgcgcctgatttatcacaagtttgtacaaaaaagcaggctcctgcaggaccatggagcagcggaggtggctcgcagtagccgttttgatgtgcctgctggtgctttgctccgggagagaactgaagaccaaacacgtgcccatatatgacccagtgctggcccggacacttgctgaatatacttctgctgtctatactgctgaccttacccaactgtttacatggacatgtgagagatgttgtgacttaacagaggggttcgaggtgatagagctgattgttgatgtgaaaaattgcttacaggcatatgttggatttgctagagacatgaatgcagttatagttgtgttcaggggcactcaagaaaacagcattcagaactggatcgaagatttattctggaaacaacttgatctcgactacccaggcatgcctgaagcaaaggttcacagtggattttattctgcttaccacaacacaacaatgcgtgacagagttatgagaggtattaaaaatactaggaaactgtatggtgatattcccatcatggtcacaggacattccatgggaggagctatggcttcattttgtgcccttgatcttattgttaatgttgggttcaaggatgtgtcactcatgacatttgggcaacctcggattggcaatgctatatttgcatctaatttcaaaagatatttgccgaatgcaattcgattgatcaatgcacatgatattgtgcctcatttacccccatactatcactactttccacaaaagacataccaccattttccacgagaggtatggattcataatgttggcctaggaagcctcgtatattcgattgaggaaatttgtgatgattctggagaagacccgacttgtagcaggtccgtgagtggaaacagcgtgcatgatcatgtacactatcttggcatcagcatgcatgccgagtcatggggacattgcagaatcgttacggacaatagtaccctgccacagcagtataagatggatcctgatggcaatataatcttgtcgaagcagcctggcttatcagtaaatgaactacacagtgcacaatgactcgagacccagctttcttgtacaaagtggtgataaattggagctctgcagagctttcgttcgtatcatcggtt

SEQ ID NO: 554 - DNA, 2493 bp, Glycine max
ttcttgtttgttgattaacccttaattaatccgggcgcgcctgatttatcacaagtttgtacaaaaaagcaggctcctgcaggaccatggagacacaatcagatggtaatgaggacaacatagctgccattaaaaatatgaggcagcagcttgaaactcgcatagagtcgcaacacaaggctcacatggagatgcttgcttctatgcaaactgtaatacctaatcttgtttcatcccttgacctttctctcaaggttgtgtcttctttcaaccgtcgtccttttgctcctacaccttctctgcctcagcctgatccaaaactgagtcccaaaaaaccggttgaactaactcaccgtttcaatgcggaaacctgtgctgatggctctattgaggcaaacttgacaaatcccaagaatcaaaagcccaaaacatctatgcattcaaactcagcatttcaagtagagtctgagaaggttagtccattagcggtggttcgatcaatggtcactgtttgtctattagggcgagtacccttctcaccgattgattcttccaccgtgtcaaggaaattggaaaatgatcagatggtgacaccaacagagaaggcagcacttcaggaacttggaggggattcgggggcaacacttgcagtggagatagctttaagggcaatggcagatgataatggtggtgttgaagtggaggagtttgtggtgagtggcaaggcaagaattatggttttaaatgtagaccggactcggcttctgagagaattgccagaaagtgtgcagtatcagcaacttgaatcaagttctggagatgggaatgcgaatcaaaatcaagttcagcatatcactcatagtggttctaatgtgaatggtagtttgcctgggatgggaaggctagttccgaggccaatgtctgatatgtggccaccccatggggacccccatatgtcagcattgcagccaatgttttcaggaggaccaaggggagctccacccagagtaatggctatgatgggggcacatagaggtataagtattccttcaatgcatagactcccattggggccaaatgcaccagggggtagtcctaatgcaatgccacagaagccaagaacttatgaggatgatatgaaggatcttgaggcattgttgaataagaaatcatttagggagatgcaaaaatctaaaactggtgaggagcttttggacctaattcaccgaccaactgcaaaggagactgctgtagctgctaagttcaaaacaaaaggtggttctcaggtgaggcaatactgtgacttactgacaaaagaggattgtcgacgtcaatctggttcctttatagcatgtgaaaaggttcattttagacggatcattgcacctcatactgacatcaatttaggagattgttcttttcttgatacctgccgacacatgaagacatgcaagtatgtgcactatgagtatgaccctacacctgatgtgtctccaacaatgatgggcgcccctcctcctccaaaaccgctaaagcctcagcgtgctgaatactgttctgaagtggaacttggtgaaccacaatggatcaactgtgatatacgtaactttagaatggacattttaggtcaatttggagtaataatggcagatccaccatgggacattcacatggaactgccttatggaacaatggctgatgatgaaatgcgcagtcttaatgtccctgctttgcaaactgatggtcttatttttctatgggtcactggacgtgcaatggaacttgggcgggaatgcttggacctttggggatataaacgtgttgaggagatcatttgggtcaaaacaaatcaacttcagcgaataatcagaactgggcgtacaggtcactggctcaatcacagtaaggaacattgtcttgttggaataaagggcaatcctgaagtaaacaggaacattgacactgatgttattgttgctgaggtccgggaaacaagtcgcaaaccagatgagatgtatcctttgctggagaggataagtccaagaacaagaaagctagaactatttgctcgcatgcacaatactcatgcaggatggatgtctcttggtaatcaattgagtggtgtaaggttggtggatgaggggctgcgagcaaggtttaaggctgcttatccagatgtggaggtgcagccactatcacctcccagagcttctgctatggaagtagacactagtattgctcctcacacgaggagtccatttgcagccactgaatcagagtccacttcggcgcagtttgcggagcctgcagccgctccagaaagtaactttgtttcagaggagaaatcaatggccattgatgtggacattggctaagtttccacttttgatcatgattggtaggagcaatgccttgataaagctactcgagacccagctttcttgtacaaagtggtgataaattggagctctgcagagctttcgttcgtatcat

SEQ ID NO: 555 - DNA, 1133 bp, Glycine max
aactctttgtttcttgtttgttgattaacccttaattaatccgggcgcgcctgatttatcacaagtttgtacaaaaaagcaggctcctgcaggaccatgtcaaccgcggcagcggcggggggcgacatggaggcgggtttcgcgaagctccagggcgaggactttgagtattacatgcagacctactccatcgtcctcggccgcaactccaagaagtccaccgtggacgtcgacctatccagcctcggtggtggcatgaacatctcccgccaccacgctcgcatcttctatgactttgcccgacgccgcttcgccctcgaggtcctcggcaagaatggctgcctcgtcgagggcgtcctccacctccccggcaacccccctgtcaagctcgattcccaagatctcctccagattggggacaaggagttctattttctcctgcccgttcgcagcatcttgggcgggcccgtgggcccgaggcattaccctaaccacgctactcccgggccggttgttcctcactataataattaccatttgggccccggcccggtgaagaaggcaccgcggagggagtattatgaggaggagtttgacgatgaagatgatgttggtggaaggaagatgcggagggatgggtatgatggctatggctacgctggtggcaagtcttcgctgtcagcacctatggataagaagtctgaaggcagatcccgagtagatcgagatgctgataatcttcagcttcagcagctggaagaaaaggatgtagtatcatctgtagctactgttctttctgatctctgcggtcctggagagtggatgcctatggagaaacttcataccgagctgttggagcaatatagcagtgtttggcaccacaacagagtgaggaggtatctcacatcagaagattggcctggtcctgaatccaaagggaagccttggtatggcttgcttatgctgttaaggaaatacccggagcattttgtcatcaacacaaggtccaagggccgtgtcacccatgagtttgtttctcttgtctctcttctatcgtgactcgagacccagctttcttgtacaaagtggtgataaattggagctctgcagagctttcgttcgtatcatcggtt

SEQ ID NO: 556 - DNA, 567 bp, Zea mays
aactctttgtttcttgtttgttgattaacccttaattaatccgggcgcgcctgatttatcacaagtttgtacaaaaaagcaggctcctgcaggaccatggcgtcaatcgggtcttccaacatcggattccagctgctgaagaagtctggttggaaggagggcactggccttggagcgcaggagcagggaaggctggaacctgtagagactcgtgttaagaataacaagcgtggtataggttctaaagaaccaaaaccacagcctaaggttggggatgacattgaaacacatcctcaaaagcccaaggaaatgcaatcaaagaaaagggcaaaattagctgcaaagaggataagaaaaatgcaagaagaggagaagcgcttgaaagagaaggaattcgagatggcttttttcagggaattttggcctgataatgtgtaaggcagaaacttcaacacttgacaatgtagctgctgctttgcctgatatctcgagacccagctttcttgtacaaagtggtgataaattggagctctgcagagctttcgttcgtatcatcggtttcgacaa

SEQ ID NO: 557 - DNA, 848 bp, Zea mays
aactctttgtttcttgtttgttgattaacccttaattaatccgggcgcgcctgatttatcacaagtttgtacaaaaaagcaggctcctgcaggaccatgccccccgtcaaatggttgatgcactggcatccgagtcccggggcgacgctcaacagccagatcctggcggaggcgtgtggctgcgccgagtccctaggcggctccaaggacgggcggtggaagacctccatcttcttctaccgcgccatgacccgggacggcgcgggaggccccgcggtgcagcagcaccccgacttgcctagggagctcctcggcgtcgcgctccacgagcgcccgggtctctacttctccatcgtccgcgcccagcgcctcgttctccaggccgatgcggcgttcccccaggtcatggagaagctccagtcatacagaatccgcgtcgccctcaacttcgaggggtttcagtatcaactgggtgatttctgcctgaggataggaaaatgtgttcccaataattctgaagcactgagaggaatcatgatggaggtagagtattatcccctaacttccattgaaaaatccaaggcagtcatggaggacttctttgacatatggcaggaaacagttgcgaagaagtcattacctggtcaattcattcatgtagactcaaacttttcagaatatggtctttcagatcaatattcttttcaacatactgcagttcaatatgcaacttgcttgcagcagctcatggctgcagtaacagtaaggggttagctcgagacccagctttcttgtacaaagtggtgataaattggagctctgcagagctttcgttcgtatcatcggtt

SEQ ID NO: 558 - DNA, 1103 bp, Zea mays
ttcttgtttgttgattaacccttaattaatccgggcgcgcctgatttatcacaagtttgtacaaaaaagcaggctcctgcaggaccatgaagatcatcattgacacggatcccggcatcgatgacagcgtggccatcctgatggcattccagatgccgggcgtccaggtcctagggctcaccaccatcttcggaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaagatcgttgtgctgggtggagcgttctttgcggctggaaatgccactccttccgctgaagcaaatatccacagtgatccggaggcagccgacatggttttcacttctggggcggacatctacgtcgttggcctcaacatcacaacgcaagtcagcttcacagataaggatctcctggagctaagaaactcgcaagggaagtacgcacagttcctatgtgatgtatgcaagttctacttggactggcacaccgagtcttatggtgctcctgtgattttcctccacgatccggtcagctttgccgcgctagttcgtccggagctgttcacgttcaagaagggcgtggtgagggtggagacgcagggcatctgcgtcgggcatacttccatggacatgttgctgaagaagtggaactcagagaacccgtggactggctactcaccgatttcggtcgcatggacggtcgatgtgcccaaggtggtcgcgtttgtgaaggagctcgtcaccaagccgtgactcgagacccagctttcttgtacaaagtggtgataaattggagctctgcagagctttcgttcgtatcat

SEQ ID NO: 559 - DNA, 899 bp, Zea mays
ttcttgtttgttgattaacccttaattaatccgggcgcgcctgatttatcacaagtttgtacaaaaaagcaggctcctgcaggaccatgctcgggttcaggcagatgccgtggtcgtcggcgcaggagcaggagcaggcgccgtcggagcagctgtgcgagggggtgtcggccgtcgtggcggcgcgccaggggatggagaagccgctgacggctgtggcggaggcgttcgaggagctggcgcgcggcatggaggccgatggcggggagctccgcctcgctcccttcagcgactcctgcgctctcgtctccgtgctcttcagcagcctcgggatggccttcaggttcgccgagatcgagtacgtcaccaaggtgaacgatctcatcggtgccggcaagtcgtaccgcacgttgagcgacatcctcgacaaggacatccagaatgactgcgtgaagaagcagggaagccactcccggaacttacgcagggtccgtctcggcctcggcctcattaaagccctcttcgagcaattcctcgataccgaggggacattgtatgatgctgctacgatagcttacgggcaggtctgcgcgccgtttcatagctgggcgatcaggaaggctgttggtgctggcatgtacactcttccaactagggagcagttgatagtgcggctgaatgaaactgatttctccgtgcagaaggagatgaggagatacattgatgcttctagtcctatcatagagtacatcgacaaccttttcctctcgaggaacattagcctagattggtgagctgatctgaactggactggactgaagatcaagtctctcgagacccagctttcttgtacaaagtggtgataaattggagctctgcagagctttcgttcgtatcat

SEQ ID NO: 560 - DNA, 1240 bp, Escherichia coli K12
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctgccaaacatccggtcattgcggtaacaggatccagcggcgcggggaccaccaccaccagcctcgcgtttcgtaaaatattcgcgcagttaaatctgcatgcagctgaggtggaaggcgacagttttcaccgttacacccgcccggaaatggacatggcgatccgcaaagcgcgcgacgccgggcggcatatcagctacttcggccccgaggctaacgacttcggcctgctggaacaaaccttcattgaatacggtcagagcggcaaagggaaatctcgcaaatatctgcatacctacgacgaagccgtaccgtggaatcaggtaccggggacattcaccccctggcaacctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcagtagtgcgttcaatggaagactatatcaactacatcacaccgcagttttcccgcacccatcttaacttccagcgcgttcccaccgtcgacacttcaaacccgttcgcggcaaaaggtatcccgtcgctcgatgaaagctttgtggtgatccattttcgtaatctggaagggatcgatttcccctggctgctggcgatgttgcaaggctcattcatttcccacatcaatacgttagtggtaccgggcggcaaaatgggtctggcaatggaattaattatgctgccgctggtgcaacgattgatggaaggaaagaaaatcgagtaaatttaaatacccagcaaatacccagcaaattggagctctgcagagctttcgttcgtatcatcggtttcgacaac

SEQ ID NO: 561 - DNA, 951 bp, Synechocystis sp.
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctgcttatctgtttaatcaagaaaatgaaccggatgaaagcgatagcataacgctctacgatgaagcggggcggcctttagattgctacgtggaaaactccctcgaacaagaggacgctcaatacttattattgatgcccgttgacatcccggtggtaattattgcctgggaagaagatgacgatgaaacagaagatgctgaggcaattttactagaggaccaagaagaaattagtggcatttttgcagatgctaaggccgtactggcagaattagatttgtcgttgaagtacactgcctacaccctcaccgtcagtggtgaactgccccccattgaagatgaagatattctcaccctggaaattgaagggaacgatccggctggggaaatggaagaggaagaattgcaattcctggctagtttttaccacgaggaagaacgctatagcatttacactcccctagcgcctttattatttcttgctaaagccattagtgaaacacaaattgagttggtgcaccccgacaatgatgaactcaaacatattctagaagagcttttatttgaagatgcggactaaatttaaatacccagcaaatacccagcaaattggagctctgcagagctttcgttcgtatca

SEQ ID NO: 562 - DNA, 1411 bp, Synechocystis sp.
ttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggttggtcttattggtcatctcacgagtttagaacacgcccaagcggttgctgaagatttaggctatcctgagtacgccaaccaaggcctggatttttggtgttcggctcctccccaagtggttgataattttcaggtgaaaagtgtgacggggcaggtgattgaaggcaaatatgtggagtcttgctttttgccggaaatgttaacccaacggcggatcaaagcggccattcgtaaaatcctcaatgctatggccctggcccaaaaggtgggcttggatattacggccctgggaggcttttcttcaatcgtatttgaagaatttaacctcaagcaaaataatcaagtccgcaatgtggaactagattttcagcggttcaccactggtaatacccacaccgcttatgtgatctgccgtcaggtcgagtctggagctaaacagttgggtattgatctaagtcaggcaacggtagcggtttgtggcgccacgggagatattggtagcgccgtatgtcgttggttagatagcaaacatcaagttaaggaattattgctaattgcccgtaaccgccaaagattggaaaatctccaagaggaattgggtcggggcaaaattatggatttggaaacagccctgccccaggcagatattattgtttgggtggctagtatgcccaagggggtagaaattgcgggggaaatgctgaaaaagccctgtttgattgtggatgggggctatcccaagaatttagacaccagggtgaaagcggatggggtgcatattctcaagggggggattgtagaacattcccttgatattacctgggaaattatgaagattgtggagatggatattccctcccggcaaatgttcgcctgttttgcggaggccattttgctagagtttgagggctggcgcactaatttttcctggggccgcaaccaaatttccgttaataaaatggaggcgattggtgaagcttctgtcaagcatggcttttgccctttagtagctctttagatttaaatacccagcaaatacccagcaaattggagctctgcagagctttcgttcgtatcatcggt

SEQ ID NO: 563 - DNA, 1343 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggccattgataacatccgtcttagaaacgaatttattaacaccgaagttattacccgcagcagcggcaaaaaactgggggtagtcaaagaagtgctagtcgatgtcgatcagcgagaaattgtcgccctgggactgcgggacaactttttgtctttaaccgggatgccccaatatctttacctgaacagtattgtccaaaccggggacgtggtcttagtagaaaacgatgatgtttttgaattggtggaagtggacctctattcccctctggtcaatagcgaagtggttactgaaacgggagaacccctgggtagggtaagggattttcagtttgacctcgccactggcaaagtttcctccattatcatcgcttccttgggattaccccaaattcctgaccaacttatcagcacctacgagctttccattgacgaggtggtgagcagtggtcccaaccgtttgatcgtttttgaaggagcagaggaaagattaaatcaactcagtgtgggattactggaacgccttggcattggccgtccttcttgggaacggatggaagaggatttgtattatccccccactacccgccctgaaaatcaattgggcagtggcatccccgtgcggccaccggtacaagtccgtcaaccggagcccgtgttggaagagcgttggaacgaggacgattggcaagatacccgccctgcgccgccccctcgtcgggaagtggcccctctgcgttatccagagccggaatatgaagatgattatgaagtggataattggggggaagcgtcttcccgttcttctgctccagaaccggattatgattatgaagatggagtggctggcgatgtctgggacgacgatgaggcccctgctccctacagccctccccgggtgaatattccggaaacccgccgggaaaaaatgcctgaatattatgaagaatagtctctgatttaactagtcttgcgcctttgttcggttattcgtatttaaatacccagcaaattggagctctgcagagctttcgttcgtatcatc

SEQ ID NO: 564 - DNA, 1856 bp, Pseudomonas fluorescens
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacccgtttcgaactgcaaaaactctacatcgatggcgcgtactccgacgccggcagcgatgccaccttcgaagccatcaacccggctaacggtgaagtcctcgcacacgtgcaacgtgcgaccaaggaagacgtcgagcgtgctgtggtcagcgccgaaaagggccagaaaatctgggccgcgatgaccgccatggagcgttcgcgcatcctgcgtcgcgccgtcgacatcctgcgcgagcgcaacgatgaactggctgccctggaaaccctggacaccggtaaagccttctccgaaaccaagtacgtcgacatcgtcaccggcgccgacgtgctggaatactacgcaggcctggtacccgccatcgaaggcgagcagatcccgctgcgtgacacttccttcgtttacacccgtcgcgagccgctgggcgttgtcgctggtatcggcgcgtggaactacccgatccagatcgccctgtggaaatccgcgccagccttggcggccggtaacgcgatgatcttcaagccaagcgaagtcacatcgctgaccaccctgaaactggctgagatctacaccgaagccggcgttccgaacggcgtgttcaacgtactgaccggcagcggccgtgaagtcggcacctggctgaccgagcacccgcgcatcgagaagatctctttcaccggcggcaccgacaccggcaagaaggtcatggccagcgcttcggcttcgtcgctcaaagacgtgaccatggaactgggcggcaagtccccgctgatcatctgcgacgacgccgatcttgatcgcgccgccgacaccgccatgatggccaacttctacagctccggtcaggtctgcaccaacggcactcgcgtgttcgtgccgagccacctgaaagccgctttcgaagccaagatcgtcgagcgcgttgcgcgcatccgcgttggcaacccggaagacgaaaacaccaacttcggcccgctggtcagcttcccgcacatggaaagcgtgctgggctacatcgccaagggtaaagaagaaggcgcccgcgttctgtgcggtggcgagcgtctgaccgacggcgaattcgccaaaggcgcgttcgtggctccaaccgtgttcaccgactgcaccgacgacatgactatcgtccgtgaagaaatcttcggcccggtgatggcgatcctgagctacgaaaccgaagaagaagtgatccgtcgcgccaacgacaccgacttcggcctggccgccggcatcgtcacccgcgacctgaaccgcgcgcaccgcgtgattcatcaactggaagccggtatctgctggatcaacgcctggggcgagtccgacgcaaaaatgccggttggcggctacaagcagtcgggcgtcggccgtgagaacggcatcagctcgctgaacaacttcactcgcatcaaatcggtgcaggtcgagctgggcgattacgtctcggtgttctaactcgagacccagctttcaaatacccagcaaattggagctctgcagagctttcgttcgtatcatcggtttcgacaacg

SEQ ID NO: 565 - DNA, 2495 bp, Saccharomyces cerevisiae
ttcttgtttgttgattaacccttaattaatccgggcgcgcctgatttatcacaagtttgtacaaaaaagcaggctcctgcaggaccatggggtcgtttcccttagctgagtttccattacgtgatatccctgttccttatagctaccgtgtgtctggcggtatagcttcctcaggtagtgttactgcgcttgttactgccgctggcactcatcgaaactcgtccacggctaagacagttgagacagaagacggcgaagaagatatcgatgagtatcagaggaaaagagcagctggttctggcgaatccactcctgaacgcagtgatttcaaaagggtaaaacatgataatcacaaaaccctccatccagttaacttacagaacaccggtgcagcgtctgtggataatgacggtctgcacaatttaacagatatatccaacgatgcagaaaaacttttgatgtctgtggatgatggttctgccgcaccttctacattgagtgtaaacatgggagtggcatctcataatgttgctgctcccactaccgtcaatgcggcaacaataactggcagtgatgttagtaacaatgttaatagtgctactattaacaatcctatggaggaaggagcgctgccgttatcacccactgcttcctctccaggtaccacaactcctttagctaaaactacgaaaactatcaacaacaataataatatcgccgatttgatagaatccaaagattctataatctcccctgaatacctttctgatgagattttcagcgcaataaacaataatctccctcacgcatacttcaaaaatttattatttagattagttgccaacatggataggagtgaactatccgacttggggactttaatcaaggataatttaaagagggacctaataacgtctttgccttttgaaataagtttgaaaattttcaattatttgcaattcgaggatattataaattcccttggggtctcccaaaattggaacaaaataattagaaaatctacatcgttgtggaaaaaacttctgatatcggaaaattttgtgagcccaaagggttttaattctctcaatctcaaactctcccaaaaatacccaaaactctcacaacaagatcgccttagattatcttttctggagaatatattcattttaaaaaattggtacaatcccaagtttgtaccacaaaggaccacgttaagaggccatatgacgagtgttattacgtgcttgcaatttgaagataattatgtcattacgggggctgatgacaaaatgatcagagtttatgattcgataaacaagaaatttcttctacaactatcaggtcatgatggtggggtttgggcattgaagtatgcccatggcggtattttagtcagcggttctacagacagaacggtgcgagtttgggatattaagaaaggttgttgtacccatgtgtttaaaggtcataactctacggtgaggtgcctagatatagtagaatataaaaatatcaagtacattgttactggttcgagagataacactttgcacgtttggaaattgcccaaggagtcctccgttcctgatcatggggaagaacatgattatccattagtctttcatacccctgaggagaacccatattttgttggtgttttaagaggacatatggcatctgtaagaactgtctcaggccacggtaatattgtcgttagtggctcctatgataatacactgattgtgtgggatgttgcgcaaatgaaatgtttgtatattttaagtggacatacggatcgtatttattcgacaatctacgatcatgaaagaaaaaggtgcatctctgccagtatggataccactattagaatttgggatttggaaaatatatggaataatggagaatgttcctacgcaacaaattcagcatcgccatgcgccaaaatacttggtgctatgtacactttgcagggtcatacagctttggtcggtttattaagattatccgacaaatttttggtcagtgccgctgcagacggttcaataaggggttgggacgcaaacgactactctagaaaattttcctaccatcataccaatttgagtgcaattaccacattttatgtatcggataatattttggtgagtggatcggaaaatcagttcaacatctataatctacggagtgggaaattggtccacgcaaatattctaaaagatgctgatcagatttggtcggttaattttaagggcaaaacacttgttgcagcagttgaaaaagatggacagagctttttagaaattctggatttcagcaaagcttcaaaaattaactacgttagcaatcccgtaaactcctcgtcgtcgtctttggaatccatttctacttctttgggtctaacgaggacaactataataccatgactcgagacccagctttcttgtacaaagtggtgataaattggagctctgcagagctttcgttcgtatcat

SEQ ID NO: 566 - DNA, 3226 bp, Zea mays
aaaaaagcaggctcctgcaggaccatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgatcttcatctacaggagacagcagcgaccttgttgacagcatcacttgctacaagaaattctgaacctgtgaattctgctactactgttttgccagctcaagggggctcttctactttagaaaatccttctgatttatccagtcaatcaccagatgtttctggtgccagtgaagttgctcattcaactgatctgatatcacaagttcctaatagcaccgccctttatgaacctcttgagataaatgaaaaagaagggtcaaaatcaaactcggatgataaaactgttgagaagctaggttcaacaagtactgaatttgattgtgatttgcttgatatttcaaggaagtcaaatacggtcagttctgcagattcgaagggagaagacattacaccatcagcaaaaagaaagaacaaagatgatggaagtcacacttctattcccttggaggatactcctagtacactcactaataaaggagtttcttcccagtcacgcgtggaacaagacaaggcaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctctgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgttggtggcaattcaggtgcggggggatactttggttacctgagaaccgtcctgtcttatgtgaatccactctcctacctgaggggaaataccaactcatcaaatacagagctacagtcaaatgaaggcctgcggcagcttagacatggatctggtccatggagtgagccacggcctcttggcaataggggccatgaagtgactgatgcagactctgcaaacacgctgcgaaggcggcctagaccatttggtgccaatatccacactctggggagcgaggatcatggtccgtctgatgaaagaaatgttttctggaacgggaactcgacagagtttggaggcgacgacagaaaatagctcgagacccagctttcttgtacaaaaaaaaagcaggctcctgcaggaccatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgatcttcatctacaggagacagcagcgaccttgttgacagcatcacttgctacaagaaattctgaacctgtgaattctgctactactgttttgccagctcaagggggctcttctactttagaaaatccttctgatttatccagtcaatcaccagatgtttctggtgccagtgaagttgctcattcaactgatctgatatcacaagttcctaatagcaccgccctttatgaacctcttgagataaatgaaaaagaagggtcaaaatcaaactcggatgataaaactgttgagaagctaggttcaacaagtactgaatttgattgtgatttgcttgatatttcaaggaagtcaaatacggtcagttctgcagattcgaagggagaagacattacaccatcagcaaaaagaaagaacaaagatgatggaagtcacacttctattcccttggaggatactcctagtacactcactaataaaggagtttcttcccagtcacgcgtggaacaagacaaggcaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctctgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgttggtggcaattcaggtgcggggggatactttggttacctgagaaccgtcctgtcttatgtgaatccactctcctacctgaggggaaataccaactcatcaaatacagagctacagtcaaatgaaggcctgcggcagcttagacatggatctggtccatggagtgagccacggcctcttggcaataggggccatgaagtgactgatgcagactctgcaaacacgctgcgaaggcggcctagaccatttggtgccaatatccacactctggggagcgaggatcatggtccgtctgatgaaagaaatgttttctggaacgggaactcgacagagtttggaggcgacgacagaaaatagctcgagacccagctttcttgtacaaa

SEQ ID NO: 567 - DNA, 3940 bp, Oryza sativa
ttcttgtttgttgattaacccttaattaatccgggcgcgcctgatttatcacaagtttgtacaaaaaagcaggctcctgcaggaccatgccgaagcactaccggcctgcgggcaagaagaaggaggggaacgcggcgaagtacatcaccaggaccaaggcggtgaagtacctgcagattagcctcgcaaccttcaggaagctatgcattctcaagggcgtctttccccgggatccaaagaagaaggtggaagggaaccacaagacctactaccacatgaaggatattgccttcctggcccatgatcccttgattgagaagtttagagaaatcaaggtccacaggaagaaggtcaaaaaggcgtttgctaagaaaaataaagatcttgcagacagattattgaaccgaccaccaacttacaaacttgacaggcttattcttgaaagatatccaacttttgttgatgctcttcgtgacttggatgattgcctaacaatggtgcatctttttgctgcgttgcctgctgttgaaggtgaacgtgtgcaagttcagcggattcataattgccgcaggttgagccatgaatggcaagcatatatatctcgaactcattccctgcgaaagacatttatatccgtcaagggcatatattatcaagctgaagttcaaggtcaaaagatcacctggctaactccacatgctcttcagcaagttttaactgatgacgttgacttcaatgtgatgcttacctttttggaattctatgagacacttctgggatttataaacttcaagctttaccattcgataaatgtaaattatcctcctgttctggatcctcgtttggaagctttagcttctgagctctatgcgttgtgccggtacatgtcttctggaagagtacctggaaattcagaacctgctggactaattgaagacaaagagggtgaagacaataaagagagctcaaaaacagatgagtctgaactcagattggcacaacttcaacaccagctcccaactaatgaacctggagcgctgatgcatcttgtacaagaatctactgctgctgatgcagacgacgctgatgccaaagaatgcaggagtttattcaaaaacctgaagttctacctaagtcgtgaggtgcctagggaatctctcttatttatcattccagcatttggtggtaccgtttcatgggaaggagaaggagctccttttgatgagacagatgaagacatcactcatcagattgttgatagaccgacccaaagccacgttttcctctctagggagtatgttcaaccacagtggatatatgattgcgtgaatgctcgcatcatattgccgacagaaggttatattgtcgggagggtgcctccaccacatttatctccctttgtggacaatgatgcagagggttacattcctgagtatgcagagaccattaagaggctgcaagctgctgctcaaagccaggtgttgcctctgccaagtttaggggacgaagatatggaaaattcactggtagaggcaattattgatcgatcagagtctaatgaaattgctgacaagaagaggaagttggagatgctagagaagcagtaccacgatgagctgaggatggaatacgaaggaaagaccttctcaaataggacggcagataaccaaccagatgttgtggacaaaagtgatactaaagaagctgacgatcatatggaggactctcataaacaagccgagaaggatgctgctgacatttccaagacccttatgtctcgcaagcagagaggccttcttcaagcaattgagattaaccaggaaaggaaaaaggacaaggtgaacttgctgaagaaaaggaaaaagaatgctgattccagtgcttcggccaaaggtcgctgactcgagacccagctttcttgtacaaagtggtgataaattggagctctgcagagctttcgttcgtatcatttcttgtttgttgattaacccttaattaatccgggcgcgcctgatttatcacaagtttgtacaaaaaagcaggctcctgcaggaccatgccgaagcactaccggcctgcgggcaagaagaaggaggggaacgcggcgaagtacatcaccaggaccaaggcggtgaagtacctgcagattagcctcgcaaccttcaggaagctatgcattctcaagggcgtctttccccgggatccaaagaagaaggtggaagggaaccacaagacctactaccacatgaaggatattgccttcctggcccatgatcccttgattgagaagtttagagaaatcaaggtccacaggaagaaggtcaaaaaggcgtttgctaagaaaaataaagatcttgcagacagattattgaaccgaccaccaacttacaaacttgacaggcttattcttgaaagatatccaacttttgttgatgctcttcgtgacttggatgattgcctaacaatggtgcatctttttgctgcgttgcctgctgttgaaggtgaacgtgtgcaagttcagcggattcataattgccgcaggttgagccatgaatggcaagcatatatatctcgaactcattccctgcgaaagacatttatatccgtcaagggcatatattatcaagctgaagttcaaggtcaaaagatcacctggctaactccacatgctcttcagcaagttttaactgatgacgttgacttcaatgtgatgcttacctttttggaattctatgagacacttctgggatttataaacttcaagctttaccattcgataaatgtaaattatcctcctgttctggatcctcgtttggaagctttagcttctgagctctatgcgttgtgccggtacatgtcttctggaagagtacctggaaattcagaacctgctggactaattgaagacaaagagggtgaagacaataaagagagctcaaaaacagatgagtctgaactcagattggcacaacttcaacaccagctcccaactaatgaacctggagcgctgatgcatcttgtacaagaatctactgctgctgatgcagacgacgctgatgccaaagaatgcaggagtttattcaaaaacctgaagttctacctaagtcgtgaggtgcctagggaatctctcttatttatcattccagcatttggtggtaccgtttcatgggaaggagaaggagctccttttgatgagacagatgaagacatcactcatcagattgttgatagaccgacccaaagccacgttttcctctctagggagtatgttcaaccacagtggatatatgattgcgtgaatgctcgcatcatattgccgacagaaggttatattgtcgggagggtgcctccaccacatttatctccctttgtggacaatgatgcagagggttacattcctgagtatgcagagaccattaagaggctgcaagctgctgctcaaagccaggtgttgcctctgccaagtttaggggacgaagatatggaaaattcactggtagaggcaattattgatcgatcagagtctaatgaaattgctgacaagaagaggaagttggagatgctagagaagcagtaccacgatgagctgaggatggaatacgaaggaaagaccttctcaaataggacggcagataaccaaccagatgttgtggacaaaagtgatactaaagaagctgacgatcatatggaggactctcataaacaagccgagaaggatgctgctgacatttccaagacccttatgtctcgcaagcagagaggccttcttcaagcaattgagattaaccaggaaaggaaaaaggacaaggtgaacttgctgaagaaaaggaaaaagaatgctgattccagtgcttcggccaaaggtcgctgactcgagacccagctttcttgtacaaagtggtgataaattggagctctgcagagctttcgttcgtatcat

SEQ ID NO: 568 - DNA, 2684 bp, Glycine max
aaaaaagcaggctcctgcaggaccatggatcaaaatagggatgagagctggaggaaattagtgaagaagatgcttcctcctggtgcttccatacctgctgatgcttctaatcttgattactccatagctatggaatatgttggtccaccagtttcatatgaagtaccaagagttgagccctttgatacaaactcaagagcaattcccactgctcaaccactctctggatcacaaagatcaaatactcacggggggcatatggtgattgaaccaatccctctaccggtgtctcgtattgctgttggcgtaacgagctctcctaatcaaagtccaagggtgtcaggaagttcagattctgtggtttctgtcttacagaacccagatctttcttctgcatcaccttcggcttcacctgcttcagttcataatcttccaagcaatcctcctaagccagctaatgaagcgaagagggccccggttgtcacttttaatactgttgatagacctcagaggaaagaggtggaggttgtgaagccagtttatgcggaatacgttggagttttgaacgaaaggaagaaaaagaaaataagagtttgttacaggtgcggaaaagggaagtgggaaactaaggagtcttgcatagtttgtaatgccaagtattgcagcaactgtgtgcttagggcaatgggatcaatgcctgaaggacgcaaatgtgtaacatgcatttgtcagccaattgatgaatcgaggagactgaaattgggtaaatattcaagggtgttgtcccgactgttaagccctctagaagtcaagcaaattatgaaagcagagaaagaatgttctgctaatcagcttcggccggagcagctgattgtcaatggattgcccctgaagccagatgagatggctgaattacttggatgccccttgcctccgcgtaagctgaagcctggtagatattggtatgacaaagaatctggtctctggggaaaggagggggagcaacctgacagaatcataagttcaaacttgaatttcactgggaaacttagccttgatgctagtaatggaaacaccgaggtttacatgaatggtcgagagatcacaaaacttgaattgagggtactcaagctggcaaatgtacagtgtccacgtgatacacacttttgggtttatgatgatggtcgttatgaggaggaaggtcaaaataatattagaggaaacatttgggagaaggcctcaacaagattcgtatgtgccttattctctctaccctttccccatggtcagcctcatgggcaaaaggatgaaactagtcactataccacagttcctaagtatctggaacagaaaaaaactcagaagcttcttcttcttggaattcaaggatctggtactagcactatatttaagcaggccaagtttttgtatgggaacaaattttctgctgaagagcttcaggatgtcaaactgatgatccagagtagcatgtataagtatcttagtattttacttgatggaagagagcgctttgaagaggaggctgtttctagaatgaatggacaaggttctcctggtcaaactatggaaacaggtagcaatggtgaagcaagtaatactagtgaatgcatttattccctcaacccaaggctaaaacatttctctgactggctcctggacattatagccactggggatttagatgccttcttccctgcagccacacgtgaatatgcaccattagttgaagaagtatggagggatcctgcaatacaagaaaccttcaaaagaaaagatgagcttcactttcttccagatgttgccgagtacttcttaagccgggcggttgagatatctagcaatgaatacgaaccttctgaaagggacatagtatatgcagaaggggttactcagggaaatggtttggctttcatggaattttcacttgatgaccgcatcccaaagtctgatacttattcggagaacctggatgctcagctgccaccattggccaagtatcaactcataagggtgaatgccaagggcctgaatgagggctgcaagtgggttgaaatgttcgaagacgttcgagcagtggtcttttgtgtttccctaagcgactacgatcagttgttgctttccccagacagtagtggcagtggaacacttgttcaaaacaagatggtacaaagcaaggaacttttcgagaccatggtgaggcacccttgcttcaaagacacccctttggtgctagtccttaacaagtatgatatcttcgaggaaaagattagcagggtgtccctaaatacatgtgaatggttcagcgatttttgtcccgtgcacgcacatcataataaccagtcactggcccatcaagcttacttctatgttgccatgaaattcaaggacctttatgcatccctcacaggtaaaaaactctttgtggcacaagcaagggcaagggaccgagtaactgttgatgaggcattcaagtacataagagaggtcctcaaatgggatgaagagaaggaagagaatttctatggtccacctgaagattcattttacagcacagacataagctcctctccctttgtcagacaagagtgagtgagtgtccataaaaaaaatgttattatttggctgttgaaaagggtgctcgagacccagctttcttgtacaaa

SEQ ID NO: 569 - DNA, 1631 bp, Zea mays
aaaaaagcaggctcctgcaggaccatggttcaactctttttgcaagtgccggcagaatgcggcagtgttaatacagttgtcgtggaagggaggagatctctttttcacaatgttgagtccataatcaagtcattgacaaaatcagcaggcaggtatgaagctcggctgtggctctgtgccactgtctcgttggtccattcgctcagtgactgtggccagagggacctgtttcttgatctcttagagaggaagaattccaggcgtgatgtcgctgctcgcttgctgcgtatgattttcgataagaaacccagaatggttgggtctattctagcaagaaaaggccatatactggaggatttcttccgaggaaatccaaacaggataatgcagtggtttggccactttgctgttactggggaatccacacatagaaagggagctaaggcactttcgcagtttgcgtttgtaaatcgtgacaggtgctgggaagaacttgagtggaaaggcaagcatgggcaatctccggctgtagttgctaccaagcctcactattttcgtgatcttgatgttctcgagacagtggagaatttcttagagtatgtcccagatttctggtcttctgatgagcttgctaattctatcaaagatggtgaaatactgcaaatcgatgaagaatattttgtagatcaatttttatacttaatgtatgaggagaattccaaagatgcatggcatgtggttgaagattttttgatggacgagcagttctcttctctttgccagcatcttcttatccatctggatgaggaaaggcttcttggtttcttaaattctttaggcaagctcatcaatcctactatgcagtgcaaggaattgacattcccgtgttgttggcttgaagttcttttatcaggacattatgatcacatatctcttgatgatcttgtctttttgaactgtgtcattgccaagggtagacaactttggcggctcatgaacgatgaagaacaacacgaagaatgggggcaaatggaagaacttttgaagggcggaaaccatttgactgatgctgatcattttgctctcatgaaggaacttgtggagacagaattacctggtgtgcttaagtgggtaggcattcagtcctggataattttctgtgaattgtcgaaagaatgcaaatcaggagattcttgtgaatcttttttctctcataacaaaatagaatttcacaaggctgatgattactcattggttcggaattatgggttctcaatttcacatatgcctgatattgatgttgaagatctaactagaagcagccataaaaggagaaagaggaataggagaaagcgccataggtacgagtctgatgaggacaagtttgatgaactgcttgaacttggatcatctgatggaaagaatggtgttgagtcacagcgtggaagctggcgcctttcaactgatggtttctctgcttcttgggacatttcagacataccagatcacctttctacttgttatttcacaatttgggtaaagtgggcttgctttagatgattgtctacacagtatgtgtagtatatcaatctgggtgccttttcactcgagacccagctttcttgtacaaa

SEQ ID NO: 570 - DNA, 1559 bp, Zea mays
ttcttgtttgttgattaacccttaattaatccgggcgcgcctgatttatcacaagtttgtacaaaaaagcaggctcctgcaggaccatggcgagagaaccgagtcctgaaatagatgatgaactttacaatgaagtttatgggaaagcatacagcggcccagttgcatcagctacaaatagtgtgactcctaaaggaaatgctgagaagaggcccctgactcgtgataagtcagatgatgaagatggggccccagatcctaatgctgttcccacggacttcactagccgagaggctaaggtctgggaggctaaagctaaggctacagaaaggaactggaagaagaggaaggaggaagaaatgatttgtaaaatatgtggagacccaggccattttactcagggttgcccctccacacttggggcaaataagagaaatgcagacttttttgaaagagttccagcaagagataagcaagtcagagatcttttcaatgagagggtaataagccagattgagaaagatgtggggtgtaaaatcagaatggatgagaagttcctgtttgtcagtggaaaggatagattaatattatccaaaggtgtttctgctgtgcataaaattattcaagagggtaagggtaaacatagtccaagcagtccgaaacacgatcgctctaggtcgcctgtacgaaacactactgagtttcgttccaaacactctgattctcatcgctcacctagcccaagaaattttgattctcaatggtcccatagtccaagaaatgcatcactctctcaaagtaaaggatactataatgaaagacatcgagatggtcgcttacacaacaatatgcccaagttttcgaaaggatctccacaagctcatgccaactttggagcaaaaggccgtccagcccaatcaaaatctccatgccatacctcttatcttgatgaattacctagaacacatggcgagaataaccaatttgctgcatcacgagtgcccaatgattggggaattgagaggcatggagcagatgccagttcaagtcttaggtttgacatgccatcccaccaacagaccttggaagaacttgagatggagtttaaaaaagaagctacacaattagctagagctcgtgaccaagaggaggatgaagagaactataggcatcgagagtcgctgagagtgattagagaaaattacatggagagagtgattaccttgaggaatgtgcatgcaaagaagtgggaagaatttcttgacacctttaaaagtcaacaacaagcacagccttcatacatacaaaccggatatctaggttttgagcagagaacggcacatatttcagctacacatcaaccaatggattcgaagagcacatatccgtatgcttctgatagctattcagccccaaaggctcatgcagcatatggtgagtttcaacatgagaggcatgatgatcttgggagggcctataggcgatattagctcgagacccagctttcttgtacaaagtggtgataaattggagctctgcagagctttcgttcgtatcat

SEQ ID NO: 571 - DNA, 1705 bp, Zea mays
ttcttgtttgttgattaacccttaattaatccgggcgcgcctgatttatcacaagtttgtacaaaaaagcaggctcctgcaggaccatgaaggacccggcacaccgcacgaaggtggtgctccggcggctaccgccggcgatcgcgcagcaggacgtcgtggaccaggtcgatgcgcgcttcgctgggcggtacgactgggcctgcttccgtcccggcaatgccagccaaaagaatcataggtattctcgactttacctaaatttcaagcgcccagaggatgttgttgagtttgctgaggtcttcaatggacacatatttgtgaatgaaaagggtgctcaatttaaagctttcgtggaatatgcaccatcacaacaggttcccaagtcaaatgtcaagaaggatggccgtgaagggactgttacgaaagatcctgagtacttggagtttcttgagtttatttcaaagcctactgagcatctgcctagtgctgaaattcagcttgaaaggaaagaagccgaaagggcagctgctggaaaggaggcacctgttgtgacacctcttatgatgtatgtccgccagcaaagggcagctaagagtatggctcagagacctggaagtaggcttagcagaaaagttgcaggtgttgtaactagcagttccagtcctaaaaggtcttttgagaagcgtcgatcctccacgtatgttgtacgagacagtattaaggagaaaccgacctatatcatggtgccaaagagagaggagcatacacaaaggggaaaaattgtttctggaaattcagatgccacaagtgggggggcatctggatctggtcagtcttctgacaaaattgtcattttgaaaggaagaggaagggttgattcgaacacacctgatggagcagctcaacagtcatcaacccctgtgaagaatataccaccatcgagttctagactagacaagcgatctgaagctaatggaagaattattaaaactgttctttcaaacaaggaagttcgcagttcaaatccatctcaacatgagcaggaaggtcacatgtttaatactgagaaggataagcgtccaccacgggctctcaaccctcggactattgtgaaagatcaggtagttgaaaatgctgagagaagccattttgatgagaagaataattatgtccacagctctgctccaattggtgagaaggttgaaaggcatgccagaaacagagatagacctgatcgcagtgtatgggcacctcgccgctatgacaaatctccgcctgggggtgtttcacatgccttgtcgtcagatttttctcaaatgcagtcacattctggagataatgtctcacaactaacagatggtcatggagacagaaagacagacacaaggggtcatggaggtagccgtggtgttcctgttgaaaatggacataggcatgccaaccgtcgtggtaccccatgtgatccaaaggaaaccaaaatatctgctagcgtgcctgatggaaagaattcaaagaggggctctgctagctatggtgctcatgagagacaagtatgggttcagaagtcaagttcaggctcgtgagtttgtccattgatgatactcccataaaaaacaggtattgaagtcgtggactcgagacccagctttcttgtacaaagtggtgataaattggagctctgcagagctttcgttcgtatcat

SEQ ID NO: 572 - DNA, 817 bp, Zea mays
ttcttgtttgttgattaacccttaattaatccgggcgcgcctgatttatcacaagtttgtacaaaaaagcaggctcctgcaggaccatgactggtgtcagcactggattgttgacgggcttgaggagggtcatggaacagcaaaggatttcaaccgctttctgcagacaatcacgagtttcgagctctactgtttctttctctgacctcgatgagaagggtgacatggaatatgatgataactctccaaattcaaagagggagttacgaccccaaggtgtagatcccaataagggctgggaattccgtggtgtgcacagggccatcatctgtggcaaagttggacaagtccctgtgcaaaaaattttaaggaatgggcatacagtaaccgtttttactgttggaactggtggcatgtttgaccagagggtaattgggcctaaggatttgccaaagccagctcagtggcaccgcatagctgtccataatgactacttaagtgcttatgctgttcagaagctggtgaagaattctgctgtctatgttgagggtgatattgaaaccagggtctacaatgacagtgttaatgatcaagtcaaaaacatacctgagatatgtgttcgacgtgatggcaagattcaattggttaaatctggggacagtgctgctaacatatcattagatgaactaagagaaggactgttctagctatagtgaaagatgtcaggagtatgcttctggcttgaggcctcgagacccagctttcttgtacaaagtggtgataaattggagctctgcagagctttcgttcgtatcat

SEQ ID NO: 573 - DNA, 584 bp, Zea mays
ttcttgtttgttgattaacccttaattaatccgggcgcgcctgatttatcacaagtttgtacaaaaaagcaggctcctgcaggaccatggcctccgaggcggtcgtcgttcacaccggcggttgccactgccggcgcttgcggtggcaggtcgaggcccccgcgagcgtagtggcgtggatctgcaactgctccgactgttccatgcgcgcgaacacccacttcatcgtccccgccgccaagttcaagctgcaggccggcgctgacgagttcatcaccacctacaccttcggcacgcacacggccaagcacaccttttgcaagacctgcagcatcacctccttctacaccccgaggtccaacccggacggcgtggccatcaccgtggcctgcgtcgaccccggtaccctgaagcacgtcgagtaccggaagttcgatgggaggaactgggaggattttttcaggaccagcgacatcgctggattctccaaggacgatgcagaggcggcggagtagctcgagacccagctttcttgtacaaagtggtgataaattggagctctgcagagctttcgttcgtatcat

SEQ ID NO: 574 - DNA, 1196 bp, Zea mays
ttcttgtttgttgattaacccttaattaatccgggcgcgcctgatttatcacaagtttgtacaaaaaagcaggctcctgcaggacatgcgccagccacggtccgggccggggaagaggcggggccgcggtccgcgcatccccgcggcgacgcttcagaagcagaaaacggcgttggcgaacgtcgaccagatcaccggcgccaagattccgaagagcttcgtattctcccgcggtaaactcccctccacgctccgccatcttcagcaggacctccgcaaggtcatgctcccctacactgctctcaatctcaaggagaagaaacgaaataacctcaaggattttgtcaatgttgccggcccgatgggtgtgacacatttcttaatcctctcaaacccccaaagcctgccacatttgcgctttgccaaatcaccgcagggcccaacattcacatttcagatagaggagtactcacttgcggcggacattgcaaactctcagaagcgcccaaggtgcccaccagggatattcaaaaactcaccactggttgtacttggtgggttgacaggtctcggcaaccctttcaggagtttggtcgaatacttccaacatatgttcccttccgttgacccaaccactgtcaagctggcaacatgccaaaggattctgttgttaaaacatgataaagagaaggatgttattgaattccggcattactccatcaagctccagcctgttggggtcagtcgcaggattagaaagctcatgcaaaacaatcaagtgcctgatctaggagaatttgaagatgttagtgagtttgtgaaaaaagctgggtatggatcagaaagtgaagcagacgatgaagcagcaatggtaagcttgccaagtgacattgacaaattaaaccgggcatccagaaaaagcgctgtcagactccaggagattggaccaaggatgactatgcgcctagttaaagttgaagctgggctatgttcaggagatgtcttatacccatggcctgtggaaaaggaagtggtgggaaagaaagggacagaaactggggaagtagaagggcaagaagacgattctgaggccacagatgagtccgaggatgagatggaggtgtagctcgagacccagctttcttgtacaaagtggtgataaattggagctctgcagagctttcgttcgtatcatc

SEQ ID NO: 575 - DNA, 1375 bp, Zea mays
ttcttgtttgttgattaacccttaattaatccgggcgcgcctgatttatcacaagtttgtacaaaaaagcaggctcctgcaggaccatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgagaaaacctcattcatgttatttcttaacaaatttgacatatttgagagaaaaatacaaaaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagatattcaagctgatcgacgagagcatgaggcgttccagagaaggaacttgatcgaggatgtggtgttataagccacaagacaagtaactaggatggtgtgactcgagacccagctttcttgtacaaagtggtgataaattggagctctgcagagctttcgttcgtat

SEQ ID NO: 576 - DNA, 434 bp, Zea mays
ttcttgtttgttgattaacccttaattaatccgggcgcgcctgatttatcacaagtttgtacaaaaaagcaggctcctgcaggaccatggggtacctccaggaggcccgggagaatcacgtcaagaagaaggtcgaggaagctttgcggagcaaaatgaaacaaaaggctcttcaggaatgcgatttctattgttcaaaatatgctgagtgtgcacggggaagaacattttctgtggtatggcaatgccgcaaacaagcaaaagagttgaatgagtgccttcatcaatacacaaatgatgcaatcctggaagaaatgaagaaggcttatatgatcgagcaaaagagcaaggagataaatcaatgatcgagacccagctttcttgtacaaagtggtgataaattggagctctgcagagctttcgttcgtatcatc

SEQ ID NO: 577 - DNA, 1274 bp, Zea mays
ttcttgtttgttgattaacccttaattaatccgggcgcgcctgatttatcacaagtttgtacaaaaaagcaggctcctgcaggaccatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcaagtgccaagcagtaccccaaagtccacgagctgatggaacatcaaaccaacatcagggtcgttgagatgagcatgaacgattcctggttccgcgacatgggccccacttttgtcacctgtaaaggggattcaggaattgcagaacaaacaatagcgggaattgattggcaattcaatgcctggggaggaatctatgacgactggagtcttgacagcgatgttgccaagaaaatagtcgagatcgagaggatccctaggtttccccaaaaaattatccttgagggtggaagcattcatgtagatggagaaggtacatgcattacaacggaagaatgcttgctgaatcctaataggaaccccaacatgaccaaactagagatagagaatgagctgaaggattttcttggagtctcgaaggtcatctggatacctcgtggactttatggcgacgaggatacaaacggccacgttgacaacatgtgctgcttcatcaaacccggtgtgatcctgctgtcgtggaccgacgacgagaaggattatcagtacgaacggtcggtcgaggcgctgtctgttctctcccagtccgtcgacgcgaaagggcggcagctccaagtggtgaagatccacgtccccgggcctctgtacatgacagaggaagaggcacagggcgttgtttcatcgggacattctgtgccggggccagcgggcacgagattggccgcctcgtacgtcaacttctacatcgccaatggtgggatcatagcgccttccttcggcgacaggtgggacgaggaggcgtatgcggttctccagaaggcattccccgatcacgaggtggtgatggtcgaaggcggacgggagatcgcgctgggaggtgggaacattcactgcatcacgcagcagcagcccgtgcgcccgtcctagctcgagcccagctttcttgtacaaagtggtgataaattggagctctgcagagctttcgttcgtatcatc

SEQ ID NO: 578 - DNA, 771 bp, Zea mays
aaaaaagcaggctcctgcaggaccatgagcttcatcttcggcaagaagaagactcctgctgagctgctgcgggagaataagcggatgctggacaagtccatccgggagattgagagggagaggcagggcctgcaggcccaggagaagaagctcatcaacgagatcaagaaggtggccaagcagggtcagatgggagctgtaaaaattatggcaaaggatcttatccgcacaagacaccaaatcacaaaattctatgcactcaagtcccagctacaaggtgtatctctacgtattcagactctgaaatcaacacaagccatgggtgaagccatgaagggtgtgacaaaagccatggggcagatgaaccgacagatgaatctgcctgccctgcagaagatcatgcgggagtttgagatgcaaaacgagaagatggagatggttagtgaagtgatgaacgacgccatcgatgatgccttggagggcgatgaggaggaggaagagacagaggagctggttagtcaagtccttgacgaaattggcatcgatatcaactcagagcttgtcaaggctcctgcaactgcagttgcgaagcccgtcgcagcggggaaagttcctgctcaggctgaagccgcaggtgggccagatggcggcatagatgatgacctgcaggcgcggctcgataacctcaggaagatgtgatcactggctggagcctaacaaaacatatccacacgctttgtttgtactcgagacccagctttcttgtacaaa

SEQ ID NO: 579 - DNA, 532 bp, Zea mays
aaaaaagcaggctcctgcaggaccatggcactagcggctatctataaccttttcatcattaacaaatcaggcggccttatatactacaaggactatggttcagcagggaggatggataccaatgacagtctaagattagcaagtctgtggcattcgatgcatgctatctcccagcaactctcccctacccctggctgtactggcattgatctcttacaagctcataactttgatctccattgctttcaatccctcacagggacaaaatttttcgttgtatgcgaaactggagctccaaacatggaaatgctgctgaaagtgatttatgagctgtacacggacttcgttttgaagaatccgttctatgagatggagatgccgatccggtgtgagctgtttgatcacaacctggctcagatgatccagaaggaccgtgttgcgcttctgggtcggtgaatcttgaaaactcatggtctcagcccttgaaaaccctacttttcccgtttctcgagacccagctttcttgtacaaa

SEQ ID NO: 580 - DNA, 959 bp, Zea mays
ttcttgtttgttgattaacccttaattaatccgggcgcgcctgatttatcacaagtttgtacaaaaaagcaggctcctgcaggaccatggcggcgatgactgcttacaagtatcaagctcaggccttgatgagggactatctgctagctgatccactagttccgtacacctctgtgctcattggcattgtcctctgcaagatggcttacgatttcactcgaatattgagctccttttatttcaagggctacactttactgacaaaaatacagcgcatcgaatggaacaataggggtatgtccagcgctcatgcaatttttatcacggctgtatcattatatcttgtcatgtcaactgatcttttctccgaccgcgtcaagggacctattacattccgttattcgataatatccacctctgcgttgggggtttctgtcggctacttcatcactgatcttgcaatgatcttctggctgtatccttcccttggtggaatggaatatgtcctccaccatactgtttccctggttgcaatagcttacacaatgttgtctggggaagggcagttttacacatacatggttctcatttcagagacaaccacccctgaaatcaacttgcgatggtttcttgacactgctggactgaagaaatcaagtgcttacttggttaatggaattctgatgtttgttgcatggctggtggcaaggatatttttgttcatgtatgtattttaccacatctatttgcattacggtcagataatgcagatgcatgcctttgggtactacctgacatttgttgtgccatcagtgctctttgtaatgaacacaatgtggttcatgaagatcttaaaaggtgtgatgaaaacactggcaaaatggccatgactcgagacccagctttcttgtacaaagtggtgataaattggagctctgcagagctttcgttcgtatcat

SEQ ID NO: 581 - DNA, 1583 bp, Zea mays
ttcttgtttgttgattaacccttaattaatccgggcgcgcctgatttatcacaagtttgtacaaaaaagcaggctcctgcaggaccatggcaaccgtcgcccccgtcgtctccgacctcgtcgacttcctcaacgcgtcgcccaccgcctttcacgccgttgacgaggcgaagcggcggctgaaggcggcggggttcgtgcagctgtcggagcgggaggagtgggcgggtctcgagcccgggcgcaagtacttcttcacacgcaaccactccactattgtcgcttttgccatcggcgcaaaatacgttgctggcaatgggttccacatcatcggtgcacacactgacagcccttgcctgaagctcaagcctgtctccaaggtaaccaaaggaggttaccttgaggttggggttcaaacgtatggtggtgggttgtggtacacatggtttgaccgtgatcttactgtagctggtagagtgattatacgggagaagaaggatggcgtggtctcttatgcacacaagcttgtacgggtacaggaaccaattatgcggatacctactttggctattcacctggacaggactatctcctcagaaggtctcaaggttaacaatcagagtcatcttgttccagtgctggctacatgtatcaagaatgaaatgcagaaatttgtagcagataatggcccaaagcaggcatccgagaatgcgaacacaaagcatcatccattactattgcagttgattgctaaagaggctaactgtgagcctggtgagatatgtgactttgaactgcaattatgtgatactcaaccaagtgttgtagcaggtgccacgaaagagttcatcttttcaggaaggcttgacaatctttgcatgtcattttgttcattgaaggctctaatagattccagttctgttgaacactctcttgatcatgaatctggtgtgagaatggtagctctatttgaccatgaagaagttgggtctgattctgctcagggagctggttcccctgccatgttggatgctttatcaagaattactgggtcttttaactcttcaggttccaagttgctagaaaaagctattcagaggagcttcctggtctctgctgacatggcacatgctttacatcccaactatatggacaagcatgaggagaaccaccagcctaaattgcatggaggacttgtgatcaagcacaatgccaatcaacgatatgctacaaatgctgtgacagcatttatttttcgagaaattgctgagagacaccagctacctatacaggattttgttgttcgcaatgacatggcttgtggttcaacaattggcccaatacttgctagtggtgttggtattcgcactgttgatattggagcaccccaattatcaatgcacagcatcagagaaatgtgtgccgctgacgatattagctactcatatgagcatttcaaggcatattttgaagaatttactgaattggatggcaaggtcaaggtggattactagctcgagacccagctttcttgtacaaagtggtgataaattggagctctgcagagctttcgttcgtatcat

SEQ ID NO: 582 - DNA, 1164 bp, Zea mays
ttcttgtttgttgattaacccttaattaatccgggcgcgcctgatttatcacaagtttgtacaaaaaagcaggctcctgcaggaccatggaggaagagaaagcggcggcgtactacgacgagctcaatcgcaagggcgagggcgcccgccgcttcaagcaggggcttggcttctcctcctcatccgccactgccttcccttccaagcccaccgcctcctccttcctatccggttttgttcgcgcgggcgcagcccctggccccgccaaacagccgttaccgcattccaggaccccatccagtccgcaccatcgctcaagttcaccgcctctttcgcgtcccaggatccgctccaggtccaggtccaggtccccgtctcgctccagccggcgccaatcgagatcgaggtcccggtcgagggagcgcaggcgccgctccaggtctagggagagggaccgcagggcatcctgtagacgctctaggtcgcgggggtcgagatcgccttctcgccggagcggcaggagcctgcacttggaagcccggcgggaacggcatggggatcagcggcggcggcacgacgacggccatcagagctctaagggtcgcagtgatagggacgggggcaaaatggactactcgcggctcataaaaggatatgataaaatgactccagctgagagagttaaagcaaagatgaagtttcagctttcagagacagctgcaaaagattccactcttggaactgcaactgtggggtgggaaagatttcaatttaataaggatgctccacttgatgaagataatgacgatgttgaagttgctaatgatgatgcttcactggtgaagaatattggaaagagcttccggctttctgctgtggagtcaaagcgcgaagataaaatcagagatgcgcatgatgaggctatatttggtgtacctacaacttcatttgttgatgttgaaattggtggtgacgagcttaaaaccaatcatgaagacgggaaagttgaagacacagaatctgatgaacctagcagctccctcatcagcgataaagttcctggagggatcgggctcagaagttgcggaagaatttgactcgagacccagctttcttgtacaaagtggtgataaattggagctctgcagagctttcgttcgtatc

SEQ ID NO: 583 - DNA, 472 bp, Zea mays
aaaaaagcaggctcctgcaggaccatggtgcgggtggcgacctacttcgcgatgaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaacgaatcatgactcgagacccagctttcttgtacaaaaaaaaagcaggctcctgcaggaccatggtgcgggtggcgacctacttcgcgatgaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaacgaatcatgactcgagacccagctttcttgtacaaa

SEQ ID NO: 584 - DNA, 1272 bp, Zea mays
ttcttgtttgttgattaacccttaattaatccgggcgcgcctgatttatcacaagtttgtacaaaaaagcaggctcctgcaggaccatggcgaaggatgggggtcccgactggaacggcctgctcaagtggagcctcgcccacggcgacagcaccaacccgccgcgtgctctcagcgaggaagacagaaaatggttcatggatgctatgcaagccaacacggtagatgttgtgaagaggatgaaggagatcactcaggtgatgaaaacaccagaagatgtcttgcagtctcagggtgtgaccccggagaacattgaagatatgttggatgagctacaggagcatgttgaatccattgacatggcaaatgatctacattctattggtgggctggatcctctacttagttacttgaaaaattcaaatgctggcatccgagcaaaggcagcagaagttgttagtacaattgtgcagaataatcccaagagtcagcaacttgtcatggaatccaatggactagagccactgttgacgaacttcaaatcagatccaagtacaaatgcacgcacaaaagctttaggagccatatcttctctaattcgtcataaccagcctggagtttccgcatttcgattgggaaatggctatgctggattgaaggatgctcttggttccgatgatgccagactccaaaggaaagctctcaatctcatacaatacttgctgcacaactacaaggcagacaggagtgttgccacagagcttggtcttccgaagctgatgatgcaccttgtgtccagcgatgattccttagtgcgtgaagctgctctaggcggcctccttgagttggcgcgggacaagacatctggtaacgcgctacctgaccaagaaaagctgaaagacatgctcaagagccgaatagaagggatcagcgcaatggacactgacgatctccacgctgctcgcgaggagcggcagctggtggattcactctggaaggagtgctacaacgaaccttcgtctctcagggagaagggcctcgtcgtgcttccgggagaggatgctccccaacagccgccaccagacgttgcagggaagatgtttgagccaccgcttcgtgcgtgggcggctgcaagacctgctcaggaagatgactctgactctggcagcggaaagaaggatccgccattgctgcttaagttttgactcgagacccagctttcttgtacaaagtggtgataaattggagctctgcagagctttcgttcgtatc

SEQ ID NO: 585 - DNA, 2060 bp, Zea mays
aaaaaagcaggctcctgtaggaccatggcatccctaatcgagcgcgccacctccaccacggcgcacgccgtcgacccggtgctcctccgcgccatcaaatcttcggcccgtgcctccgatgccgccatccgggacgcgttccgcctcatcctctccctcatgtccaagccccactcccacgtgcggctcctcgccttcagcatcgccgacgagctcttcatgcgctccaagctcttccgctccctccttgctgactcgctcgacggcttcctcccgctcgccgtcgggttccgccgagcaaaccccctcccgccgccgaccacgtccgctgccttactccggaaggccgccgtccaggcgctcgagcgctggcaccatctctttggtgcgcactaccgccagctccgcctggccgtcgagtacctcaaggagtccgcgcgcgtccagttctctggtctgcgggccaccgttgatgctcgtgcagctcgtgaggctcgcatgcaggagatctatgctggcaaggttgagcagttgcgtgaaaaccttgcgtcaatcaaggcggagattcggtccacgattgatgagattcgcaatggattggagatcatccgtgctgaacataagaaatttgagggttattatgtggatgacgaggaggagattgcatccttgtcaatgcggagcattagaacagcatcattgatggctggggagtgggtgcctgagactcaggagaatgaggcagtttttgatgcactgagggaagcacaccggttgcttgtgtcaaagcatttggtcacagtacaggagtggataactgtgcttgtgagggtcaaccttccagacaaccgtttccgagattctgcattgaaggatttcattgatgttaagaatgagataagggctgtgagagatcattgcagtgagcttggtcttgaccttgataattttcataggcggaagggtgaccaggaggaagaggacaatgagttctgggtggagggaaacatagaggcaccaaatcgtgctagagtccagagcagtttagatgttgcgagcactagcaaggacactgagaagggaaagtgggtggttggtggagtgtctcacattggcaaggcaccagttgcggctaatggaacgagaaatcttgatccagaaaaatcaaaactcctcgctgaagcccctgtgctgccatggagctctgtcttggatcgctggggctcaagtggggatgtacacgtaaaccagaggggacttgaggtcgagagtcattggggaagagtggataatgatgccactatacctgcagcaaagattgcagagttgaatgttcattgctcaatttatagagaagacccagttgagatcctaccatgccacgcccctctaaaaaaaggaggactttgccagagaagggatcttagggtatgtcctttccatggaccgattgtcccacgtgatgcagaaggaaatccaattgagcagaacagtggtagttctgatgcagaagtaaatcctgttgagcacttagacattggaggacattcaaatgagcttaatggaatcagtgatgatgattgtatggagggaacctcttcaagaatggcaggtgtcaataatgattatggtgacatagctggaacttgtgatctaggtaagattactgcagagcagttagcaagacaatcagttaaaaatgtccggaaaagagaaatggatcgcaaggcacaggaaagggcccaacgtgcaagaatccgtcagcacaatgaagatgtcctgcgaaatgcggctcttgcttcaacttcctattctgcagcagcctatgagcagcctacagaagcacatggtcggcgaggacgccgaggtaaggcaaaggcaccaacgctggcatcgatgctgaaaaagaaagttaccaccaaagacagaattgcagagaggcttctgaacgctcgagccacagatgccacagtaagggatgtttctcataatgaagatatgagctacagggaagcatttccaaatcagtggtagctcgagacccagctttcttgtacaaa

SEQ ID NO: 586 - DNA, 610 bp, Glycine max
ttcttgtttgttgattaacccttaattaatccgggcgcgcctgatttatcacaagtttgtacaaaaaagcaggctcctgcaggaccatggctcagaaggccgagaaaaacgacaccgactttaaggtccccgaaaccatcatcaccccctgcaccaccaccaccgccacctcgattaccgaaccttctagattcttcgacgcaaccacccccgccacgtcatcgcgctcccccaagcgatccctccccctcgacgacgaatctcagacggaccaaacggcgtcgtcggagcccaaacgcgtcgtgagccgctgctcctgctgtcggcggcgcgtggggctcactggattccggtgccgctgtggcgacctcttctgcgccgagcaccgctactccgaccgccacgactgctcctacgactacaaggccgcagggagagaggccatagcgagagaaaaccccgtcgtgaaggccgcgaagatcgtcaaggtctgaaaaccctaaatcggagaacaaaaatctcccaagagatcgaacaaatctcgagacccagctttcttgtacaaagtggtgataaattggagctctgcagagctttcgttcgtatcatc

SEQ ID NO: 587 - DNA, 916 bp, Glycine max
ttcttgtttgttgattaacccttaattaatccgggcgcgcctgatttatcacaagtttgtacaaaaaagcaggctcctgcaggaccatggccaatgtttcaattccactcccacgaaacggtttctccaaacccaattactcgacaaaacgcccatgtttcaccccttcagcttcaacactcagaatttcttgctctggagtggctgagtttgatggatctcatcagaaaaaaggaggtttgtttaatttcaatggaatcaagggcgtggcttgtggtattcttgcagcttgtgctgttacttctgctgcatttcctgttactgctgctactcagaggcttcccccattgtcaactgagcccaatcgctgtgagcgtgcatttgttggcaacacaattggtcaggcaaatggtgtatatgataaaccattagatctccggcaatgtgatttcacaaatgagaaaaccaaccttaaggggaagtccctgtctgctgcactcatgtcagatgctaagtttgatggagctgatatgacagaagttgtaatgtcaaaggcttatgctgctggtgccagctttaaaggggtggacttctcaaatgcagtcttggaccgtgtgaactttgagaaagctgatcttgaaggagctatatttaagaacacggtattgtcaggatccacctttgatgatgctaagctggacaatgcagttttcgaggacactatcattggttacattgatctccagaaactatgcacaaataagaccattggtgatgaatggagagttgaactaggatgtcgatgaaaagcaaagtcttcactgtcttctatttctagtatgctgcctcgagacccagctttcttgtacaaagtggtgataaattggagctctgcagagctttcgttcgtatcatc

SEQ ID NO: 588 - DNA, 603 bp, Glycine max
ttcttgtttgttgattaacccttaattaatccgggcgcgcctgatttatcacaagtttgtacaaaaaagcaggctcctgcaggaccatggtttccagggttcacaagagaacagccatgtacaggaacctacacctgcttcgttcaatcagatactcacactcggtgtcagattacatacaaggtttaaagcaaaaactggaagaattgaaccagttaacagtggcaacggcacgaaaaatcgttgactatgatccaatgcctaagcttgaagttgaaacacaagaagagggttttgtgatcaaggtgctgagtgaaagcagttgccaggggttgctggtgtttatattggaagcctttgaagagctggggcttgatgtgctccaagctagggtttcttgtgcgcacagcttcagtttagaagctctcggaaacaaagagaacaatgaagatactcgcccattggatgcacaactagttgagcaagtagtgtctcaagctattcaaaactggagggaagtttcacagatataactcgagacccagctttcttgtacaaagtggtgataaattggagctctgcagagctttcgttcgtatcatc

SEQ ID NO: 589 - DNA, 495 bp, Zea mays
ttcttgtttgttgattaacccttaattaatccgggcgcgcctgatttatcacaagtttgtacaaaaaagcaggctcctgcaggaccatgccctctgcctccctgaaagatatcgttcacactctgctcaagggttaccaaacagaaaccccaatcctccagaagatcatcgatgtcttcttaatctatattcttattaccgggatcgttcaattcatttacgttgtcctcgttggaacgtttcccttcaattcttttctgtctggtttcatctcgaccgtaggatgtttcgttttgactgtttctcttcgtatgcaagtagatccaaaaaacgagatcaagggagtctcggtcgagcgtgcgtttgccgattacgttctctgcaaccttattttgttcctcgttgttctcaatttcatgggttaactcgagacccagctttcttgtacaaagtggtgataaattggagctctgcagagctttcgttcgtatcatc

SEQ ID NO: 590 - DNA, 876 bp, Glycine max
ttcttgtttgttgattaacccttaattaatccgggcgcgcctgatttatcacaagtttgtacaaaaaagcaggctcctgcaggaccatggcagcttcttcctttacaacatcttccattctcttcccattcacaactagttctaaatcccctccttctcaactattcccctcttttccttgcaaacatcataccctccgtctcagacccgtctcagtctcagccgcttcaaccccaaccccctccatccaagccgacaaatccccggtctccgccactccctccaagcttctcccctttcggattggtcacggctttgacctccaccgattggaacccggttatcccctaatcatcggtggaatcaacattccccacgatagaggttgcgaggctcattccgatggtgacgttctgcttcactgcgttgttgatgcgattctaggggcgctaggtcttcctgatattggccagattttccccgattctgatcctaagtggaagggttgtgcctcttccgtcttcatccatgaatctgtgagacttatgcatgaggctggttatgagattgggaatttagatgctacattgatacttcagaggccaaaactaagcccacacaaggatgctatcaaggccaacttatctgcactgcttggggtggactcttctgtagtaaatatcaaagcaaaaactcatgaaaaggtagacagccttggagaaaatagaagtatagcggctcacacagtggttcttctaatgaagaaatgagaagacaatctggaaatattgaggaacatgagagaactcgagacccagctttcttgtacaaagtggtgataaattggagctctgcagagctttcgttcgtatcatc

SEQ ID NO: 591 - DNA, 930 bp, Zea mays
ttcttgtttgttgattaacccttaattaatccgggcgcgcctgatttatcacaagtttgtacaaaaaagcaggctcctgcaggaccatgggcggcgccctgatcgtcgcgctcctcctcgcgaccgtgcccctctccttgggcggcggcgcgcacccgggctactccgacgccgacgagagcgcgtgcacggtggacgcgggcgcggagctgctgcggcggctggaggagcgcgggcccggcgggcgcagcatcatcgacatcacgcacgcggtcgtgccggacctgccggcgttcgccacgggggcggtcgcggggcccatgctgcgcctcagggagtccatggcggacgggtccgagtacaacctgtcggagctgcggatggagtgccacaccggcacgcacgtcgacgcgcctggccacatcaaccaggcccacttcgccgccggcctcgacgtcgacacgctcgacctccacgtcctcaacggacctgcattgctagttgatgtgccaagaaacacaaatataacagctgaagcgatggaattcctaaacatcccgagaggggttcgccgagttctgttcagaacactgaacactgacaggaagttgatgtggaggaagggaggtgacatgagctacgttgggtttacagaggatggcgcgcagtggttagtcgacaacaccgacataaagctagttggagttgacggtctgtcagtggcatcatttgatcacctgatctctgcccacgtggtctttttcaaaaccccggatataatccctgttgagagcctgaatctggacgacatcgaggcggggatatacatgctgcactgtctacctctcaggctggtcggagccgagggtgcaccgaccagatgcatcctcatcaagtgactcgagacccagctttcttgtacaaagtggt

SEQ ID NO: 592 - DNA, 1581 bp, Bacillus halodurans
gctttcaaactctttgtttcttgtttgttgattaacccttaattaatccgggcgcgcctgatttatcacaagtttgtacaaaaaagcaggctcctgcaggaccatggatctctatattaatggagagtggatgaggagcggaaaaacattagatgtgaccaatccggcgacgggtgaagtgattgataccgttccctttgctggaaagaaagaggcagagctcgccgtatccgctgcatatgaagcttttccgcagtggtcaagccaaacagcctcagagcggagccgctatttaatgagatggtttcagctcattgatgaacaacaagacgagattggcgaaatcatgacgaaggagcaagggaagccgcttcgtgaagcgattggagaagtccaatatgccaactcgtttattcaatggtatgccgaggaagcaaagcgtatttacggtgacacgatccctgcttcggctataaacaaacggattcttgtgcaaaaacaaccagtaggtgtgatcgcagccatcacgccatggaactttcctgccgcaatgatcacaagaaaagtagcgccagctttagcggccggttgtaccgctatagtaaagccagcagagcaaacgccgttaacggccttaaagctagcccaattggcggaggaagcggggattcctgctggcgtccttaatgtcattaccgggaatgcccaagacattggtgaggcttggcttgaggattcacgggtgcgaaaaatcacgtttaccggctcaacagaagttgggaagctcttaatgcgcggggcagctcagacagtaaaaaaaatatcgcttgagcttggaggtcacgccccgtttattatcatggatgatgccaacttagaggaagccgttgaccaagtgatagcctcgaaatttcgcaatgctggtcaaacgtgtgtatgtgccaaccgaatttacgttgcccgggaaatagccgaagcttttacagaaaagtttgccgcaaaagtgaacgaactaaaggttggaaatggactggaggaaggtgtcacgattggcccattaattgataaagctgccgtggaaaaggtagaagctcatattcatgatgcccttaaaaaaggaggacaggttactgttggcggccggtggacgaatcattttttcgagcctacgatcattactggtgcgacagacgagatgctctgcatgaatgaagagacgttcggtcccctcgccccggttgcaacgtttgacacggaggaagaagtgatcgaacgagcaaaccatacaccgtacggattggcagcttacgtcttcaccgaaaatattggcagagcgatccgtttaagcgaaaagctcgaatacgggattgttggggtgaatgacgggatgccttcagtggctcaagctccgttcggtggctggaaagaaagtggcctcggacgtgaaggtggaaaatacggaatcgaagaataccttgaggtcaaatatgtatcggtcgcgttcaaatgactcgagacccagctttcttgtacaaagtggtgataaattggagctctgcagagctttcgttcgtatcatcg

SEQ ID NO: 593 - DNA, 1241 bp, Escherichia coli K12
aaaaaagcaggctcctgcaggaccatgattgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtggtgtaactcgagacccagctttcttgtacaaa

SEQ ID NO: 594 - DNA, 2400 bp, Zea mays
ttcttgtttgttgattaacccttaattaatccgggcgcgcctgatttatcacaagtttgtacaaaaaagcaggctcctgcaggaccatgagcgagtctgagtcgtccaacacgggcttcgccgcggccctagagctgtggcaagaaaaccagctgcgcatcctcgtcctgattagcctcgccacccagtgcttcctcttcgtcttcgccccgctccgtcagcaccggatcccaggtccgctgaggctctccatctggctggcctacctgggcagcgacgccgtggccatctacgccctcgccaccctcttcaactcccaccggtgcgacaccggcaccggcaccggcaccgcccgcgccggcgtggagctgctgtgggcgcccatcatgctggtgcacctgggcggccaggacagcatcccggcctacaacatcgaagacaacgagctgtggcggcggcatgtcgtgacagcggtgtctcaggtcgccgctgctatctatgtgttcgtcaagtcgtggccaaaatccatggcggcgactgctgcccatctagtggttgaccaagacactcgtaaccggataaatgccttcatggcccataaaagtgagatggcggcttacgggagaatcttgggaccggcgcttcttctcttcttctctgggatcaccaaatgcgtgtgcaagccctgggacctcaagagggtcagcgtcaacagcctcgtggactcctcctcatcgggctcctcggaagagaaggccgatgccggtgagagtgagatggattcgcttcaggagtacgtgggagctgcagcacagtatttcgagtccgtcggccacgaggaggaggaggacgacggcggcggcggcgacgacgacgatgacgacacctgtaaagcagaggaagtttggaagccctacaacctgtgcgtggacctggcgcccccctactccggccggctgagctgcctgaaacacctggcgcgcagcccagcggacgaagcccatcgcctggtgaaatccagcctctccgcgacgttccaccagctctacaccaaggaatcgctgaagctgcacgacatgtcgcacattgtccttacagacaaccgcgccttgaaccgattgaagctggtcacctcggctcgagggctccggacggtagccgcgaccaccctgctcggggcgatcgcggcgttctacggagaaggcgacgttgaccaggacccgacggacgtcaccatcacgtacgccctgctgtggtctgctttcgtgatggagtgcgtcttgcccaccgtgatccaccacacgttcggctggatagagcggctgttcaccgggcaccggacgtggccggaccaggtcgcgcagtacagcctcatggggtacgtggcacgcggccggagccactcgtggctcatgaaggcggtggcctgcctcggctgcggggacctggtcgaccagctctggaccatgaagccgcgcatgggtgcttcgtccagggagatcaccggcctggtccacgcccacgtcgccggagcgtggatggagggccacatagccggcgcggactcgttccgggcgttcaacgactaccgaggccagtggactctcggcaactgcagggagatcggggtcggcgtatcatccatggtggtactgatgagcagcgtgtcgaggccgttcgacgagagcgtcctcgtctggcacctcgccaccgacttctgcttccacttacttcaggtccagggagacccgtcccgcgccaccgccaccgccaccgccaccgcccgccgctgcatcgagatgtccaactacatggcctaccttctcttcgtcaagccggagatgctgatgcccggtgcccggcgcaagctgttcagggacgcgtgccgcgagctcgtgggcctgctcgaggaggatcgtcctggcgcgccgcgggcacggggcaagagagacctcgcacacaaggtcgtccagctgctcaagagggacggaggcgacgtcctgggctcagcaggcgtcggcgtcggcgtcggcgtcgttcgccgggcttggtgcgtagccgagaaactcgtggattcgcacagtggcgacgaggagaagatgtggaccgtgatacagggcgtgtgggtggagatgctctgcttctcggccagcaggtgcaaaggctacctgcacgccaaaggcttgggaacgggcggggagtacctgtcctacgtgtggctcctgctcctgtacatgggcatggagaccttggcggagaagatgcagaggacggagctgtacgagggctccactgcagcagcgttatccatcagtggccagaatgtttgactcgagacccagctttcttgtacaaagtggtgataaattggagctctgcagagctttcgttcgtatcatc

SEQ ID NO: 595 - DNA, 1710 bp, Glycine max
ttcttgtttgttgattaacccttaattaatccgggcgcgcctgatttatcacaagtttgtacaaaaaagcaggctcctgcaggaccatgatcagttttgcaggacttattggtgatggagcaccgttgatttctttatccagtggtaaatcaactaatgtcagtgcagtccattccattaaatcggtgaatatggttcacactggtgcaaggaagaatgggttttctcactggattaaaagtggaaaccctttccagcaaaaattaccaacctccaatgaaggtcgtggttactcgcaacctaatggatcagtttgtggtgaatttgacggaagttcaaccaataattttcatgacgataaaacacccagaaagaatgatatcaatcaaatgaatggtgccaattctgtttcagaagatgaaaatgaggatcttcttgctgactttattgatgaagatagtcaactaccaagtcgaagttctaaaccccatcattcaagagctctctcttcacatgttaatgacgaagagaatacaacacaaactggatcttctctctgtctattaaagtctatggataaatatgcaaggcttatgcagaaattggaagtggtaaatgttgagttcttcaagggagtatgccaattgtttggattttttttctattttatatatgaaacatttggtcagcaaaacgctagttcaactggaaaaggcacttctagctctcttaactatcgcctgagaacagctttatccagagtaaaccaagattgtgaagagtggattaagtctcaatcatcgtcaccaacatctttgagttcaccatttgtacatgctgagttgacacctacacaccctcccaatacaaattatggtcactcctcagggacttctttgggtctgaaggaaagatgtgtggctgttgacactatatctcttgttgctcgaatactgaatagatctaaagctcatctccaatcaatgctcttgcaaagtaattcaactatacttgaggatttctatgttcatctggtggatgctgtaccagatcttacagaacatgttcatcggactacagtgagactactgttgcacattaatggatatgttgaacgtgttgccaattgtaaatgggaagtaaaagagcttggcatggagcataatggatatgttgatttgatgctgggggagtttaagcactataaaacacgacttgctcatggaggaattcgtaaagaggttcaagacctattattggattatgggcttgaaattgtggcggaaactcttgttgaaggactttcacgggtgaagagatgtagtgatgaaggacgggcccttatgtcattagatctgcaggttttgatcaatgggttacaccattttgtgtcgctgaatgtgaagcccaagctacaaatggttgagactttcatcaaggcttactaccttcccgagacagaatatgtgcactgggcacgagcacacccggaatacagtaaaagccaggttgttggactggtcaaccttgttgccactatgaaaggttggaagaggaaaaccaggttggacatactagaaaagattgaatgagcatgtcttttgttgtgtatcaagtcaggcaaatagaatcttctgctcctcgagacccagctttcttgtacaaagtggtgataaattggagctctgcagagctttcgttcgtatcatc

SEQ ID NO: 596 - DNA, 702 bp, Glycine max
ttcttgtttgttgattaacccttaattaatccgggcgcgcctgatttatcacaagtttgtacaaaaaagcaggctcctgcaggaccatgtctcccgccctcaccactctgtcaccgccgttatctctttccgttacttcggcggcgcgtcgtccacggctgacagcgatggtgaagactgagaaaaagcaaagccttggcttcggcagcgataagaaggaaacaaagtggcactgcgtggagggttgtggttcctgctgtaagcttcaaaagggtccatcttttccctctcccgaagaaattttcgacgacccttctgacgttcagttgtacaaaagcttgataggtcctgatggatggtgtattcattatgagaagagtactcggaaatgctccatttaccctgagcgtccatatttttgccgtgtagagccagaggtatttaaatctttgtttggagttaaagagaagaattttcacaaggaggcctgcagtttctgcagggacacaattaagtctatttatggtcccaattcaaaggagcttcataatttcaacagctcaataaggaactcttctagttagattttgtgggatttggattcttaattgctcaaggttgttttcttgtctctcgagacccagctttcttgtacaaagtggtgataaattggagctctgcagagctttcgttcgtatcatc

SEQ ID NO: 597 - DNA, 1507 bp, Glycine max
ttcttgtttgttgattaacccttaattaatccgggcgcgcctgatttatcacaagtttgtacaaaaaagcaggctcctgcaggaccatgggagggaagagctcaaaagggagtggtaggaggtatgattttggtgcttcttcatcttcacgggataataactatggtggataccatccacaatcaccatacccttcttatcaaacacctcagcacccgcgtgcatcagctccattttatgactatgcacagccaaaaaggaagttggataagaagtattccaggatagctgataattaccgttctttggatgaggttacagctgcacttgcaaatgctgggctggaatcttctaatctcattgttggcattgatttcaccaagagcaatgagtggacagggaagaggtcattcaatcgaaaaagtttacatgacattagaagtggtcaaaacccttatgaacaagcaatttctattatcgggaaaactttatctgctttcgatgaagataacttgattccttgttttggatttggagatgcatctacacacgatcaagatgtatttagtttctattcagaagagaggttctgcaatgggtttgaggaagttctgacacgatacagacaaattattccttccctaaaactcgcaggacccacttcgtttgcccctattattgaaatggctatgactattgttgagcaaagtggtggccaatatcatgtcttgctaataattgcagatggacaggtgactagaagcgttgatacacaaaatggcaacttaagtccgcaagagcagaacacaatagatgcaatagtaaaagccagtgagtatccactgtcaatagttttggtgggagttggagatggaccatgggaaatgatgagggaatttgatgataacatcccttctcgggcatttgacaattttcagtttgtgaattttactgaaataatgacaaggaatgtagattcaaccagaaaagagacagattttgccctttcagctttgatggagataccttctcaatacaaggcaaccctagagcttggcatattgggttcacggagggggcattcaccagatagggttgctctacccccacctctttatagtagaacctcttccagcatcagcacaaaatctacacggtctaacagttttcagcagaggacacctacacatactagctatgatagcagtgttcacacagagacatcatcaagttctttatatgataataaggtttgccccatttgtcttaccaatgcaaaggatatggcctttggttgtgggcatcagacttgttgcgagtgtggagaggacctccaattctgtcccatttgccggagcacaatccatactagaataaggctttactagttagctttgatgcagaagtcctgtcaatgaatttcgtcatttccagaatctcgagacccagctttcttgtacaaagtggtgataaattggagctctgcagagctttcgttcgtatcatc

SEQ ID NO: 598 - DNA, 1377 bp, Glycine max
ttcttgtttgttgattaacccttaattaatccgggcgcgcctgatttatcacaagtttgtacaaaaaagcaggctcctgcaggaccatggacactgatgccactggagatcctgttgacaagctcaaggctatccagaatgatgatgtagaatatcaagacgaagatgatgattttgatgacgaagaagaagaagaagatgaccctattactcttggtttcgttgacaaacccaagaatgaatggtctcttcgccgtcaatatttcccaagcaaaactggtggagtcccggcttggcttgaccctctgaatataccatcagggagatcatctgtgtgtgacatttgtggagatcctttacaactcttgcttcaggtttatgcaccaactgacaaggaaaccacatttcaccgaatgttgtttgtttttatgtgtccctccatgaaatgtcttcttagggatcagcatgagcaatggaaacgccatccagagaagccatctagaagtgtgaaggttttccgttgtcaactaccccgcattaatccattttactcacctgaatgccctcagtataatgagagccacgaacctgctggcagtggagctgctctttgtgattggtgtggcacctggaaaggagacaagctttgtagtagttgcagacaagcacggtattgctctgagaaacaccaggctatgagttggcgcacagggcataaaactgcttgccaacagacgaaagtttcttcacctgtttttggacccaacaaaagtggaaccacctccttggagtctcataaagttggaagcaagaatctgtggcctgaatttgagatcagcattgaagatgaaagtgaatataatagggacatatctgaggaaaatagcttagctaattccttgatctctaggaacaggaatgatgacacaatgaattcacttatggataactttaagggtgatgatgacaaaaagagctgggcctccttccaggaacgcattgccgaggctcctgaacaagtgttgaggtattataggaatactaatgccaagccaatatggcctgtttcaagtggtcgaccatccaatgctgatatccctaaatgcagttactgcagtggaccaatgtcttgtgaatttcagattttgccacaactgctctattacttcggcgttgacaacgaagtggactctctggattgggcttcaattgtggtgtatgcgtgtgaagcctcttgtgaagcaagtttgccttacaaaaatgaatttgcttgggtacaaatttattcactttccacaaccttatagctcgagacccagctttcttgtacaaagtggtgataaattggagctctgcagagctttcgttcgtatcatc

SEQ ID NO: 599 - DNA, 1889 bp, Zea mays
ttcttgtttgttgattaacccttaattaatccgggcgcgcctgatttatcacaagtttgtacaaaaaagcaggctcctgcaggaccatgccagattggagggtgcgtgagtttgaaggtaaattcactgatgagtttgcccacagtaacaacaacaaacatgaaagtggagttgaggctcctggtgtcactagtagtaagaagttgaagcatacagttgccggtgagaaaattcaaggtgtcatccctggaataaatagctcagatccacagaaatgtaattcagagaacatccaacatgagaacaggatagtatcccagaatataaacagtgctggtgactgcattggagactgcaaagacagctccaacgccttctcttcaagggaagaaaatacaatcgctgaaaccagatgtccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatgttgctttgcagcaagggtttgactcgtcttattccgattatgatattctggatgatctctcagcattccaatgtgcagaagataaatcactaccctcagttggtccttcatcggatttatgtgataatcaattcaatgatacctatctgttcagtgagcagaagaatgcgaatgcatatggtgaacagatataccaagaggatgtgatggagttgttgcccactgaccagatatgcagtggacatgaaaacattgatatgttgcagggtggaaaccagtattcatctgaacatacaattcaaggtattgaagacaagaaattttctatagcatcaacttctcagctgagctcctctcagaatttactgaagcaaaggcaccacttagattccaattcaccaagcaacattacttatgaggcctatgaagaaaagttcggtccatctagtggttcttttgcacaaaggaatttaaaagtgcagaagaaaactatgaacatgcaaccaacacagccgataaatgataatgtcatgaacagacatcctcaaacattgacaagaagtgcttcttatccttgtgagaacaatgaatctgaaagaagaggattagggaaaagaactctgggggatcctcaagttacaatgggtacttcaatggtagtggatggctcatttgtatcatccatgtcctctgatatctctgttgaagaaagcagctttcgacaactgcagaatgctgttagtcagctggatgtgcaaaccaaattgtgcattagagatggtttataccgattggcacgaagtgcgcagcacaggcaagttatcccaaatatgatgagcagcaatgaagacaacccggatataaaggacctgcagaatgcagaaactttgcgcaaattcgtcgatcctcggagcatcgagacacagacaaacccgatcgaccggtctatcgctctgctacttttccaccagtcatcggaccatgcggctgtggctgtcgacgatgcctcatcacttaaaccccctgctggtagcaaacaccaccagggccctgctgctaaccaaaaccaaggcctgataccagattcatcggtgtattcccctggagatggggcccccaaggatgtacagtccctggacaagttctgactcgagacccactttcttgtacaaagtggtgataaattggagctctgcagagctttcgttcgtatcatc

SEQ ID NO: 600 - DNA, 1508 bp, Zea mays
ttcttgtttgttgattaacccttaattaatccgggcgcgcctgatttatcacaagtttgtacaaaaaagcaggctcctgcaggaccatggtggctatggttacgacccatattattctcctattgcaacacctgtaccaaatgctgttagtggagggtgatacaataatgccgattgacccaacacaaggagcttttatcgctgataccctgagtccaaacagcttcctgtttggcccaagacctgaatggttcagatcttcagaaggaactgggtcatttccatcacctgcagcttcacctcaaccttctaggggtgttccagggtcctatgaccaaaacaactttccaatggcttcaagaatgtcatcacctcaccagaagcccttctatggtttgagatccacaactgactcctatggaaggggtttttctcatggtggaatgttcccacaggccagtaattatgggggatccgtcaccagctttggccttaatggtagaagtttgatctcaaccgagaaagggcgcaggaggggaaggggcaatgcacttatttgcagctgcaatggtcctcttgactttcttaatgagcaaagtcggggtccacgtgcaactaagcctaagaagcaaccagaggttgacagtaaggatgaggtgcctactacaggagttggtcgtgagttatacaacaagcctgactttgttatggagtacacgaatgcgaggtttttcatcataaaatcgtacagcgaagataatgtgcacaagagtgtcaaatatggtgtttgggctagcaccacaaatggaaacaagaaactggactcagcctatcgcgaagctaaggagaaaggagagcactgtcccattttcctgttattttcggtgaatgccagtgcacaattctgtggtgttgctgagatgattggaccagtggactttgagaaaagtgtggattactggcagcaagataagtggactggtcaattccctgtgaagtggcacatagtgaaggatgttcccaataatcttttccgacatataattcttgaaaacaacgacaataaacctgtaacaaacagcagagatacacaggaggtgaaactagagcaaggaatggagatgctgaagatctttaagaaccatgatgatgatgcatcaatccttgacgactttgagttttacgaggagcgtgagaaagcgctgcaggaaaataaggcacgcctgcatcagcaacatctacccagttctattgttattgagcccaagaaacccttgactgcacccagtgacctcgtgggccatatcaccaagagttttgctgaggctgtgcggcttggtgaggccaagactgtaagccatttgactgagaaggtttctgggggtgatccgtctattcctgtgaagcatgttgaagttaagcagagtggtttatcttagctcgagacccagctttctgtacaaagtggtgataaattggagctctgcagagctttcgttcgtatcatc

SEQ ID NO: 601 - DNA, 655 bp, Zea mays
ttcttgtttgttgattaacccttaattaatccgggcgcgcctgatttatcacaagtttgtacaaaaaagcaggctcctgcaggaccatggcgatgaagcggccggcgcgcagcgacccacacctgccacccgaggaggcggcacgggtggaggccgaggttcggagctacttcgacagcgtcgcgccgaggcgcccggccaagccgccgcgcagcgacccgtcggtggacaccttcgcggaacccgccgccgtcgacgccggggaccacgacttgccggagctccgcaagctgcgcgacctcgaggcgaagccccagaagctggtgttggacggagggggaggggacgtggatggcggggaggattacgtggagacgcgatactacgatggcctcataggcatcgacaagcagcatcacacgactgggacaggctttatcaaagtggagagatccaatggcagcagcttcagtgtgatgactaacggctacccacctgccagctctgtccgctgcacgagcaatcctgcgacaaatgattggataccatcttctgaatcgatcatccctgcatcgaacaagcccagcaggagcgactcctgactcgagacccagctttcttgtacaaagtggtgataaattggagctctgcagag

SEQ ID NO: 602 - DNA, 617 bp, Zea mays
ttgttgattaacccttaattaatccgggcgcgcctgatttatcacaagtttgtacaaaaaagcaggctcctgcaggaccatgggcgggttcagcctcagcggcgctacaggtctcgcggcgtaccgcgaggaagacgacgaggagctgttcgagacgtcgtcttcgatctccggcgactccgacgatgagggccaccagctctccgatggagaggggggcgcctatgatttgtcatctgtgatggcacagctccctgtcaagaaagggctatccagatactacgacggcaagtcccagtccttcgcgtgcatgtctgaagtgcgatgcctggaagatctgcgcaagaaagagacgccctacaagaagatcaagacatcaaggagtagcgtcgcgttagacgaagagcaggactgtcatacgccgggtcgtacgaacagcagcagagcgcccggaagttgttgcgcaaacctggtggctcggaacaacggcaaaaacatgctgtacagacctcccccagtccctgtaaacaaaagtggataccgtcagtagctcgagacccagctttcttgtacaaagtggtgataaattggagctctgcagagctttcgttcgtatc

SEQ ID NO: 603 - DNA, 1064 bp, Zea mays
ttgattaacccttaattaatccgggcgcgcctgatttatcacaagtttgtacaaaaaagcaggctcctgcaggaccatggctatgcaggccgcaaggaggctagcatctttgaaactccaacgacccctactccttccctctcaggccgagtccccaagcataagcatcccaaccgcagcggcggcggcagccttcctccactcccatgccaccagcttcgggtacaagcaggttcgcgaagaggataagagcaaattggttggcaacgtgttcagcagcgtggcttctagctacgacctcatgaacgatctcatgagtgtcggcctgcataggctgtggaaggacaggcttatttccaagctgaaccccttttcggggatgaagcatctcgatgtggctggtggaacaggtgatgttgcttttcgtgtactggaaagagttaagagtgtgggtcacagagctatgcagggtactcttactgaaaccgaagaaggcacccacatttatgtctgtgacattaatccaaatatgctaaatgttgggaaaaagcgtgctgcagaaagaggttatagcgaagaacattgtcttagctggatacaaggagatgcagaagctctgagttttgaggatggatctatggatggttacactatcgcatttgggatcagaaatgtgacgcacattgagaaagctctgtcagaagcttacagggttctaaagcaaggggggaggttcctatgcttggagttgagtcatgtggatgtccctatttttaaagagatttatgatgtttactcgttttctatggttccggctattggagagctggttgctggtgatcggcagtcgtaccaatacttggttgagagcatccgtcggtttccgaatcaggaaaagtttgctcagatgattcaggaagccggattccagagggtggaatatgagaacctcgtgggtggtgtagttgccattcattctggactgaaactgtagctcgagacccagctttcttgtacaaagtggtgataaattggagctctgcagagctttcgttcgtatcatc

SEQ ID NO: 604 - DNA, 819 bp, Zea mays
ttcttgtttgttgattaacccttaattaatccgggcgcgcctgatttatcacaagtttgtacaaaaaagcaggctcctgcaggaccatggcgtccgcgacgggggtttcctcctcggagatggcggtggaccacgcgacggggccgggcgccgtggacaagccgcggttcgatgctctgacgccgaatgagatgagcggcgggaggccccagttccggaaagtgcccgtcccgcagcaccggttcgcgccgctcaagcgatgctggatggaaatctacacacccgtatacgagcatatgaagatcgatatacgcatgaatctcaaggcaaggagggtggagctaaagacaaggcaagacacaccggacgtgagcaaccttcagaaatgtgcggactttgtgcatgcttttatgcttgggttcgacattgctgatgccgtcgccttgctgcgtcttgatgacctgtatgtggactccttcgaaatcaaggacgtgaagaccctgcgaggggagcatctgtcgcgtgctattggccgcctatcagggaaaggaggcaagaccaagtacgccattgagaactctaccaggacccgcatcgttatcgctgatacaaagatccatatacttggatcctttgttaacatcaaggtcgcgcgggattcgctttgcagtctcatcttgggttcacctgctggcaaagtgtattctaagctaagggctgtatcagctaggttggcggaaaggtattaactcgagacccagctttcttgtacaaagtggtgataaattggagctctgcagagctttcgttcgtatcatc

SEQ ID NO: 605 - DNA, 992 bp, Zea mays
ttcttgtttgttgattaacccttaattaatccgggcgcgcctgatttatcacaagtttgtacaaaaaagcaggctcctgcaggaccatgtatagtaattacgggaatccttcggggatgcagatgcccccgcaaaactctcaacctgtccagtttgataatccattatacggtgcaagctcgggcctaatcagatctgggataggagtatatggggagaagtttttgggttctagttcagaattcatgcaaagcaacatcaatagatacttctccaacccgcagtattacttccatgtgaatgatcaatatgtccgtaacaagttgaaagttatactgttcccgttctttcacagggggcactggactcgaataagtgagccggtcggtggccgcttgtcctacaaacctccaatctatgacataaacgcaccagatctgtacatccctttcatggcatttggaagcttcatcatcctttcagggtttacattgggtttcatgggaaagtttactccagcagctataaatctgcagtttacaagggcgctcatcggctggggcttccagctcatggtcctgaaaggtctgctctactcgatgggtggtggcgaggtgccactgctcgacttggtagcgtacggcggttatttattcgccgggctatcgctcgccgtcgtcgcgaggctcgtgtgggcgtactcgtactatgtgatgatgccgtggatgagcctgtgcatgggggtgttcctggtgaggacgatgaagagggtgctcttcacggagatgagaagcagcgagaggcactcgtcgcggcagcactacttccttctcttcatggcaatcgcacagttccccctgttcttctggctcggcagcataggtgcatgatacagttttgtgtacttttcgcagcattaacgttgcaaaaatgatattctcgagacccagctttcttgtacaaagtggtgataaattggagctctgcagagc

SEQ ID NO: 606 - DNA, 1479 bp, Zea mays
ttcttgtttgttgattaacccttaattaatccgggcgcgcctgatttatcacaagtttgtacaaaaaagcaggctcctgcaggaccatgccgtccatcacgcactacgtgctggatcgcctcctagagacacggtcgcctgttcatgtccagaaggtggttcccaagcctccgcccccgcctcctgacaaggccacaccggtgccagtgtctactgccaggacacggtcgtcgctggcatcactctatgccacgcctgagaacaccaccctgccggacttgccttcctcgttcccgggaacctggtcgccatacctcatcaaccataagaggcggggagcctcccttgccaggaccttctctcagggtgatgctgggagggaggtcagccagccaaacctccctgtgatgctgcctgctttgccgagagggtgtgaacccactcaagtccaggagcccgagtttgtgtttcagcaagcaggcaatggtcaagctgaaggtgaaagtgctgtagaagaggctttgaatggcaaaagtgtaatgctacagaaaggcaaggggtctgttatagctgaaatagagcaggagcagcctgagtttgagttttgtcaaagtcttgaagcattagtgaagcctgttaatgttagaaggcctttgaatggtgaggcacccaaaatttgtgagagtgacacctttgaatggcggaagcctagttcacctcttggaacctctgttggtacaccaggtgcagaattctacgatgcatttgaagaaatatccagtgacggtggaactcggtcatcgcgaggcatggatgatgacctccgtgaaatgaggttaagtctgttgatggaaattgagaggaggacacaaacagaagaagcacttgagatctggcaacaggaatggaagaacctgagtcaccacctatctcttgttgccttatcactaccatctccaagtatagctgaggattctgattgtttaaaggtggatcctggagctgagttgtgccagcaaataactgtttcacaacttgtggctgctgctattgctcggggttttgctcgtgctgaagttgaatcagagatggaaactatgattgcgacaaagaactttgagattggaaggctgtcggatagggtccagtactatgaagctgcaaacagggaaatgtctcaaagaaaccaagaagctatcgagatgtcaaggcaacaacgcaaggggcgtaagaagcgacagaagtggttctgggcttcagttgggcttgcagtcacccttggcgccacagccattgcctggtcttacgtaactccgtcgcagccccaggccagtgcagatccaagtagtgctgccagccagtaagctactaagtaagctaggatgaagacatactcctcgttccagaagctcgagacccagctttcttgtacaaagtggtgataaattggagctctgcagagctttcgttcgtatcatc

SEQ ID NO: 607 - DNA, 487 bp, Arabidopsis thaliana
ttaattaaatggacgctctcattgctcagcttcagagacaatttcgtgattacaccatttctctctaccaacaggggtttttggatgatcaatttactgagttgaaaaagctacaagatgatggaagtcctgattttgtgtctgaagtgctttcacttttctttgaagattgtgtgaagcttatcagtaacatggctagagccttggacacgacaggaactgtagattttagtcaggtaggtgctagtgtgcatcaattgaagggtagtagctcaagtgttggtgccaagagggtcaaaactttgtgtgttagcttcaaggaatgttgtgaagctaagaactacgaagggtgtgtgagatgtttgcagcaagtggatattgagtacaaggcgttaaagacaaagcttcaagatatgttcaatcttgagaaacagatcattcaagctggtggtatagttcctcaagtggatattaactaaatttaaat

SEQ ID NO: 608 - DNA, 3039 bp, Arabidopsis thaliana
gcacgagaggaggaagagtgtaagcaataaattcctcttcttctacgaaacatttgctcttctcctctttctcttctcttctcttctcctttgcttctccgattctcttccttttttttagtttgatccgactactcaagctttttttctgttcatggtttcctccatcatcgcagttgcagaaggcaaaaagatggagctagaacccaataaatcactatctgctgatatgccatctttgctgagtagatcatctgaagcttttaatggaggcactggatatcgttcttcaagtgatctcagcatgttctcaagctcattgcccacactttttcatgaaaagctgaatatgactgattcagatagttggctctcctttgatgaaagctcacccaatctgaacaaacttgtcataggaaactcagagaaagattctttggaagatgttgaacccgatgctttagaaatattgctgcctgaggatgaaaatgagctccttcctggcgtcattgatgagcttaattttaccgggttgcctgatgaacttgacgatctcgaagagtgtgatgtcttttgcacgggagggggtatggagttggatgttgaatcccaagataatcatgctgttgatgcgtcagggatgcagatttctgatcgcggtgctgcaaatgcatttgttcctcgtaaacgtcccaatacggctggtagagtttcagtggaacatccaaacggtgaacatccttcaaggacattatttgttaggaatatcaacagcagtgtcgaggattctgagttaagcgcccttttgagccgtttggggagatcagaagtttgtacactgcatgttaaaagcagggggtttgttatgatatcctactacgatattccgagctgctccatgcccgccaatgccgttgcacttaccagaaacacacttttaagaaaaaggacactggacattcacttttccattcctaaagaaaatccatcagagaaggatatgaatcaaggaactcttgtgatttttaatgtggacacaacagtatcgaatgatgagctccttcagctgtttggtgcctatggtgaaataagagagattagagaaaccccaaacaggcgattccacaggttcattgagtactatgatgttagagatgaagagacagccttgaaagcactgaatagaagcgagataggtggaaaatgtataaagctcgaacttagtcgtcctggaggggctcgtcgactgtcggtcccgtcacaaagtcaagatttggagagaaccgaagttacaaatttctacaatcaagtaggttcacatgttgctaattctccaccaggtaactggccaattggtagcccagtgaagggctctccttcgcatgcctttacgaggccacatggtctaggaatggtcaggccagttaactcagacaatatgccaggactggcttcaattcttcctgctcatccttctagctttcatggattttcaccagtcagtaatgaccaagggctattgaatcattcaaaccaaactattctgaataagggattgatgcacaacatttcctatgggcaacctcattctttgccagagcatataacagggggaatttccaactccatgaggtttatagctccacactcctcaggattcgggacttcatctgatcaccgctatcgctggggaagccctcctcagcatatgaattatcctggttacactggagtgtcgtcgtcatcgtcatctactgaacgtcctttcactgtcaggcatggttttccatttgctgagaggcaggcttcattgcttggaaaataccagcatcatgtgggctctgctccctcaagcattcattttaatacacaaatgaattgctacacgggatcaccagagataccccttggatttagtgatatgggaatcaacagaaactataacagtgctcatggaaaagcaaaccttggtgttagtctaccggggaacagtagtgaacaggatttcactggctttggcatgtcttcaatgcctacagttcctttcggtgggagtagaggattacaatcagtaaggcctgaaccttttgctgagcagggtaggatacataaccacgagagtcacaatcagaatcagttcatagatggtgggagatatcatatcgacttggataggattgctagtggagatgaaatccgaactacattaatcatcaaaaacatcccaaacaagtacacttacaagatgctggtggctgaaatcgacgaaaagcacaagggagactatgactttctatgcttgccgacagactttaagaataaatgcaacatgggtcacgcttttatcaacatggtctctccattgcacatcgttcccttccaacagactttcaatggtaaaatatgggagaaattcaacagtgggaaagttgcttcattggcatatgcagagatccaaggaaagtctgcccttgcgtcatacatgcagactccaagttctatgaaggaacaaaagcaattgtttccagaagtctcctaccatgatgatggtcaagacgccaatgatcacgagcaactgttttcaagcatttggaacataaccgcgcctgattcagattggtcttacacaatggatcttatcgaaaatccgagggagaacggtaactccaagaatgctgcagaagagtcctcttgaatccccactaaaactagtagttgggaactctaactcaccatcaaaggtaaactaagtgtacaggtctggcgcggttatggaagaaacagaatgtacagtattaaggcttgttttctccacggaacaaagtaaccagtttttagggattacttcactcgaagcaaccgattaaagaaacatccctattagtacattacgttgtatactttatattcggaaacttctctctatatcagtcatgtgtatataacatcctcttgcgtgtacattatcctttccatgtgaaagacatgatcagtatttagttgtacaacaggttcgttataaaaaaaaaaaaaaaaaaa

SEQ ID NO: 609 - DNA, 2316 bp, Zea mays
ttcttgtttgttgattaacccttaattaatccgggcgcgcctgatttatcacaagtttgtacaaaaaagcaggctcctgcaggaccatggcgccccccgcgctggactctctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccttacttcaactaccgcaccacgctcttcctcaccgagaacggcttcagcgagttctggaactggttcgacttcgagagctggtacccgctcgggcgcgttgtcggggggacgctctacccgggtctgatggtgaccgccgcgctgctccaccgcctcctccgcgcgctctacctcaccgtccacatccgtgaggtctgcgtcctcaccgcgcccttcttcgctgccaacaccacgctcgtcgcctacgccttcggccgcgagatatgggactccggggcggggctcgtcgccgctgcgctgatcgccatcgtccctggctacatctcccgctccgtcgcggggtcctacgacaacgagggcgtcgccatcttcgcgctgctgctcaccttctacctcttcgtgcgcgccgttaacactgggtcgctcgcctgggcgctcgcctcggcgttcggttacttctatatggtgtcggcatggggaggctacgtgttcatcatcaatctcgtcccgctttatgtgcttgtgttgcttgtcactgggaggtactcgcagaggctctacgtggcctacaattgcatgtatgtgcttgggatgttgcttgcaatgcagattcgttttgttggattccagcatgtgcagtccggagagcacatggctgctatgggagtcttcttcctgttgcaggttttcttcttcttggactgggtgaaatatctgctaaatgatgccagactattcaagtcattccttcgaattaccctcacatgtgtgattactattggcaccctggctcttggacttggtactgcatctggttacatctccccttggacaggacggttttactccctgcttgatcctacctacgcaaaggaccatataccaatcatcgcatctgtttctgagcatcagccaacagcatggtcctctttcatgtttgacttccacatcctacttttcttgttcccagctggcctttatttctgtttcaagcgcctgtcagatgccacgatatttattgttatgtatggcctcacaagtatgtactttgctggtgtgatggtccggttaattcttgtggcagcaccagccgtttgccttattagtgcgattgctgcatctgctacaataaaaaatctaaccactttgatccggacaaagagcaaaagtccacagactactggaaaaacaactggttcaaaggcaggtgcaaagggagcagttgatcaatctttaccattccaacacaatgcagctattgctcttcttctcggtgccttttacttgctcagtaggtatgcaatacactgcacttgggtgacatctgaggcctactcttctccatctatagttttggctgcaaggggtcataatggtggaagagtcatctttgatgattatcgtgaggcatactattggcttcgtcagaacacgcctcctgatgctaagattatgtcttggtgggactatggataccaaattacagctatgggtaacagaactgttattgttgataacaatacatggaataacacacacatagctacagttggacgagctatgtcatcttatgaagatgaagcatatgagatcatgcagtcacttgatgtgaactatgtgcttgttgtgtttggaggtgttactggatattcttcagatgatatcaacaagttcttatggatggtacgtattggtggaggagtttttcctgtaatcaaagagccagattaccttgttaatggggagtatcgtattgacaagggggcagcacccaaaatgctgaactgcctaatgtacaagctttgttactaccgatttggagaacttaccacagaatatggaaaacctccagggtatgatcgtgtacgaggagtggagattggcaacaaagacataaagcttgaatacttggaggaggcatttacaacttcaaactggatagtgcgcatatacaaggtgaaacccccaaagaacaggtcctgactcgagacccagctttcttgtacaaagtggtgataaattggagctctgcagagctttcgttcgtatcatc

SEQ ID NO: 610 - DNA, 2399 bp, Arabidopsis thaliana
ttcttgtttgttgattaacccttaattaatccgggcgcgcctgatttatcacaagtttgtacaaaaaagcaggctcctgcaggaccaaagctttcatttttcaatctcatcagagagaaattaagctatggcgaagaagattggagtaacgatggaagttgggaacgatggtgttgctgtcatcaccatttctaaccctcctgttaactctttagccagtccaattatttctgggttgaaggagaagtttcgtgacgccaatcaaaggaatgatgttaaggccatcgtgttgatcgggaacaatggaagattttcgggtggttttgatatcaatgtctttcagcaagttcataagactggggatttatcgcttatgcctgaagtatctgttgagcttgtgtgtaacctgatggaagactccaggaagccggttgttgctgcagttgaaggattagctcttggtggtggtttggaacttgcaatggcgtgtcatgccagagttgctgctccgaaagctcaattaggcttaccagaactgactcttggagtgattcctggttttggaggaacccaacgtcttccaaggttagtaggccttgcaaaagcaacggatatgatactgctttctaagtcaatatcctcagaagaggggcacaaactgggtctcattgatgccttggtgccacctggagatgtgttgagtacatccagaaagtgggctctagacattgcagagggacgtaaaccctttctgcagtcactgcacagaaccgacaaaattggttctttatctgaagctcgtgctatattgaagaattcaagacagctagccaagaagattgccccaaatatgcctcagcaccatgcttgcattgaggtgattgaagaaggaatcatccatggaggatacagtggggttctcaaggaagcagaagttttcaagcaactagtactgtcagacactgcaaagggtcttgttcatgttttttttgcacaacgtgcaacatcaaaagtgcctaatgtaactgacgttggattgaaaccaaggccgataaaaaaagttgcagttattggtggcggtctgatgggttcaggcatcgctacggctctacttctaagcaatataagagttgtgctcaaagaaataaactcagaattccttatgaagggaataaaatcagttgaagcaaatatgaaaagcttggtatctagggggaaactgacacaagataaagcaggaaaggccctctctttgttcaagggagtacttgattacacagaattcaatgatgtggacatggtcatagaggcagtgattgaaaacattcaattgaaacaaaacatattcaaagaaatcgaaaaggtttgttcaccccactgcattttggcgagtaatacatctactatcgacctcgatgtaattggtgaaaagactaactcaaaagatcgcattgttggcgcacatttcttcagtccggcccatctgatgccccttctcgagattgttcgttcaaagaatacttctgctcaggtgattctggatctcatggcggttggaaaggccataaagaaagttcccgtggtggttggaaactgcataggctttgcagtgaataggacattctttccttattcacaagctgcacatatgttggccaatctaggtgttgacttgttcagaattgacagcgttattacctctttcggcttgccattgggccctttccagcttggtgatttggctggacacgggattggattagcagttgggccgatatatgccaaggtctatggtgaccgcatgttcagatctccaatgacagagcttcttcttaagagcgggcgaaatggaaaaatcaacggaagaggatactatatatacgaaaagggaagcaaaccaaaacctgatccatcagtgctttcaattgttgagaaatcaaggaaactgaccaatatcatgcctggtgggaagcctatatcagtaactgataaagaaattgtagagatgatcttattccctgttgtcaacgaggcatgccgcgtcctagatgaaggagttgtgatccgagcctcagacttggacattgcgtctgtccttggaatgagttttccttcttaccggggaggaattgttttctgggcagacactgttggaccaaagtacatatatgagaggctcaagaaattgtcggagacttatggcagctttttcaaaccatcgaggtatctggaggaaagagcaatgaatggaatgcttttgagtgaatcgaaatcgtcgaggtccaaattgtgaagcgtttaattaagtatatgcagaaggagaggctgactcgagacccagctttcttgtacaaagtggtgataaattggagctctgcagagctttcgttcgtatcatc

SEQ ID NO: 611 - DNA, 2316 bp, Arabidopsis thaliana
ttcttgtttgttgattaacccttaattaatccgggcgcgcctgatttatcacaagtttgtacaaaaaagcaggctcctgcaggaccatgatccttctctcacttcttctccatcttcttcttcatctcctcaacacttctccttctctttctctttcccccgacggtatcgctttactctcactcaaatccgccgtcgatcactcctcctcctccgctttctccgattggaacgataacgacaccgatccttgtcattggtccggaatctcctgtatgaacatctcagactcttctacctctcgcgtcgttggaatttccctcgccggaaaacatctccgtggctacatcccctcagagcttggctcacttatttacctccgtcgtcttaacctccacaacaacgaactttacggttcaattcctactcaattattcaacgcgacgtcgcttcatagtatcttcttatacggtaacaatctctccggtactcttcctccttcgatctgtaaactcccaaagcttcagaatctcgatttgtctatgaattcgctctctggaactctttcaccggatctcaacaagtgtaaacagcttcaacggttgatcctctccgctaacaacttttccggtgagattcctggtgatatctggccggaattgactaatttagctcagcttgatctctctgctaacgaattttccggcgaaatccctaaggatatcggagagcttaagtctctctctggtactttgaatctctcctttaaccatttatccggccaaatccctaattccttaggaaatctaccggtgacagtctctcttgatctccggaacaacgatttctccggcgagattcctcaatctggttcgttctctaaccaggggccaaccgcatttctcaataatccgaaactgtgtggtttccctctccagaaaacttgtaaagacactgatgagaactctccggggactcgaaagtcgcccgagaataatgcggattctagaagagggttaagtactggattaatagtgttgatctcggtggcagatgcagcaagtgtagcttttattggtttagtgttagtttacttgtactggaagaaaaaagactctgagggagggtgtagctgcacagggaatgcgaaactcggtggtggttcggtgaaggggaaatcgtgttgttgtatcacggggtttccgaaagaggatgattcggaagcggaaggtaatgagagaggagaagggaaaggagatggagagcttgtagcgattgataaagggttttcttttgagcttgatgagttgttgagagcttctgcatatgttttggggaagagtgggttagggatagtgtataaagtggtgttagggaatggagttccggtggcggtgcggcgacttggggaaggaggggaacagaggtataaagagtttgttacggaggttcaagctatggggaaagtgaaacatcctaatgtggtgaagttaagagcttattattgggctcctgatgagaagcttttgattagtgacttcgttaacaatggaagtttagctgatgctcttagagggaggaatggtcaaccatcaccgagcttaacatggtcaacgcgtataaagatcgcaaaaggagctgcgcgtgggttagcttatctacacgagtgtagtccaaggaagttggtacatggcgacgttaagccttccaacattcttcttgattcctccttcactccttacatctctgacttcggtctcacacgtctcattaccatcactgccgcttctgcctcttctaacgaaccttcctcctcctctgctgcgggtggtttcttaggtggagctcttccttacacttccatcaaaccctcagatagatccaacggctataaagcccccgaggcccggctccctggagggaggcctactcagaaatgggacgtatactccttcggtgttgtgcttatggagcttctcaccgggaaatcgccggattcttctccgttaagctcttcctcgacgtctacggtggttgttgaggtgccggatttggtgaagtgggtgaggaaagggtttgaagaggagactccattgtcggacatggttgatccaatgttacttcaagaagttcacgccaagcaacaagtcttgtccgtttttcatctagctctcgcttgtaccgaaggtgaccctgaagtccgtccacgtatgaagaacgtctctgagaacatcgacaaaatctgactcgagacccagctttcttgtacaaagtggtgataaattggagctctgcagagctttcgttcgtatcatc

SEQ ID NO: 612 - DNA, 893 bp, Glycine max
ttcttgtttgttgattaacccttaattaatccgggcgcgcctgatttatcacaagtttgtacaaaaaagcaggctcctgcaggaccatgaggaaatcaaaagcagatgagaagattctcagctacaacgatgtggtgcttaggcgatctgatttacacatccttagtggtccatattttttgaatgatcggattatcgagttttatttcagctatctttcttcatgtcatccctctcaggatatcctgctggttccaccatccattgcattttggataatacaatgccctgtcgctgaggctcttggtgatttcatagaaccccttcatttgcctgataagacactggttatatttcccgtcaatgacaatgatgacgttgacagagctgaaggtggttctcattggagcttacttgcatattaccgcaacgctaatttgtttgttcaccacgatagttgcagaagcatgaatgcagcacccgccaagcaactctataaaggcattgctggatacatgggatcctctggatcagcttctgaggctagctttctggaatgcactaattcacccatgcaagacaatggttatgactgtggcttatatgccacagccatagccagagtaatatgcaactggcatgtaaatcataaaaatgctgatacaaatgatctgtggttttctgcggtgaaggaacaggtttccccatctgctgtcgccagcatgcgaggcgagatcctggccttgatcagagatctaatggcaagacattgagatcagcatgttccagattaaaatctgtcttcttacttggaagtctagaactcgagacccagctttcttgtacaaagtggtgataaattggagctctgcagagctttcgttcgtatcatc

SEQ ID NO: 613 - DNA, 744 bp, Zea mays
ttcttgtttgttgattaacccttaattaatccgggcgcgcctgatttatcacaagtttgtacaaaaaagcaggctcctgcaggaccatgggtgactacacaatccagattagcaccaagctcattgaccagcttgctcgtgatgacgagaaggtaaaacggaaagccaggaagcccaagcctaagaagaagcccaccgtccagccacatgaagagcccctggaattcccgagagaaccaaagacgacaagccttgctactgctcctgggtggcctctgcagcctccccctatgtttctgccagtgacccctgctcccccgccacccccggccacaatgccggaggtggaagccattcgttccgtcctgaaagaaagtgaggcgcttctcaagaagctggagaaccaggaaactggggcacgccaagagctcagcaagagagcaaaggagctgcacgacaaggagttcaagctaccataccagaaacccatgccctgcacccaggagagggcaggctgccttgagtgttacaagaccaatacaaaggacccgctcaagtgtgctgaagcagtcaagagatttgaggcatgtgctctcatggccatcaaaagtactgccgcaaaagctgattagtatgtagtccgtgaaactttgtgagttggggcgagctgatacctcgagacccagctttcttgtacaaagtggtgataaattggagctctgcagagctttcgttcgtatcatc

SEQ ID NO: 614 - DNA, 2484 bp, Arabidopsis thaliana
ttcttgtttgttgattaacccttaattaatccgggcgcgcctgatttatcacaagtttgtacaaaaaagcaggctcctgcaggaccatggaacaattaaaggttttacctttgctctttctttcatgggttatgttcttacaaagcactcatcaactgccgaactctcagactcaggtcctgtatcagctcaggaagcatctggaattccctaaagctctggaatcttggggaaattactatggagacttatgtcaaatccctgcaactgctcacatgagcatcacctgtcaaggtaattccatcacggagcttaaagtcatgggggacaagctttttaaaccatttggtatgtttgatgggtcttcacttccaaatcacactctgtctgaagcattcataattgattcttttgttaccacattgacaaggcttacaagcttgagggttcttagcttagtgtctctaggtatctatggtgagttcccagggaaaatccatcggttgaattctcttgagtacttggatttgagttcaaattttctgtttggctctgtccctcctgatatttccagattggttatgcttcaaagtctgatgcttgatggaaattacttcaacggtagtgttccagacacgttggattccttgaccaatcttactgttcttagtttaaagaacaatcggttcaaaggtccatttccttcttcaatttgcagaattggaagactaacaaatcttgctctatcacacaatgagatttctggtaaattgcctgatctcagcaagttaagtcatctgcatatgctggatctgagagaaaaccacttggattctgaactacctgtcatgcctataagattagttactgttctcctgagcaagaactccttctcaggcgaaattccaagacgttttggcggtttgtctcagcttcagcatcttgacttgtcgttcaatcatctgactggaactccatctcggttcttgttctctttgccaaacattagttacttggatttggcatctaacaagctcagtgggaagctacctcttaatctgacctgtggaggcaaactcggatttgtggatttgtcgaataacagattgattgggactcctccccgttgcttggcaggagcttccggcgagcgagttgttaaacttggtggaaactgcttgtccataattggcagtcatgatcagcatcaagaattcttatgcgaagaggctgaaactgagggaaaacagttccaaggaagaaaggttgggattttgattgctgtcattggtggagctgttcttgttcttgtgttttttgtattagttatcctcctcctgttatgcacaaaccgctgctctagctgttgttcaagagaaaagtcagtgccgcaaactcggcttaaggttgtgacagataactcacacaccagtctctcctctgaagttcttgctagtgcaaggttaatctctcaaacagcaaagctaggtgcacagggtgtgccctcatgccggtccttttcttttgaagatttaaaggaagccacagacgattttgattcatcacgtttcttaggtgaaggctcccttggaaagctatacagaggaacactggaaaatggaagttccatagctatcagatgtctggttttatcaaggaaattctccagccagagtatcagaggtcacttagactggatggcaaagctcaaccatcctcatctccttggcttcttgggccattgtacgcaaaccagcggagaacacgatcctgttgcaaccatactctaccttgtatacgagtatatgcccaacgggagctatcgcacacatctatcagaatctttctcggagaagatcctgacatggccagatcggctagcaattctgattgagatagcaaaggcagttcattttcttcacaccggtgtaatgcctggttcattcaacaatcagcttaagactaacaatattttgcttgacgaacacaagattgcaaagctcagtgactatggagtctctgccatcattgaagagaacgaaaagcttgagacaaagtcagaaacccacaagtcaaagaaaaaggctaaaagagaggacgatgtgtacaacttcggattcatacttctggaatctctgataggaccagtgcccactacaaaaggagaggcttttcttctcaacgaaatgacatcatttgggagccaagacggtcggcagaaaatagtaagtccaacagtcctaacaacaagctcgcaggagtctttatcgattgcgatctcaatcgccaataaatgtgttttgcttgaaccttccgcaagaccttcctttgaagatgttctctggaacttacaatacgcagctcaaatgcagtctgccgcagacgctgaacgcaaatctgatacgtcgtcgtgactcgagacccagctttcttgtacaaagtggtgataaattggagctctgcagagctttcgttcgtatcatc

SEQ ID NO: 615 - DNA, 2400 bp, Glycine max
ttcttgtttgttgattaacccttaattaatccgggcgcgcctgatttatcacaagtttgtacaaaaaagcaggctcctgcaggaccatgagtgttgatggcgacagcaaagagctgaaagaactgaatcagcgcttacgagatgggaagaagattgctggtggggagcatggtttatgcgaggaagtgaaatgtaatggaattgctgaagaagttaaggttgaacagggggggactgtggagtcctcctctgtccagcagcatataccacagcctcaaggggcaataatttgttgggagaggtttttgcatattagatcccttaaggtcttgcttgtggagattgatgactctacccgtcatgttgtcactgcactgcttcgcaattgtagttatgaagttattgaagcagcaaacggattgcaagcttggaagatattggaggatttaaccaatcatattgatcttgttttaactgaggtggcaatgcctggcttatcaggcattggacttctatacaagattatgggccacaaaacccgcaaaaatattccagtagttatgatgtcatctcatgattctatgggtttagtctttaagtgtttgtcaaagggtgctgttgactttctagttaaacccatacggaagaatgagcttaaaaacctgtggcagcatgtttggagaagatgtcacagttctagtgggagtggcagtgaaagtggcacacaaacccagaagtctataaaatcaaagagtcttgagaagtctgataataattctggaagcaatgacgaagatgataatgaaagtataggcctgaataatgtggatggaagtgacaatggtagtggcactcagagctcatggaccaaacgtgctgtagaagttgatagtcataaaccagtttcccagtgggatcaaatagctgagtgccctgacagtacctgtgctcaagttgttcactccaatgctgaaatgggtgggaacaaggtggttcctctagctgcaaaggattgtgcagaacagaatgaacaacttgtcaaaactgcaggttctcaacatagcaatgcacctgatgtcggcccctctaaattcagtgagcaaattaatagaggacaactggaccttaattgtgaaaatcaatctagcaagctaaggtgcaaaggtttatcactgtctgatgccattactagtacttgtgattctcagatgcatagtggagaatttgaagccctaaataaaaaacccaagtcctcagatattgaaaataaaggtactaataatgatgaagaattgccatctcttgagctcagtttaaagaggcttagaggagttgaagatgctgatattacaattcaggatgaccggaatgttttaagacgttctgatcagtctgctttctcaaggtacaatgcagcctctaacactaagaaatctcccactggatgtgttggaagcaattctccttataataatagcttagaagttacaaagaaagattcatctcgtgatattcaatctcattcttgcggcaatcctcctaaccaaaactcaaatggtgctagcaataacattgatatgggttccactactaataatgcttatgctaaatctgcagttatgagtgagccagcaggggcatcaacaacaaaatgtttgtaccaaacatctgctttccagcctgtaaaaaacagccttgtttgtacctctcaacaagttgtcttaaataatactgaagatatgtcggcaacaattctggcaccacctaaactagacagacataaagattctgcagctctggacttccatctccattgtgaaaaccataactgtattgctgacaacatgaagcatcagctgccacctgatcatgatgctgaatctataaagaaaatggctactgctgctccacattgtggatcatcaaacgtggaagaagtgctagttgaaggtaatgttggaaaccacagtatcaatagaagtgtttcaggcagcaacaatggaagcaatggacaaaatgggagcagcacagcagttaatgctggagggacaaacacggaaagcaacaatggactcactgggaatagtggcagtggtgatgctagtggaagtggaagtgccaacagagtagatcaaaacaagacttctcaaagggaagtggccttaactaaatttcgccaaaagagaaaagagagaagggagaggtgctttcataaaaaggttcgatatcagagcagaaagagattagctgaacaacgacctcgatttcgtggacaatttgtgcgacagacctctaacgaaaatgcaagtgaggcaacaacagatagctgactcgagacccagctttcttgtacaaagtggtgataaattggagctctgcagagctttcgttcgtatcatc

SEQ ID NO: 616 - DNA, 1156 bp, Glycine max
ttcttgtttgttgattaacccttaattaatccgggcgcgcctgatttatcacaagtttgtaaaaaaagcaggctcctgcaggaccatgggtgggggaggagctatgaggtcggcggcgaagatagccggaattggcgtgtccaaggcggcgctccggccttcggcgctccctacggagcagacggtccgcaacgcgtcgcgaccaacggcggtctccggagtgtcgtcgcagtcggcgaaatccgcggaggtggcgccgctgcacacggcagctgcctgggacgattgggacttcgccgaggatggcgaattggtcgtgccgaggatggtgttcggttctgtccccactctcgatgaagctaaggaagccaccgcagagttgaaggacgctattgatcaagtatatctttgtcctgagacttctcaatattcatctcccggtggtcaagtctctgctttgtctcccactctctatgggccagtgaacagatcttgtgtcattgatgctatttcagatcctacggccccaaagcatgccattcaggcttttcatttgcttagcactagtcgtgaggcccaggctgttgtggcttcacttgcttgtgacccaaatgtatggaatgcagtcatggaaaattctgctgtcagtagtttcttccaatcacaacagtcagtggctggttttggagcagcagaaaattctgaggaagtggataagttatcaagctgtgcttctgaaacagtcgaatcccctgagaaattggaagggtcggctgagtctcacccggggaacatgtttgacgatttcatgggtcttctgcagaatgtgaagcttacagttattgaattggtaagtaggttgtctggtttccttcagaacatattcccaacacctgatgctatgagagagaaaatgtctttcgatgctgatgggaacactaaagcaagtttcatggatagtaaaattagcatgggaggaaccttcataggtttggcagtgctggtgataatggtgatcgtgacaaagagagcttagactctaacaagcaaaactacaatttgtcgacttttctgatagttttgaaactcgagacccagctttcttgtacaaagtggtgataaattggagctctgcagagctttcgttcgtatcatc

SEQ ID NO: 617 - DNA, 1563 bp, Glycine max
ttcttgtttgttgattaacccttaattaatccgggcgcgcctgatttatcacaagtttgtacaaaaaagcaggctcctgcaggaccatgccccttctcgatcgcggcgatgtttggaagagcaaggcgcgatccttgcagctacagctcagggaccgtttccgtgtcgccgtcgaccgccattggcgccgccgccacaaccaccacacctttatcccctccgccgatggctacttctcctccaccattcaacgctggctcagccgatttcgtgatttccgcagagactcgttgccgtcgtccacctctttttatcgcaaacgagtgattaaggatttcagttctgaagaagattcaactcttgttcgtatgatgcaagctgttgcggttcctgttcttggaaatgtctgtcacgtgtttatgaacggattaaacagtgtgcaggtatatggtttagaaaaactgcactccgctttactgcaaagacctaaaggaaaacctcttcttacggtcagcaatcatgttgcttccatggatgatcctcttgttattgcttcgctgcttcctccgagtgttcttttggacgctaggaatctcagatggacgctttgcgcaactgataggtgttttaaaaaccctgtgacttctgcattctttcgatcagtcaaagttttgccagtttctcggggtgatggcatttatcaggagggaatggacttggccatatcaaaattgaaccatggtggttgggtccacatattcccagaaggcagtcgctcccgggatggtggaaaaaccatgggctcttccaagagaggtgttgggaggttagtcctggatggagatagcatgcctcttgttgtcccatttgtacatacagggatgcaggagattatgcctgtaggtgctaactttcccagaataggcaagatggttacagtgctcataggtgatccgatcaattttgatgatataattgaatttgacaaagacaaaggctcaaatgtgcccagaagacgactatatgatgcagtagcatctagaattggtgatcggttgcatgagatgaaggtccaggttgacactatcgcaattgatcaagaaatgcagctacaagataagtcctcacacagcactgaacgaacatctaaaatactgcagcaggttgattgggaattatttggaatggatagcttcatgtctgtagaagatgattccaagcagagacaagaaacagttgccctctcaaatgttagtgtttctcagcatcatcaacaatctcatagtgatcagagttggagagctgggttctcatacaggatgcgtggttatattgatcagatggagcttgtgtcttttgctgcgagaggtatatttctgaataatgatacaaagaactctgctcgccctagcagagagatgggccccttaaaggcatggaagcagtttttggaagctaatctattaaggcagtggaattacgtccattactgactcgagacccagctttcttgtacaaagtggtgataaattggagctctgcagagctttcgttcgtatcatc

SEQ ID NO: 618 - DNA, 2449 bp, Arabidopsis thaliana
aatatacacatcgttataatcgaaacacaccatcacctcaattctctcttcgttaacattacaaatttacaatctcttcatctttcttcattagatcacaaaacttcactataacctaacatggcaacgagtcatcctgatccaaccacctctcgccacgtggcagtaatcggagccggagccgctggactcgtagctgctcgtgagctacgtcgtgaaggccactcagtagtcgtcttagagcgcgggagccaaatcggaggcgtgtgggcttacacctctcaagtcgaaccagacccgcttagcctcgacccgacccgacccgtcgtccactcaagcctctacagatccctacgtaccaacatccctcgagaatgcatgggcttcaccgacttcccttttgcgacccgaccacacgacgggtcaagggatccgagaagacatccggctcatactgaggttcttgcttacctgcgagactttgctaaagaattcgatatcgaggaaatggttaggttcgagacggaggttgttaaggcggagcaggtggcggcagagggggaggagagagggaagtggagggttgaatcgagaagctccgatggtgttgtcgacgagatatacgacgccgttgtggtttgtaacggacactataccgagcctcgtcatgctcttatcactggtaataagcaaaaccttacttgtgtcttgagtttgtgtattttatatgttcaattaaaaagaattttgtcgtaatatgataggtttaaaaaaatttcacataaagaaaattagtttaaaatagtaagaattcaattaaaaacagagttttcttgagggatggattattcgtcaaacaatatcaatatttaggttttcatttgggaataatatttttttttttttcaggcatagattcatggccaggcaagcagattcacagccacaattaccgtgttcctgaccaattcaaagatcaggtacttgcagaagaatcccatcactagagtgaatcttgtacgtgatctcatatatatccacgtttctcttcacttttaactcttggatcgtttcctttttgttgtgtaatttgtaggtggtgatagtgatcggaagctctgcgagtggagttgatatatgcagagatatagcgcaggtcgcgaaagaagtccacgtatcatctagatcaacttcaccggatacttacgagaagcttaccggttacgagaatctatggcttcactcaacggtacactaactaaccggccaatgaatgatgttggttgtttgataattcagttactccatctataagacggttgaatgatataatataggttacaacgttcattgtagattcaaattgcccgcgaagacggttcggtggttttcgagaatggaaagacaatttacgcggataccatcatgcattgtaccgggtaagatacatatcggctcaaatctctaaaagagattaaacatcagaacacagaacataggaaatttgaaaacgttttcactgacttgtttttatcttgttaatatcttcatcaggtacaagtattacttcccgtttcttgacacgaaaggtgaggtgactgttgacgataatcgtgttggaccgttgtataagcatgtttttcctccagctcttgcccccagcctttcgttcatcggcttaccatggcaggttaataatctttataatgtttatgatctggcttctgtgaatacatttgctgcttttattgcatatgatctcattgtttggttgaggtgcacacaaaaaaaaaaaaaaaaaaaaagatctcattggtttaacttggtttcttagatcactccctttccgatgtttgagcttcaaagcaagtgggtcgcagcggtcttgtccggccgagtatctctcccatcgcaagacgagatgatggaagacactaaggcattctacgataagctagaagcctcgggaattcccaaaagatatacacatttgatgccagatgactctcaggtacacatatttcgtagcacaacattacattacaaaacatgttatcataaaaaaaaaaaaaggttgagactaaacaaatttttggttgaattgttgttgcagtttgaatacgacaattggcttgcggatcaatgtgaatatccccggatagagaaatggagagaacaaatgttttacatcggtttcaagagaatatatgcacaatcctctacatatagagataattgggacgatgatcatctcatcgtagaagcatacgatgatttcgtcaaattcatgtcaagttatcaagaacttttgccgatgctcaaaacctaatgataattgacgtgggagttttgttatgcgaaaatgatggttgggtatatatatatatatatatatatgttatgtaattgtaagtgtgtcttgtggttgctgtgtttcagaatgtgaaaa

SEQ ID NO: 619 - DNA, 2263 bp, Arabidopsis thaliana
acattattatggggtggaatgtataaatattccataatatagggtctgtttaattatatcaagcatatatgcacatctttttaaggaaactgatagtttgacattaattgacttgacactatgaccagcgtaatcacctcacgtgctcgtcacgtggccgtgatcggactaggagccgccggcctcgtggcggttcgagagcttcgtcgtgaaggtcacaccgtcatcggtttcgagcgtgagaaacatgttggtggactctgggtgtacactgatcgagtcgattcagactcggttagcgttgacccggatcgaaccatcgtacactcgagcatctaccagtccctccgcaccaatctaccacgagagtgtatgggttacagtgactttccattcgttacccgatccagtgacggcgacccgagacggtaccccgatcatagggaagtcttgatgtaccttcaagatttcgccaaagagttcaagatcgaagatatgatccgatttgagacagaggttttgtgtgtggagccgtcgccggagaataaccgtaaatggagagttcagtttaagagctcaaatggtgtctccggcgaagaaatcttcgacgcggtcgtggtttgcaatggtcacttcactgagcctcgtcttgctcatattcctggtaagtaatattttggttacttaaaagtgtgattaattaatggttgattagtctcttaagtatcttggttttagtgttttagggatagagtcatggccaggaaagcagatccatagccacaattatcgaattccagatccattcaaagatgaggtatttgcaaaatttattatcttcttcataatcttagctcttaattatactaatagattcttttaagttatctacattgattgttgtttgacatgttttgtaggtggtgatagttataggaagtcaagctagtggaaacgacattagtacagacatagcaaccattgcaaaagaagtccatatctcgtctaaaatggttgcatccgattcatatggctgttacgacaacctacggattcaccctacggtagtaaaatgaaatataaagacaactaagaatatgaatatgttcatttgatttcttaaatgtctcttgatatgtttgtagatatatcgcgcccgcgaggatggttccgtggtattccgaaacgggaaagtggtttttgctgatgctatagttcattgcactggttacaagtatcatttcccgtttcttaaaaccagtggttatgtgactgtcgaggataaccgtgttggacctctctacaaacatgttttcccacccgcacttgcgcctgggatctcctttattggtttacctttcatggttagtattacgacatgttagatacatatggcagttttaagagattaagaatgttaggataatcttgaaatacatggttaatattaattggtatatatacatgaagtaaaaaaaaaaagagaattagaatgtgctattgaatctccaattcgcaaaaatcaaagatcaagttattatttcaaaatgcaaaactacttaatccggcaacattattgaattttatggtggtatatattttttttgatatgccttgatattgtaatgtctgaaatctccggatactcaaataacgactttgatttttgttgttgggctcattacttggtttgatctttgttctaataatccaggggctccagttctttatgtttgaaatccagagcaagtgggttgcttcggttttgtcgggtcgagttaagcttccagcagaggataagatgatggaagaggctgtagctttctactctaagcttgaagatttagggattcctaagagatatacacattttctaaccgatcctcgagggaatccaatgctcgggacgtttaaaccggaggatgcagttgtgatctctcaaagtgattacttcaactggatcgcaaaacagtgtggttgcacgtccatagaacgttggagagagcgattatacaatgtcgccatcaagaaagttttctttggtggcgacagctatcgcgatcgatgggacgatgatcaactcatcgaagaagtgtaccgcgagttcgccaaattgaaaccgaaccaagattgttcttcttagtttatcaattcgggaagatgattgaaatgtgacaagggaaagttaaaatctgaaaattgggaagtgtaattgttaagttgttgagtgctggtggactcattaagaaaaagttgtaaacat

SEQ ID NO: 620 - DNA, 702 bp, Arabidopsis thaliana
aagttattagggcttataaatagacaaacgcataggttcataacttcattaccttattactcaatcatttactcaattcttcaatcttccagagaaaaaatctcccccactgaaaaaataatgtcgacgaagaagatcatattgaagagctccgatggtcactcattcgaggtcgaagaagaggccgcacgccaatgccagattatcatagctcatatgagtgaaaatgattgtaccgataatggaatccctcttccaaacgtgacaggcaagattcttgcgatggtgatcgagtactgcaacaagcaccacgtcgatgccgctaatccttgctccgacgatgatctcaagaagtgggacaaggagttcatggaaaaagatacatccacgatctttgatctcatcaaggctgcgaattacctaaacatcaaaagcctttttgatctagcatgccaaaccgtcgcggaaatcatcaaaggcaacactcctgagcagattcgcgaattcttcaacattgagaatgatttaacacctgaggaagaagcagcgattcgtagggagaataaatgggcttttgaatgagcggattatcaaaacctaaacagctttctttcttttcttttctttcttatttagtgtgtgtttcgttatcaatctaggtgatggtgacttcatctacgtacgataatccaataatggaag

SEQ ID NO: 621 - DNA, 1683 bp, Arabidopsis thaliana
tagtaacaaatacagtactattgttctataatcagatttttttttggattagtttcttgtctctttgatttatgagaaccgacttgaatgtatttattttatttttgatgattgaaggagatgagttcctctagtgaatctcatctagccaccgccaaaacagctctcacagcggttgcatcagttgctgcagccgcaatactagctcgatcagtggttcaagattacatgccaaacgaggttcatgaatatatctctcacggctttcgcagattcttcagctacttctcttatcagatgacagctgtaatagaagaatttggaggttttgaacacaaccaagtgtttgaagctgcagaggcttatctctccaccaagatatctaattccactagaagaatcaaagttaacaaacttgagaaacagagcaattatagtgttactgttgaacgtgatgaggaagttgttgatatttttgatggcgtcaagcttagttggatccttgtatgtcgccatgtcgataaaaaggattttcgtaacccgagagatctcaactccactttgaaatcagaagtgcgtagttacgagcttagtttccgaaagaagttcaagaacatggttcttgaatcttatttaccgtttgttgtggaacaagctgcttctattaaacaaaagtttaaaacattgaagatcttcaccgttgattcttactccgtggagtggacctctgtgactctagatcatccttccacgtttcgcactctcgctctggatcccgaggtgaagaaaaacttggtggaggatcttgatcgattcgtgcagcggaaaggcttttacgggagagttggaaaagcttggaagagaggttatttgttgtatggtcctcccggtactggaaaatcaagcttgatcgcagctatagctaatcatcttaacttcgatatctatgacttagacttgacatcacttaacaacaatgctgagctacggaggttacttatgtctactgcaaatcgttccattctagttgtggaagatatagattgttcaatcgagttaaaagatcggtctactgatcaagaaaacaacgatccgttacataaaacggtgatgcattttgattcactatcagttatgttgttatgtgatcttttgcttattagcattactaatgttttggttagtcattttcaggtcacactctctggtctattgaattttgtagacggactatggtcaagttgtggtaacgagcggattatagtgtttacgactaactacagagaaaaattggatccagcattgttgaggccaggacgtatggacatgcacattcacatgtcgtattgcacaccagctgcttttaaggttttggcttcgaattatctcgagattcaagatcatatacttttcgagcagattgaagaatttatccgagaaattgaagttacaccagcagaagtagctgaacaactgatgaggagtgactctgtggataaagtactccaaggacttgttgagttcttaaaagccaagaagcaaatagataattcaaaagcttagaagaaatttagttcttttatttgtttctttgttaaacactatcatgcaattattggttataaaatgttacagaaagtgaaatcatttttttttttcctaagtgaaatgcggatattgttt

SEQ ID NO: 622 - DNA, 1462 bp, Arabidopsis thaliana
cgaatttgttcggttagaaatagatttatattccacaatttcttgcacctacgttgatgcctatatatatagacacacttaaatgtatgtggaatttgaaatatatattgatatagtaaaatgggatgtgtttgcagcaagcaattagaaggaagaaggcaagaagacatttcgcttcttgcttctcaaaccttttgtaagttacgtctacttcaatcatccaccacttcctcctcctatatattatattgcatggagaaagaatattattacacgagcttgtagatcagataacatctaaattgttttgggtttgcagttagcgaggctgaggttgaagttttgcatggattgttcatcaaactcacttcttgtcttagcaacgacaatcttttgaccaaagttagagtccaaactaatttttcttccacaatgtgaataatttttttttggtcaacaaaatgtgaataatataacatctaaattttatactagctagttatagaaaagttgtgcttttgtcatgtcaaatttggttggcttttccaggaaaaatttcaatttatcttgatcaagaataccaaaaagcgcagtctttctgcagaacgggtaattgaatttgttatattaagcgaaataaataaataaacttcgattgatgttgtttctctgaaatatgcagatttttggattattcgatatgagaaacgatggggctatagattttggagagtttgtacacacactcaacatttttcacccaaactcatcaccaagagataaggccatatgtatgcttcatcacttctaatgtgtttattcatttattccatgttattattattttctatatagctagagatcaatgttattaactataaccacaaatacatctgatcacttgtttaaaattaaacagttgcatttagattatacgatactcgtgagactggattcattgaaccggaggaggtacgtatgtaaactttgtctcaaaaaaaagaaaaagtcatgattaattatatttgacggttttcctcgacttggagaaatctataggtgaaagagatgataatagacgttctagaggaatcagaacttatgctatccgagagtatcattgattctatcgtgtctaaggtgtgtataacgcttaagtttatgagcttgatttaacattatagtgattttacttactatttttgtttacttatatttggcaaagacatttgaagaggccgattggaaaaaagatgggataatagatttggaagaatgggagaattttgttgccacctatcctttgacactaaagaacatgactatccctttcttgaagtaattcgtttgtttgtttttcctaaccattttcttaatattcgctgataaattgcatgttttagatacatctttcgttttacaaaaaaagtaatatatatacatctttcaaaaacagctttta

SEQ ID NO: 623 - DNA, 1455 bp, Arabidopsis thaliana
agttattataattacaaacattcttccttcaatagttcttcattcatttgacgtttgcttcttcttgttcttgttaagtttgttttttgttgttgagttccgttggcattttaactgaaaatgatccaaacaggtgaagaagatgaagaaaaggcaacgtcccttgaagttgagtttgcttctggaaatggtgttgatgatgaggaagagcttcggttgcagtgggcaacagttgagagattaccaacttttaaaagggttactactgctttgttggcaagagatgaagtgtcagggaaagggcgagtcattgatgttactagacttgagggtgctgagagacgcttgttgattgaaatgctcgttaaacaaatcgaggatgataatctccgtttactcagaaaaataaggaagagaattgacaagtaagtcactgcacgactctactgtgtttttttatgtcaagtagagcaacatttgttttgtaaattgtatgtgcatgttagcaactattgaaccttcatgtaattgtagagttggtatagagttgccaacggtggaagtgaggttcaataacctttctgttgaggcggaatgccaagtaattcatggaaagcctatcccaactctttggaatactatcaagggcttactatctgtaagtactcaaatttatttgctgcatcgatctgaatatggagcgcttttctgctctcaatgttctttattcatgtttttctgctttccatgttacaggagttcatttgttctaagaaagaaaccaagataggcatcttgaaaggagtgagtggaatcgtaaggcctggaaggtaaagtattcaagaggttattctctagtccctttagttgcacggaagaagaaatgaagggtgactggttattttgtgcatgtagtgtttttttataggttttcattacagagttcaaaagaggtgttggttttcttgcagaatgacgttgttgctcggtcctcctggttgcggtaaaactactctgttacaagcactttctggaaaattttccgattctgtaaaggtttgactaacagagtaaaaacataagcctgttgaactaatataaaataatatattggagatcattaaggttgtcttcactttacaggttggaggagaagtatgttacaatggttgctcactctcagagtttattccggagaaaacgtcgagttatataagtcaaaacgatctgcatattcctgagctgagtgtaagagagacacttgacttctctgcgtgttgtcagggcatcggaagccgtatgggtgaggatcagatttctgaaagtttgaactgaaggatacttttgtgtgtttgaactcagttcacattaacaagcaatggtttattaaacagaaattatgaaagagatcagtagaatggaaaaactccaagaaatcattccagatcctgctgt

SEQ ID NO: 624 - DNA, 1663 bp, Arabidopsis thaliana
tgatagaacataatttaatgatttaaggaaagcccccaataaagcaaatacaaaaacagaattagcaatcttcgtggccctttcgtcttctctccctaccccaccttggactaccggaaaatggccaaggtggtggtttacacgatactaaccgccaccatcatcttcctcatcctcctcgctcataagaaacaaaaccagactcaatccattgagggtctcataacccgccgcatcggacggaggcttgaaatgccggtgtttgaccctttggtgacccggattgagaggttgtctcatgagaaagaagctggtacgaagaccgtggaggctgcgaaagaggagaaagatgatatgtttgaggagtattttgcacaagagagaaggcttaacacgacaatgaggatcaagttcttgtttcctctgcttgacgcgtctccaagagatggctttgtgagcttgaaagagcttcagacatggatgatgcaacagacagaagacaacatggtttacagaaccgccaaagagcttgagctacaagataaggacaaggacggtgtcataactttcgaagagtacttgcctcaattctctaaacaagacattggtaatatattaacttgtctttgatccttcgagatttttcttcttcattatgcaaataagaaaaaacaatgataatatggaaacagagaaaaacgagaagggtcacggtgaagccggttggtggatggagcaattcaagaattctgattttgatcataatggctctctcgacattgaggagttcaacaagtaattaatatgccttgaaaaatctcatcacttttaaaatttccgaaaataaaaaatgaatgaaaatatgggatttgcagtttcttgcaccctgaagacagcagaaacggagatacacaaagatgggttctaaaggagcgaatgacgtaagcatttcgtgatatatcgtgtttcgatatgatcataaatgaagcttaactaggaaacaacatgttgtttgatatatataatatataggggcatggacacgaacggtgatgggaagctagagtacaaagagtttgtaaaaaatgcatatgaaatgtataaagaattcgcaaagttcgagaaagaggaggatgagaatgtgccaacacctcagcttctgttcgcagagatggacagagacaaagacagattcctcgtggccgatgagcttcgacccattttgcaatatcttcaacctggtgagatgagttatgccaaattctattctactttcctttgccacgaggttagtctctcccaacctaaatcttaatcttaagttttctttctcacaactttgaaactcattaatagtggatgtatatgtataatgcttagactttcaacgtccaataaattttaattattttgttaggcggatgaggataaagatggtaaactatctcttgaagagatgttgcaccacgaagatgtcttttacaaggcagttcatcacgaagacttggacgacgaagactattttgatcatgatgaactctaacttttgaatttgttttccttcaaattttaatcataatttttttttgttcaattgacttcttaattcatctcgtctagaatgggtatgttagattgttaggcaacgagattacatgcacaa

SEQ ID NO: 625 - DNA, 1591 bp, Arabidopsis thaliana
tctgtggatatatacctattttggttcgatctttaatggatcttctttagatgtttgttctgttttcttgatcaacttaataagaggattttatcatttgttaccagagaactccatctaatggcgaagaggaggtcgtggttcggttggatgaaaagactattcatctgcgaggccaaagcaagagcagagaaggttttgtttctttctctacacactatgaattgtttatgtttctgaatctaaaatgattcttctttttacgtagaagccaaggagattgagatgggtgtttaaaaggctgaagctgagaccgcagcttgccacttgtgggcaagagacaaggactttgaacgaagcaacacaggatcagaggaaacatgcaatgaatgtagccattgccacggctgcagcagctgaggcagcggttgcagccgccaaggcagctgctgaggttgtccggatggcgggaaacgccttcacatcacaacattttgtcaagaagctcgctcccaatgtggctgctatcaagattcagagtgcattcagggcttctctggccaggaaagcgttgcgggcgcttaaggcacttgtaaggcttcaagcaattgtgcgtggccgagctgttaggcgaaaggtttctgctttattgaagtcttcacactccaacaaagcttcaacatcaaacatcatccagagacaaacagagagaaagcattggtccaataccaaatctgagatcaaagaggagcttcaggtatcgaaccattcgctgtgtaactcaaaggtgaagtgcaatggttgggacagtagtgctctcacgaaggaagatataaaagccatatggttgaggaagcaagaaggtgtgatcaagcgcgatcgtatgttgaaatactcccggtctcaacgggtaaagtctctctctcaagatctttatatatctggttagtttttcaaggagttgtttttgcaggagagaagaagtcctcatatgcttgtggagtcactgtacgctaaggatatggggatgagaagctgtcggctggaacattggggtgaatccaagtctgcaaaatccatcaactcatttctcattccaagtgaaatgcttgtccctacaaaagtaaagcttagatctttgcagagacaagactctggtgatggacaagactctccattttctttcccaaggagatctttcagccgtttggagcagagtatattggaagacgagagctggtttcaaagatccaatggtttccagccgtacatgagtgtgacagagtctgcaagggaaaagatgagatcactgagcacaccaaggcaacgtgtagggatcatggattctttgtttgataactacaagaaggatggggataaagtctctctctggtctacttttgtctgcgaaaatagtaagatcaacaacgctaagaagtcgtctctgaccacatatcaacataattgttgaatcttgaacattcatgtcactttatttctttggttttcccagttgttttgttatttggatctcatatctcatgtgctttatagatatggttatgaagaggtcaattttttggtgtttgat

SEQ ID NO: 626 - DNA, 2765 bp, Arabidopsis thaliana
gagatgtagtagtgaggaagtcttaaatttctactataaaaacaacctccggtgagagaccacacaaagaaaccaaatcaagaagccattccaaatccatctttcttcaaactaacaagtatggttacgttcacatcagaagcatcaaggagccgatcaaagaaggtatgtgtgatcggagctggaccggcggggttagtctcggcaagggagctaagaaaagaaggacacaaagtggtggtgttggagcaaaacgaagacgtaggaggtcaatggttctatcaaccaaacgtagaagaagaagatcccttaggaagaagtagtggttccattaatggtgaactgaaggtccatagcagcatttactcttccttgaggctaacctcaccgagagagataatgggttattcggattttccgtttttggcgaagaaagggagagatatgaggaggtttccagggcataaggagctttggttgtatcttaaggactttagtgaagcttttgggttaagagagatgattaggtttaatgttagggttgagtttgtaggagaaaaagaagaagaggatgatgtgaagaagtggattgtgagaagtagagagaaatttagtggtaaggttatggaagagatctttgatgctgttgttgttgctactggtcattactctcaccctagattgccctctattaaaggtatattattgttcatattattttcgcatttaatcatgttatgtgtatctatggttattgatttgttttttcatgtttctttgatggttataggaatggattcttggaaaaggaagcaaattcatagccatgtttacagggtgcctgatccatttcgtaatgaggtaattgaaacttttatatctttaattttggtgatgataatgatggttatggttatgatgacggtgatggttatgatgatggtgataggtggtggtggtggttgggaactcaatgagtggacaagacatatcaatggagcttgtggaagtggcaaaggaagttcatttaagtgccaagacacttgatatatcttctggcctttcaaaagtcatttccaaacacccaaaccttcttattcacccacaggttctcttcactttaataatatagtttgtataaatttggatttaaaagtttcattctttgatttttgttttgtagattgaatctttagaggatgatgggaaagtcatttttgtggatggttcttgggtcgtcgctgatacaattttatattgcaccgggtaagatttagatctttagataaacgaaaaaccttatcttaatctatttatttacatgataaaaatattagttcattataaaacagatgattcgcatatataaacaactttgagtaaatagactaaaattactactttttgtttccgttagagaagacaaatagatgatgatgtttaaggtttctcagatagtgtttagccgccgtaattagttaacgttaagttaaatttaattaattgtgttttggctttgtggggtattgtggtcttcataaattattgtttcatgtaagaaaaaaaagactggaaaagaaataataaattattggaatctgcatgatattgcgtaactttttttttttttttttgatattgcgtaacttagatattagtcttactagaaaatcatatcgatcgaacaaaaaatacaaattcacttatatatcactgaaaatatcaatattatattatagtatagtatgtaaaagccagaatgagtgggctacaaatcttttctacattggtcttctcaattgatttcccctagttcttggggccatcatattgtacaacaataatcaatttctgtcatatgtttttagatcttttatgcattttgtggatcttttatgtattttgtttattacttaaagtaataatttatatgttgggggaccaaaacacaggtactcgtacaagtttccatttcttgagagtaaaggaagaatagaagtggatgatgatagagttggtccactcttcgaacacactttccctccttgtctctccccttctctctcctttgtcggtatccccagaaaggtcctttattttatctctttttttttttgttttaactaaaacatcattggttttacctctaaacaaaatttgacaattcatttttggtattttgcagttgataggattcccattctttgaagcacaagcaaaatggatagcacaagttttgtcaggaaagtcatctcttccttctcctgaccaaatgttacaatcagtagacgagttttaccggtcaagagatctagccggagtccctaaacacaacactcacgacattgccgatttcacggtagttaataaaaccttcctgacaattttttttaacatttttgtatacttttgatttcattgccctaataaaaaagtttgtgtttgaatctctttgcttatagtattgcgataagtacgcggattatgttgggtttccgcatttagaagattggagaaagctactatgtttgtctgctctcaataattcacaagaaaatcttgagacttatcgcgattcttgggatgatcatgaactcctacaagaagctcttcaaagctctcatttcacaaacttcaattcttgaattactcatttatcgttatgttagaaagaaagagtttattatatattcatacatttgtttgtttgttgtttctttcctttatttagtttgatctgcctacgtttttggttgactatttat

SEQ ID NO: 627 - DNA, 2226 bp, Arabidopsis thaliana
ctccatctttccaacagatctaatcttcttcacttcccaagtgtaaaaacctcaactttcagccaacaaaattagggtttcaagctgagattttctacttctgttacacaaaaatacccaatgagtaaagcttcggtgatcctatacattacggtaggaatcctggtgctcttcctcgtctcttattcaccgaagaagaagggtgaccacgatcaccaccatggtggtcacaatcaacatcaccgcttaaaactccggtcttctttcaatttcaaacccactcgtcacgatccagttccgtttgatcctcttgtcgccgacatggagcgccgccgcgaggataaggagtgggagcgacagtacattgagcattctcacccggagcttgtctctcattctcagaaagaaacaaccggtggtggacatgaacatgcacctggtcacgagtcgcagcctgagtgggaagaattcatggatgctgaggattacttaaatgatgaggagaagttcaatgtcactgataggtttggttatacttatatatatcttcagttcccaatctttgattttgagcgctaattgcaacaatgtgtacttcaatttccttcaaagtttggatctttgaagattttagtttagcatttactaaagatgtcatttttgtaaggaatgagtttgattgctatggtactttgcaggctgatattgttgtttccgaagattgatgtttctcctgctgatgggtttatgacggagagtgaattgactgagtggactatgcagtcttctgccaaggaagttgtgcacagaactcaacgagacctggatgttcatgatagaaacaaagatggttttatttctttctctgaatatgaaccaccgtcttgggtccgtaagtcgggtgagctgctgtttcctgttcgtctttgagtttcattgactaaaatgtttgctacttaatatgaccatgtagaaatatttgatgacagtcttgtaagtagatttgctttaatctgtgtttcacttctagctcttctgcctatgacctatataataatcctttccttattctggaccacagtttgattgcgattttaagcaaatgatctcacttttgtctcttaggactgctagctgacttggttataaatttaacagataataattcgtttggctatgatatgggctggtggaaggaggagcattttaatgcatcagatgcaaatggtgatggtcttctgaatttaacagagtttaacgagtaagcgttttcttctagtgtagatagaaatcaaccgagctatttcaggtttttagtactatcagttattttttctttctatttctcacaatgtttttgctggttaattcccttagctttctgcatcctgctgacaccaagaacccaaagttactgttatggttatgcaaggaggaagtaaggtaatgtacggttgtcatatgattatttccgaggaacctttcttttagcttaatgtttatcaacggattcccctccttccctctcccagagaaagggattcagataaagatgggaagatcagtttcgaagagtttttccacggcctctttgacactgtaaggaactacgaagaagacaatcacaattctacgcatccttaccatgacttgcctgaaggcccagcaaagcagttgttttctcagcttgacaaaaatgatgacgggttcgtaatatacgagtacacaccatgattagcatttccattaataccatacatcccttaacataattgccacttatctacaggtacttatcagacgttgaattgcttcccattatcagtaaaatccatcctactgagcattattatgcaaagcaacaagctgattatataatatcacaggtacataactttccaaataaatggtgtatttagctgctgaattgttccatgttacatttatgatttatctcttctttttctaatcgtccaggcggattcagacaaagatagacgtttgactttggcagagatgattgagcatccatacgtcttctacagtgccattttcgatgaagatgacactgatgatgattatggtttccacgatgaattccgctagttttataatttgtaagcatctgccacaaactattcttattcagtttgtcgaaatatgtcccaacttaacttataacactaatcgttattcttcaatacacaacacagaggaataaacaac

SEQ ID NO: 628 - DNA, 1760 bp, Arabidopsis thaliana
tgggcctggaatcatcccacatagttctaatcctcttatccacccagaggtttcattaagttgaaactctctcttatcgttaacaatttgtgaagcagaagaaacatttgatttgatgagatggggaagaagaaagggaaagcgatcatagtaggaggaagtatagcaggcttatcttgcgcacactcgctcacgttagcatgctgggatgttttggttctcgagaaatcttccgaacctcctgttgggagtcctactggtgctgggctcggactcgaccctcaggctcggcagatcatcaaatcatggcttactactccacagctcttagatgaaatcaccttgcctctctcgattgatcaggtaataagaacactgagtttagttcgacaattgaaacaatcggcgtttagtttttccagctctacctaaagtttttaactttttttgtgtgttgtgggtttgttgtagaatcagacaactgatagtgagaagaaagtgacaaggattttaacaagagatgaggattttgatttccgagcagcttattggtcagatattcaatctcttctgtataacgcattgcctcagaccatgtttctttggggacataagtttctgtctttcacaatgtcacaagatgaatctaatgtaaaggttaagactttagttgtggaaactcaagaaactgttgaaattgaaggagacttacttattgcagctgatgggtgtttgtcttcgattcggaaaactttcttgcctgactttaaactgaggtttgaaataagagtgtgatcttcatttatcgatattttgtggacttgatcatataggattttgtttttttcgttttatgtgaaaggtactctggttattgtgcttggagaggtgtatttgatttctcagggaatgagaactcggaaacagttagtgggattaagaaagtgtatccggatcttggaaaatgcttgtattttgatctcggtgaacagactcatagcgtgttttacgagctttttaacaagaaactcaactggatttggtatgtcaatcaaccagagcctgacctgaaagtaagaagactaattcctctctctttttgattaggatgcgtctacaagtgtagttttcttgatttctattttgttgttgttatggaattacgatatcagagcaactctgttactctaaaagtgagtcaagaaatgatcaataagatgcatcaagaagcagaaaccatttggatccccgaactagcgagactcatgagtgaaacaaaggatcctttccttaatgttatttacgactctgaccctttagaacgaatcttttggggaaacatcgtgttggttggagacgcggctcatcccacgacccctcatggtctaagaagcacaaacatgtcgatacttgatgcggaagtgctaggcaaatgcttagagaactgtggacctgagaatgtaagtttgggtcttgaggaatatcagagaataagattgcctgttgtttctgagcaagttttgtatgcaaggcgtttggggcgtatcaagcaaggtctggatcatgacggaattggagatggcgtttttggtttggagcagagaaacatgccattcttttcctgtgctccccttatctagtgataaatatttgatgtgagagatgttgtatgttaataattgtgtgtttaatagacttgaacatattgtttggaacgttaatgtagaaactatggatacttcaaatacaagttatataaa

SEQ ID NO: 629 - DNA, 1131 bp, Arabidopsis thaliana
atacacacatagatgatagacctgtatttaatatctcacacttacgacgttggttttctccacaaccccacttttgtacttctcttccctctccccctcccaaataaccgccgataaacaatgctccggctaagcaacgccgccgtaataacaaccaatgcaattctcgcattgatcggcctcgccgctctatctttttccgtctacgtctacgttcaaggcccatcacagtgtcaacgtttcgttcaaaaccctctcattgtaactgcggctctcctcttcttcatctcgtccttaggccttatcgctgctctctacggtagccacatcatcatcacactctatctcttcttccttttcctctccattcttctgcttcttgtcctctctgtctttatcttcctcgtcacgaatcccaccgccggaaaagcgttatccggtagaggaataggcaatgtcaagaccggagattatcagaactggatcgggaaccatttccttcgtgggaagaattgggaagggatcaccaaatgtttgtctgattctagggtttgtaaaaggtttggtccacgtgacattgactttgactccaaacatctctctaatgtacaggtatgtgtttatagtatacatctataggattcagattgtttcactaacaatgtagtaataaaagtggttttttgttttatgtttcttttcttttagtttggttgttgtcgacctcccgtagaatgtgggttcgaatcaaagaatgccacgtggtggacagttcctgccacagcgactacggcgattataggggattgtaaggcatggagtaacacgcagagacagttatgttacgcgtgcgagtcgtgtaagattggagttttaaaagggataagaaaaagatggaggatacttattgtcgtcaatctccttcttatccttctcgtcgtttttctttactcgtgtggctgttgcgtgagaaagaacaatcgtgttccatggaagcgccggttcttctaacaactctttccatttgttttccaaatgattaattaattctttatatatttttctgtttttgaaatatttagttgatgtttgatgtttcttttagtgaagttgtcctctggtcatgattgt

SEQ ID NO: 630 - DNA, 2047 bp, Arabidopsis thaliana
caaacaactctcttgtcctcgcccctcggatctgtttttcagaccaaacccatatcaaaagtttcaacatttaagctcaaaacagagccaaatcttgaatctttctcctccttgcaagttatggtagtagaagagcaaagccttgaaaacggcggatccgtacatgtggtcaaaggagaaagtaatttccgtaatgtggtgtgtggtcctgtacggtggctaaagatgttgtcttcagagcttcattggagctttgtgtttggtgtagtctcactatatggaattaaccaagggcttggtggctcattaggtcgtgtagctacagagtattatatgaaagatgttcaaaaagttcagccttctgaatctcaagctctcactgcaatcactaagattccatggatcattaaaccactttggggcattctcactgatgttcttcccatctttggtttccatagacgtccttacttcattttagcaggtaaaatctcgctcgaaatttcgatcaaagtctctttgatttctcttttaaatgtacaaaactctgtttttgtaggggtgcttggagtggtttcattgttgtttatttcactgcatagtaatctacacctttacttggcactgttttggatgacaatatcaagtgctgcaatggcgattgctgatgtaaccattgatgcttgtactgcttacaatagtatcaaacatccttctcttgcatcggatatgcagagtttatgcagtttaagctcttccattggagcacttcttggtttctttatgagtggcatcttagttcatcttgttggctctaaggttaatgaatcgtctgtctactatgatctttttcatttgtgtttcctctctaatgctgtatttggcttgttttgcgacattagggtgtctttggattgctgacattcccattcgcgttagtatcggtagtcgggatcgtgtttagtgagccccatgttcctggtttctcttacaaacaggtaataattattctctctttggtagcttgatcatgagggtattgactcttgttgtatcatttcaggtgaaccagaaatttaccgatgcagggaaagcgatgtggaggacaatgaagtgttcagatgtgtggcggccgagtttgtatatgtacatttcccttactcttggtttgaacatacatgaaggtctcttctattggttcacagattcaaaggatggtcctttgtttgctcaggtattaccaaaacaaatagtttctattttcaaacttcaccccaaaataagtaatatgctgaagaacctacctggtctgttttaggaaacagttggtttcattctctccattggttcaatcggatcgattctagcagcaacgttataccaactagtcctaaaggatcatccgttccgcggactttgtttgtggactcaacttctctttgctctatcgggaatgcttgacctcattcttgtgttccgtctcaacttaaaatttggtttaccggattatctcttcatagtagtggacgagatagtttctcagatgatcggacgcttgaaatggatgccgctgcttgtcctcacttcaaagctttgtccccacggaattgaagggacgttctttgcattgctaatgtcaattgacaatgcaggcctcatgacctcatcttggcttggagggataatgttgcatgtcctcaaggtgactcggactgagtttggtaacctgtggcttgcggttttggtcaggaatgtcatgagacttttgccgctttgttttctgtttcttgtgcctaaaggagatcaaaacacgttcaagctcccggatgagataatgggcgaagattcggacgaagagaaagatgaaaaagaaggaactcggaatttggaattggcttctcttgttcactctgttgatagaagatagctagtgttcttttattatagtgtttgaagcaaatgcttcagtttttcagcagttttgccgaacttcacttttacttctggaaagtgcaaaaggcacacactacatttttctctgaatgca

SEQ ID NO: 631 - DNA, 1650 bp, Arabidopsis thaliana
acgaagagttgatttctagtccttgtccaaagaagaccactatttctgggttaagacaacaacaataaagacgcgcaaattcagttaaagaagatatacagctgaaggagcaaacaagaaatgtctgaatttgataagcatgtccaaaaccacatcaaaaatgagaagcctttcaattcaatcaaaccttcagaaatcgattcaactctctctttatccgattctcttctcctcaagatcatcgagaagcttcctgaatcacagagcaacgacgtctcactcgtctgcaaacgctggttgaatcttcagggacaacgtttacggagtctaaagcttcttgattttgattttctcttgtctgagagactcaccacgagattccctaatctcacgcatgtcgatttggtgaacgcgtgtatgaatccgcgggtcaattccggtattttgttctgtcacaagtcgatttcttttcatttatcttcagactcgtcgaattgggagtttcttgaggagaatctattgcacagtgacgtaattgatagagggcttaggatattaagcagagagagttttgatttgcttaaccttaaagtgattaacgcttctgaattgggattattgagtttagctggagactgctctgatttgcaagagttagaattgcataagtgtaatgataatctcttgcatggcattgctgcgtgtaagaatctgaagggattgagattggtaggaagcgtagacggattgtatagttcatctgtgtcggatataggattaacattcttagcacaaggatgtaggagtttggtgaagcttgagcttagtggttgtgaaggtagctttgatgggattaaagcaattgggcaatgttgtgaagtgcttgaggagttgagtatttgtgaccatagaatggacgatggttggatcgctgcgctttcgtattttgagagtttgaagatattgaggatttcgtcttgtagaaagatagacgctagtcctggaccggaaaagttgttgcggtcttgtcctgctatggagagtttgcagctcaagaggtgttgtttgaatgacaaggaggggataaaagctttgtttaaagtgtgtgatggagcaacagaggttaatattcaggattgttggggactgagtgatgattgtttcagtttggctaaagctttcaggtaacttgtcctttttgcttcattggtcttctcggtgggcttttgaatcatcatttttgttctttgcaggagggtgaggtttctgtctttggaaggatgctcagttttaacatcaggaggtttagagtcggtgattttacattgggaagagcttgagagtatgagagtagtgtcatgtaagagcataaaagacagcgaaatttcaccagcgctctcgtctttgttctcacttctcaaagaactaacttggagaccagacactaggtctcatctctcgtcgagtcttgaaggtgccgggattggaattagaggcagcaaattcttcaagaagagtgttttacattgaacatatgttgtgtaagtgcaaactcttagtttattatcttcttccctggggcattactactctctcttgtaaaataacacatcccaaactcttatgtatagcaatgtatagtattaaaac

SEQ ID NO: 632 - DNA, 1548 bp, Arabidopsis thaliana
ttaattaagatggacataatctcagggcaagctctgttactcctcttttgctttatcttatcatgttttcttatcttcaccaccacaagatctggacgaatctcccgcggggccaccgcgctgcctccaggacctccacggttaccgatcatcggaaatattcacctcgtcggaaaacatccacatcgctcattcgccgagctctcaaaaacttatggaccagtcatgagtcttaagcttggaagtttaaatacagtggttatagcttcaccagaagctgcgagagaggttttacgaacacatgaccagattttgtctgcccgtagtcccactaacgcggtacggtccatcaatcaccaagacgcttcccttgtctggcttccttcgtcgtccgctcgttggaggctgttgagaaggctgtcggtgactcagctcttgtcaccacagcgtatcgaagccacgaaagccttgaggatgaacaaggtgaaggaacttgtgagcttcataagtgaaagcagcgatagggaagaatctgttgatatttctcgtgtagccttcatcacaactcttaatatcatatcgaacattctgttttccgtcgatctcggtagctacaacgcgaaagcttctattaatggggttcaagacacggtgattagtgttatggatgctgccgggactccagacgctgctaattactttccatttctgaggtttcttgatctgcaaggtaatgtgaagacttttaaggtttgcacggagaggctggtaagggttttccgtgggttcattgatgctaagattgcggaaaaatcatcgcagaataaccctaaagatgtttcaaaaaacgatttcgttgacaaccttctcgattacaaaggagatgaatcagaactctccattagcgatattgaacaccttctcttggatatgtttacagcaggcacggatacaagctctagtaccctggagtgggcaatgacagagttacttaaaaaccctaaaacgatggcgaaagctcaggccgagatcgattgtgtgataggtcaaaacggtatcgttgaagagtcagatatctccaaactgccgtatttacaagcagtcgtgaaggaaactttccggttacatacgcctgttccgcttcttatcccgcgaaaagccgaatccgatgcggagattcttggtttcatggtgcttaaagatactcaggttctagtgaacgtctgggccataggacgagacccgagcgtgtgggataatccgtcccagtttgagccagagaggtttttggggaaagatatggacgtgagaggtagagattatgagcttacaccattcggagccggacgtagaatttgcccgggaatgcctttggctatgaaaacagtgtctcttatgcttgcttctcttctttattcctttgactggaagcttccgaagggtgtcctttcggaggatttggacatggacgagacctttggtctaactttgcataagaccaacccgttacatgccgtacccgtcaagaaacgcgccaataatttaaat

SEQ ID NO: 633 - DNA, 1158 bp, Arabidopsis thaliana
ttaattaatgctactgtgttttgtcggtttgatctccaaaaaccagacatgaacagaggaagcttatgccctaatcccatctgtctccctcctcttgagcaatccatctccaaattcttaacacagagtggaacgtttaaagatggagatcttcgagtgaacaaagatggaatccagaccgtgtctctgtccgaaccaggagctccacctcctattgagccattggacaaccaattgagtttggcagatttagaagtgatcaaagtcattggcaaaggaagtagtggtaatgtccagttggtcaaacacaaactcactcaacagtttttcgctcttaaggtcattcaattgaacacagaagaatcaacatgtcgggcgatttctcaggagctgagaataaacttgagctcgcaatgtccatatcttgtctcatgttatcaatctttctaccacaacggtcttgtttcaatcatattggaattcatggatggtggatcccttgcagacttgttaaagaaagtcggaaaagttcctgaaaacatgctatctgccatctgcaagcgagttcttcgaggtctttgttatattcatcatgagaggcgaatcattcatcgggacttaaagccttcaaacttgctaatcaatcatagaggtgaagtcaagatcacagactttggtgtcagcaagatcttgacaagcacaagtagtcttgctaattctttcgtgggcacatacccttatatgtctccagagagaatcagcgggagtttgtacagtaacaagagcgatatttggagcttgggactggttttgctcgaatgtgcaacgggtaaattcccgtatactcctccagaacacaagaaaggatggagtagcgtgtacgagcttgtggacgccattgttgaaaacccgcctccttgtgcaccttccaatctcttttctccagagttttgctccttcatctcgcaatgtgtacaaaaagatccaagggacagaaaatcagcaaaggagcttctggaacacaagttcgtaaagatgtttgaagattcggatacaaatctctcggcttacttcaccgacgcaggatctttgattcccccacttgctaactagaaccgagtttgaacaatcttttaacctccaagttattatttaaat

SEQ ID NO: 634 - DNA, 2289 bp, Arabidopsis thaliana
aaaaaacaattgttgaccaacaacaacaaccaaaaaaaaaaaaccactatataagcatgccccatgacccatatatgacaccacgagaagcaaatcaaaatcagttactctccgtccaaaatggtgttagtgattacagagccaattaagagtcaatcaaagacggtatgtgtgataggagcaggaccatcagggttagtgtcggcgcgagagctaaagaaagaaggacataaagtggtggtgatggagcaaaaccacgacgtaggaggtcagtggttataccaaccaaacgtagatgaagaagatacattgggaaaaaccaaaaccctaaaagtacatagcagtgtttactcatccttgaggttagcttcacccagagaggtaatgggtttctctgatttccccttcatcgcgaaggaaggaagagactcgaggagattcccagggcatgaggagcttttgttgtatcttaaggatttttgtcaagtgtttgggttaagagagatgattaggtttaatgttagggttgagtttgtgggaatggtgaatgaagatgatgatgatgatgatgatgtgaagaaatggatggtgaagagtgtaaagaaaagtggtgaggttatggaagaagtgtttgatgctgttgttgttgcctctggccattactcttatcctagattgcctacaattaaaggtattgtttttgtctaaattatatgtaaagctataatttggagtccgtgtgtaattatgtttaagttcataatcaaaatggttttggtgttttaaatacaggtatggatttgtggaagaggaagcaacttcatagccatatatatagagtgcctgagcctttttgtgatgaggttattaattgtagtaattagtgaataaacttgatgatttcatgatgtttatatgaagcatgcatgcatgatgatgatgatggtaggtagtggtggtcgttggatgctcaatgagtggacaagacatatcaatagagcttgtggaagtggcaaaggaagttcatctaagtaccaaatcacttgatattcctcctggcttgtccaaagtcattgaaaaacatcaaaatctccatcttcatcctcaggtacggtcttaccatcacatcacatatatacatcttattcaaatcatttaaaatcttttgttttatttttcaaatggttgtagattgaatctctggaagaagatggacgggtcattttcgaagatgggtcttgcattgtagccgacactattttatactgtaccgggtaagttaatatttctttccacgacaagatcactttcatctccttatttcttggggccgacatatgaatagttacagaaaaaatgtcagaattgtggattctatacatgaatatataaacatttcttgacatttttagatttgagaaattttatgtttactaacaaaaaaaaaaaactaaaaatgtgggcacaaatacgtgtaggtatgagtacaaatttccatttcttgagagcaaaggaagagtagagattgatgataatagagttggaccactcttcgaacatactttctctccttctctatccccttttctctcctttgtcggaatccctcgaaaggtacaatgattagtacttacttactaatcattatgatttatataaatcaatctttcgttagttaaatcgaggattaaaaaccggttaattgcagttgatagggttcccattctttgaatcacaagctaaatggattgcaaagcttttgtcaggcaaaacttcacttccttcctctgatcaaatgatgcaatcaatctctgatttctatctcgccagagaagctgacggaatccctaaacgtaacactcacgacatcgccgatttcaatgtagtacaaagtttctccctttttttgtttactcaaaaagtttcgatctttttcatctgataaagctctgtttttttgtttttggatatttgcagtatagcgataaatacgcggattacatcggatttccacatctggaggaatggagaaaggtcttgtgtttatcggctatattgaattccatcgaaaatctagagacttatcgtgactcttgggacgatgatgatcttcttcaagaaactcttcaagacccttactttacccaactttcaattccttctgtttgataaaaacaagatttatcttttgtctaaatgaataaaaacgctaaaggtctaaactttctgtagtatatttgtatgtaaacttcttttttgaagtaccatctagcttacaaattcatcttc

SEQ ID NO: 635 - DNA, 1850 bp, Arabidopsis thaliana
atgataaatccattgttatcaattcaaaactccccaaccaagttcttgaaaccaccactttcgtccattcacaggcaacaacaacaacaagagaggcagagcaataacaatacccttttcatgggggaagccagaccaagaagagcgaccacattcgcatgtctctcgataaggagaaggagaaacaacaatggtgtgtctgaatttgaagaaacggcgaggtttgaacaagtgggtggtaaaggaatctcggttttgtgcgggttaggttattgggtacaaggatcaagatgtttcccatggcttgcacttaacttccatatggttcatagcctcgcactccaaccatcgacgcttcagcttgtgcaatactcttgcagtcttcccatggtggctaaacctctctacggtgtgctctcagatgttctttacattggaagtggtcgtagagttccttacatcgccattggaggttagtttttccaaagtctctctttgtgccagctccaatgccttgaacatgagatttttagaaccaaatttaggaaatgaagaagcttgctgattgtggcgattctgtgtcagtgtttctgcaggttttagcatggggttcaatggggatatttcaaggagctagagaagttcttccttctcttgtggcatgtgtcctgcttagtaaccttggagcatccatcactgaggttgcaaaagacgctcttgttgcggaatacggtctgagataccgaataaacggtctccagtcttatgcgctcatggcttcagcagctggtggagtccttggaaacttacttggaggatatctcttactcacaacacctcctaagatctcctttcttgtattctctgctttgttgtctctgcagctcgttgtttctttatcttccaaagaagaatctttcggcttaccacggatagcagagacaagctcggttttggagagcgtcaagaaacagatatcgaatcttaaggaagcaattcaggcagatgaaatctcccagcctctgatttgggcagtagtatccattgcaatggtccctcttctctcaggatcagtcttctgttaccaaactcaagttctgaatcttgatccttcggttattggaatgtcgaaagtgattggacagttgatgcttctttgtctaaccgtggtctatgatcgatacttgaagacacttcccatgagaccactgatccatatcatccaactcttgtacggtttatcgattctcctcgattacatcttggtgaagcaaataaatctcggatttggaatctccaacgaggtttatgtgctgtgtttttccagcctagcagaaatcctagcacagtttaagatccttccatttgcagtcagattagcaagtatgtgtccacaggggtgtgaaggatcagtcacatcttttcttgcttcaactctgtgtctatcacaaatagttagtgcattcttaggcgtcggattggctaatctgatcggtataacatcaagtaactattcaaacttgtcttcagggattctcatacagtctctagcagctctggcacctttgtgcttcatgcaccttgtgccaatgtcagaacctgtgattgagaaagaaggcaagagaggtattagtaagagaagcaggagaaacagacgagtcgggagagtagtcgataaagaaagtgttacttaccgacgggaaagagagtcagaagaagcacaaaggtagtgtaaagtatagttacatcacaaattagaatagttgtgtatagcgaaggatgtatactttgtctatatactgagattttcctttttctctctttcttgcgatatcatcctatttggatat

SEQ ID NO: 636 - DNA, 1100 bp, Arabidopsis thaliana
atgagagggatggtgagttttgccgtttgggctctctttgctgctttactctcacagcagctctttgcttctgttgcttccgtaaggtttgaggatgccaaaacatactacttatctcctccctctggtaagaaaccaaacattgtaactttttttattcgcttgatgtaataagaatcttcactatgcttctttcacttaactcatgcaggctcacatggaactcctccatcacacacgcctccttcttctaactgtggaagtccaccttacgacccttctccttcaactccttctcacccttcacctccatcacatactccaactccttccactccatcacacactccaactccacacactccatcacacacgccaactccacacacccctccttgtaactgtggaagtccaccttcccacccttccacgccttcacacccttccactccttcgcacccaacgccatcacaccctccttctggtggatattactcatctcctccaccaagaactccggttgttgtgactccaccatcacccattgttgatccaggcacacccatcattggaggaagcccaccaactcctatcattgacccaggcactcctggaactcctttcattcctgctcctttcccaccaatcactggaacatgcgagtaagtgtcaaaacattcgctcttatacaaacatcataagacagatgatgatatcaattatcacacttcatgtgttttgtttatcttttgtgtagttactggagaaaccaccctacattgatatggggcttgcttggatggtggggaactgttggaggagcttttggtacagtcagtattcccagtagcattccagggtttgatcctcacatgaaccttcttcaggcactttccaacacccgctctgatcccattggtgctctctaccgtgaaggcacagcttcttggttaaactccatggtcaaccataagttccctttcacaacccctcaagttagagaccactttgttgcaggactttcctcaaacaaggcagccacaaagcaggcccataccttcaagcttgctaatgaaggtcgtctaaagcctagagtctga

SEQ ID NO: 637 - DNA, 1551 bp, Arabidopsis thaliana
gggtattgggttcaagggttaaggtgtttctcatggcttgctcttaacttccatatggctcattgtcttaatctcaagccatcgacgcttcagcttgtacagtacactgctagtcttcccatggttgctaagcctctctatggagttctctctgatgttctttatattggcggtgctcgtagagttccttacatctccgttggaggttagttttctttctccaactgtcccggaaaaaacggtctctttcgcattatgctccaaatggtccaatatagtgttgtctcagtgcttttgcagggtctagcatggggttcgttggcgatattccctggtgctagagaagttcttccttcacttatggcatttattctgcttagtaaccttggagcatccattactgaagtttctcaagacgctcttgttgcggaatacggtttaagatatcagataaatggtcttcagtcttatgcacttatggcttcagcagttggaggaatccttgggaacttactcggtggatattgcttactcaagacacctcctagaatcttgtttcttgcttttacagctttgttatctcttcagctcattgtttctttatcttctaaagaagaatctgttaacttgccacggatcggagaagtaactccagagataagctctgttttggggatcgtaaagaaacagtttttggatcttaagggaattgttcaggtagatgaaatctcccagcctttgatttggatagtatcttccattgcattggtccctcttctctcaggatcagtcttctgctaccaaactcaagttctaaaccttgatccttcagttattggtatgtcaaaggttattggacagttgatgcttctctgtttaactgttgtttatgatcgttactggaagaaacttcccatgagggcgttgatccatatcgtgcaactcctgtacgcgttttcattactgtttgattatatcttggtgaagcaaataaatctcgcgttcgggatctcaaacacggcttttgtgctctgtttctctagtgtagcggaaattcttgcacagttcaagattcttcctttctctgttttgctagcaaatatgtgccctggaggctgtgaaggatcaatcacttctttccttgcttctactctgtgtttgtcatcagttgtaagcggattcactggagttggaatggctaatatgatcgggataacatcgaagaattactcaaacctgcctgcaggaattctgatacagtctttggcagctttggtgcctttgtggtttattcattatgttccaatgttagagcctggttttgagagagaagggaagagagctatgagtaagaaaagcagaaggaatagacgtgtagggagagtcataggtcaggaaagttttgcttaccggcgggaaagagaaacataaacaagaatcagtctgagttatagttagagctagttcttcagctgacataacattgtttcttgggaggagaagattttgtgcccatgtaagtaaggatggatactgatgttggtaaacata

SEQ ID NO: 638 - DNA, 666 bp, Arabidopsis thaliana
atggcgcaacaatcgttgatctacagtttcgtcgctcgtggtaccgttatcctcgttgagttcacagatttcaaaggcaatttcacatcaatcgctgctcagtgccttcagaagcttccttcttctaacaacaagtttacctacaactgcgatggtcacacgttcaattacctcgtcgaaaatggattcacctattgtgttgttgcagttgattctgctgggaggcagattcctatggctttcttggaacgagttaaggaggatttcaacaagagatatggtggtggaaaggctgcaactgctcaagcaaacagcttgaataaagaatttgggtcgaaactgaaagagcatatgcagtattgcatggatcatcctgatgagattagcaagcttgctaaggttaaagctcaagtgtctgaagttaaaggtgttatgatggaaaacattgagaaggttcttgaccgtggtgagaagattgagcttttggttgacaaaacagaaaaccttcgctcacaggcgcaagattttagaacacaaggaactcaaatgagaagaaagatgtggtttcagaacatgaagataaagctcattgtccttgcaattatcattgccttgattctcatcatcatcctctcaatttgtgggggattcaactgcggtaaataa

SEQ ID NO: 639 - DNA, 1964 bp, Arabidopsis thaliana
tttatgtttgtgtgtctatacttattacaaatctatctcatcttatataacaggactctttttctattaatgagattggtatgctagatttggagtgtattggattagattgtggcgatcatgggttctttgtctgggatcattcaacggccacttgttgctgctgctgctgtgattacagcttctgtgtctgcagatgtctctgagaggttctcatctcttagatcactagttcgaggttctgaatcagagcagattgctccttcagtgtctggtttagttcaggaagaaaggtccttgtgggtttctcaagtctcggcctccaagcttgcagatttatcttttgtgtcgaggatttgtgttcctgtaccaaatgttgatctcctagcttctaatcctagctgtagtctcgctacttctgttacttctctgtccgctcttcgtagtgtttatcagtctgcagagttggctaaagcatcgaaaccggttgcattcacaatcggtgcctcacttgtggttcctgatatttcctacagatggcatttacctgagcctagtgcagtcgatatgtctggttcttcgagttgtgtgtctgaaaagaatagaactgttgtggttttgcttggatggcttggatcaaagcagaagcatctgaagaaatatgctgattggtacacttcaaagggttaccatgtcattacatttactcttccgatgaatgagattatgagttatcaagttggagggaaagcagagaagaacatcgagtcgctggttaatcacttggctgattggttggatgaagagcaaaagaaaaatctcgtctttcacaccttcagcaacaccgggtggttaacgtgagtttaatatctctgtttttttcatgtgcttacatagttacatggcggttttacattttactaagcgagtttctcatctatgcagatatggagccattttggaaaagtttcagaagcaagattcatcattgatgggaagagttaaaggttgcatagtggactcagctcctgttgctgctgcagatcctacggtaagcgatgattcttgcattcatagccatgtttatatggtcatttggcttgtgctaaatcataggcttggatacctgatttgctagacgctgatgggtgctattctttttatagatttctgcactattcgcttgaactttctggatactaatttggctttgttaaaacaggtatgggcatcaggtttctcagctgcgttcttgaagaaaagcagtgtagccactaaaggatctgcgagctcatcatatgagtcaaacggtataaacatctcccagcctaaacccgctgcaacagaaacagctttgcttttggttcttgaaaagttctttgcggtgattctaaatcttcccaaagtaaacaggtaacatacaataaaactccgcgtttcgtcactcattcttttacccaaatcctatgatttcacactaacaaatgcgggcaatcatatctcttcactcattcttgtcacccatatcctatgatttcacactaacaaatgcgtgcaatcatatttttaacaggagacttgccgatgttcttgacacattatcaacagcacaaccaagttgtccacagttatacatttacagctctgcagacagagttataccggtggaacaagttgaatcattcattgtagagcagaggaaagcaggacatgaggtccgtgcttgcaacttcatatcttcacctcatgtagaccatttccggagtaacccagaactgtatacagctgagctcaaccatttcatgaacaactttgtcctttcttgctgccaccattcttcatagcgacttccacaagtgttgttgttgctaaccatttttggggtccttttaactcttatacaagaaagagaaaaatagttactgattgatgattctttttggtttggattggtttatagattc

SEQ ID NO: 640 - DNA, 2789 bp, Arabidopsis thaliana
accgattgaccacgttctcgtcttcccccaaatctaaaaccctaaattctcaattgctcgtcacacttcgtcactccaccagcgacaatcgccgcagaaacctctacgaaacttgctacaatggagttttcatcacaagacgacgattttggaggagacgattccgctgctaatgccaccagggcttcaggtcccgacattaatggatttctcttaattcatggtttttgtttaaggttggattggacattaatttctcatctgtatcattcaggtaatagaagaagcttcggtgatcttgaagacgatgaagatgatattttcggatcaacaacggtagcgcctggtgttagaactgggatgattttgtctctccgaggaaggttattatccaatcctttcttcatgtatgagaaaaatctttgatgtataattctaactttcttttgctttttctctttggcagtcttaagaattgtaaagatgatcttgcttcatgtcaagtaagcattgttactgttcatccctaatctgtttgaattctataccattgctgtttatggttgcttcgcttttgcatctaactatatcgttttggttagaatgagctcgagtcagcaaaaacagagattcagaagtggaagtcagcgtttcagaatgagtcctttgttcccgctggaaaatctcctggttaacctctctttctcaattttgttttgtacatttgtatatgcgatgttaattcttgagcattcaatatgattctgtttggtacttttttttttccagaaccaagatttttgattgattatattcaaaacctaaaatcttctgagaaatctttgaaagaacaggtttgtacttgagtaataacttgtgtgtatatatcaatatgaaggtcttgattttcaaataaggtttggttgttgtttctctcttttcagttagaaatcgcaaagagaaaagaagcgtcatgcattgtacaatatgcgaaacgggaacaagaaatggcagaattgaaggtaattctcgagaaactcattgcctaccactttgattcctgactgatgctatcacatgttttcttgaccattacatagaatagatgtcgctaaacacagtcttgtattttgtatttctagtcagctgttcgcgatttgaaatctcaactcaagccagcgtcaatgcaggtatatagttctcccaatgttttgattctggaataatttatacaattgtgccaacaatacaaatcgtgaaaaaagttagctgttgaagtaacttggacttttctaggcatagtccgctttttatgccgtagtgtaccttttatgacggtcatcctcgaccttgatgcatgtagagggaaaccttttccttgccttttagatttcagtctgaatacgatgataagcgcatgtttcttgtaaacctttacctggcatctgaattattaacaagtctgaatagaagaaatggctataaattttgaattgcaatggtcatttagcagcttgtcatgatcagatagcagtgtagattatttattctttgtttacctttgtaggcgaggaggttgttactggatccagcaattcatgaagaattttcacgtctgaaggtctgcacctactcgtttctatttacccttagactactttttcataaggatgtatttgtcgtaatatatccttagataatccaaactgtatctacggaacaaaattccgctttcgttatgaatggcctgaaagaataattccttaataactgatagctgacactgtcgtagtagatacagttgaggacgaacattcccaactttttgttaatgtacatttgttgcagttaagtaaagagtagatgaagtttgattccatgtttctattatgcagaatctagtagaggaaaaagacaagaagatcaaggaactccaggacaacattgcagcagttacttttactcctcaaagcaagaatggaaagatgcttatggcaaagtgcagaaccctgcaagaggaaaatgaggagattgggcaccaagctgccgaaggaaaggtatagtttgttctactctcagtcttcaatctggaattatatgaattatatagtaaagcagtagtcttcttcaacctttgtaaaacatgattccctgaaaagggtaaagaaattgatgcttgcctatgttcatgtggaatggcagattcatgaactagcaataaagcttgcaatgcagaagtctcaaaacgcggaacttagaagtcaatttgaaggtaagtcatatgttgatattaagttatagcaaagatttttgtagagtttgcaatttggatttgaggatttttgtggaatgcaggactgtacaaacacatggaggaattaactaatgatgttgagagatcaaatgaaacggtgttgatccttttctcttatctcttaattcctcaagatttttcttaaaacggaagaatgattatggttttgttggaaatatgtgactttgataaatctcaggtgataatattgcaagagaaactggaagagaaagagaaggagatagagagagtaaagaaaggactggaaattgtgtctgagctagtaggtgacaagaaagatgaagttgatgaaattgatgaagatgcaaaagaagaaattgctggtggagaataggaatttgtagctttcaaaaaatgttttgtacattttgaagttcaaaatcacatttcttcattcgttatctgtttcatgaaacagaaagttctaatcttcatcttctattaatatgtttta

SEQ ID NO: 641 - DNA, 2058 bp, Arabidopsis thaliana
tttccagatcctaaaatcttcatctcctacagatctgcagaaatggcggttacgtactgattcagatacgggagaagaaaaagaagaaagctttctgctttaacttttcccattactgtaatggcggatcctctaaacggcaagtccttctttatctgtttctcccttttattctccttcactctgcttttcatttcgccgttgtatgccaccgagtctccggttatcgaagatgtttctaccgatgttgctgtgtctgttagcgaaaccaatcgagaagctgttctattgcataatttagaggaactcgttaagaatctgacggaattagtcgctaatctagatgctaagttatctgcaactccattaaaggagaagaacgagatctcagttgatgatgacatcggagaagagaaagagagaggaagggctaaggcgttttcagtgactaaatacagtccgttttggtcggagaggtttcagtttacatcagctgtgaaactcaattccgatgcgacttgtatcaatgtgttgccgtttagagatttcgaaggttcaagcaagtactttgcaattggtgattctaaaggtagagtttatgtgttcttgagaaatggtgatgttttgattgagtttttcaccactgttgattctccggttactgctatggtttcgtattcatctgtgtttaagaactcgagtttcgtggttacgggtcatcagaacggtgcggtgttgttgcatcggattcacgagggatcgaatggcgaagattggaactcgaattcggtttctatggaacatgttgggaagtttgatgtggatgattcagctgatcctgtgactttgttggaagtgcatcatgtgggtcgtgttaggtatatattggcgactgatttaagcgggaagctcacggttttaactgagaacaggacggtttatgggtcggttattccatcgagtagaccgctcgtgttcttgaagcagagattgttgtttcttactgagtctggtgctggttccttggacttaagaagcatgaagataagagaaactgagtgtgaaggactgaaccattcgcttgcgagaacttatgtttttgatgctgcggaacggtctaaagcttatggattcacatccgagggcgagatcattcacgtattgcttcatggagatataatgaacttcaaatgtagggttagatccaagaagaagtttcaaatggaggagccagtagctttacaatcaatcaaaggctatcttctagttatcaacgaagaaaaggttttcgctttcaatgtatcgactcagcattatgttcgtactgcgggtcctcggcttttgttctcagcgggattagaagagatcagatccgcgttcttgagccatcgcgaatcatcttcacgaaccaccacagtagtaaagactaggccgttaatagctagcgacagggaaaaccttcttgtgatcggtttagaaaacggatatttcgctgtttacaaatcgaagctgccaactctcaaaggagacttcaacacaatgctttggagcagtcctgtgttcttcttcatactatttctattcggggcttggcatttctttgccaagaagaaagaatcgctcactgcatggggaccagatgatccttttaccccgaccggcgcacaaaatagttcggcgaaagagccaacatttactgaaccttcaagaagaaacgatgacctcatggatctacggagaaggtacgctggtggctcataccggtcagttggagctaacgacccgagttcaagagctccggttgatggaaactatagaacaaccgcacaggatcataacaattatcgcggtggtggctcgggtcttgattcaaacgggtttggtaatagaagagatcatttgtttggtaacaacaaagttttggataacgaaagttagaatctttggattacttgcaaattctggcacgttaatcaccacttacttcaaaaattgtaatctttgtaactttatataaacgctaaagggttttattattcctcgttcggtttttaactt

SEQ ID NO: 642 - DNA, 436 bp, Arabidopsis thaliana
ttaattaaattagacaccgaaaatggcttcgtctgcgccacagggatctgttgatcctctcaccgggaaagatccggcgaaggctttaaccgctgttgcttctggattcttcgagaatgtgaagaaaaacaagcaaagcttcttccagttcgccgccatgactgggattttgcttctgagtttccgatcggtaagtcagaagtaccgaattcacgatctggaggaagacactgctgttctcaagaaggaacaagatagtttgacggatcgtatgagtaaaatcaaaagcgatcttcttcatcaagcatcgattgactcttccggcgtctttgcttctcgtctccgtctacttttcggtgaagataaaaagtgatcggagatttgattggtttgagtcaacgaggttaccattttcttactcgtgcgatggcgcgcc

SEQ ID NO: 643 - DNA, 1187 bp, Arabidopsis thaliana
ttaattaaaaaaggaagaagcgaagaacgaagtagacgaagacgatgaagaaaggtggattcagcaataatctcaagctcgcaattcctgttgctggcgagcaatccatcaccaaattcctgactcaaagcggtacgtttaaggatggagatctacgtgttaacaaggatggagttcgaatcatttctcaattggagcctgaagtcctgtctccaattaagccagctgatgatcagctgagcttgtcggatttggatatggttaaagtcattggcaaaggaagtagtggtgttgttcagctggttcaacacaaatggactggccaatttttcgccttgaaggtcattcaactaaatattgatgaagcaattcgcaaggcaattgcacaagagctcaaaataaatcaatcgtcacagtgtccaaatcttgttacctcgtaccagtcattttatgacaatggcgcaatctcactaatcttggagtacatggacggaggatctctagcagactttctcaagtcagttaaagccatccctgactcctatctttctgccatctttagacaagtgcttcaaggattaatctatcttcatcacgataggcatatcatccatcgtgacttgaaaccatccaatctgttgatcaaccacagaggagaagtcaaaataactgactttggtgtgagtaccgttatgacaaacaccgcaggtttagcaaacacatttgtggggacttacaattatatgtctccagagagaatcgttggaaacaagtacggaaataaaagtgatatatggagcttgggtttagtagtactcgaatgtgcaacagggaagttcccttatgcacctccgaatcaagaggaaacatggaccagtgttttcgagttgatggaagccattgttgaccaaccgccacccgctcttccttcaggaaatttctcccctgagttatcttcattcatctccacatgtttgcagaaggatccaaacagtcgaagctctgcaaaggaactgatggaacatcctttcttgaacaaatacgactactcggggatcaatctcgcgtcctacttcacagatgcaggatcgccacttgcaacacttgggaacctgtctggtacgttctccgtgtaaactacaagggagacataatatcaccatctggttcctgttatcaatttaaat

SEQ ID NO: 644 - DNA, 434 bp, Arabidopsis thaliana
ttaattaaccgaggaagaagaagaagaagagatgggttttgtcttaatctgtacttgtcctccgtcctcgggtgtcgtcgtctctcagcttcaccatcaccagttctccgccggagtcaaaagcaatgaactttggtttcgtccgactcgtagaaccctaatttcgaaatcatcttgtttcaatctccctcaagaacccattctctccgaagctctcaaggagccaattgcattcttgggtgggatgtttgctggacttctaagacttgatctaaacgaagagccgctcaaggattgggtgacgcgaacagttgaagcctcgggtattacagaagaagaagttgatgcagatggggttgtttccaatgatgaagactctcctcaacagatagagattgaatgaggtgtcttggttctgcagtatttggcgcgcc

SEQ ID NO: 645 - DNA, 366 bp, Arabidopsis thaliana
ttaattaaaaaagaatctagacgacgacaatggcggagaagagccaaatccctgataacaacaacaatacttcttcgtcggcgaaaaaaccgacgccggagatcggatcgggttcgggtaaaaggtattataacccgcctgagtcggtgaatccggatcaggcgacgttaagggagcaatggaaattcgcgattcggcaatacagtaaatggtactcacacgcttggggaactgcgattctagctggaggttttttcttcggactcggttggatcatcaagggctctaatcctcttccttctcttcaatcgagttctaagcctcgcgatgaagaaaaatgattccgtatctgcgttttggcgcgcc

SEQ ID NO: 646 - DNA, 310 bp, Arabidopsis thaliana
ttaattaatatggagattgagagtcacgtttcagtccctgggaagaatctagttaaagtagagttcaagcttgggacagagagctacacaattgattcaatcaagggtgatactgtattggaccaattggtttcgatgaaagaagaaagtatgaagatacttaaggattttatcacaaagcataatgttccagatgatgatgtccctgaccaaatcttgtctgatgatgaagaaggtgatgatgatgatgcttctcctgtaatatgtcctgtgaaaccacccaagaagacaaagatttgagtggcgcgcc

SEQ ID NO: 647 - DNA, 1629 bp, Arabidopsis thaliana
agaacatcaatgtatcttagactcttacacatcttaattcctaatatagttgtgttattcaaagaaaaaagcttctctcttatgcagataagggcattgcttcattgatatggttaagaaatgttagttgcgtatcctgcgggaactatcaacaaattccaaatccctattagctgctatgccgctttgcgcagattcaagacctcgccttttggtcctctgattagttgttctgtctccccaagatcaatagttccttgtagcaatgtagagtgttatcattcatctttttctacaaaatatcaaattcagcctcgaaggagatggatggttagtaattaaagttttcgtctcttcggcaagttatacatccatctgtatactgctcctaagtttttttgtgtttgttcttttgatttcatcaagttttgtaactcacgcaacaactcgatttcatcggatgatgagtaccgttcatcacccaacatagctataagtcttttaagacgttacaggaccgtgattggacgcggtgaaggcgaaaccttaaaagtaacttcctttttttatttgagtcattcttgttttcttctcgattgtatatccatctttcattaatttgtttgtgtgtgtatcttcaggaattcatatccgctggtgtgaatgcatatgcgctcggctgcacagatgaagatttgagaaaagaactaatggctatgaaagattcgggtttagagattgagagaatggagaattacggcggaagcacacagactaaatccaaaattacgctgtctgaggttagttagttacaacgaacttgtgatatcatcggttaatatatgagctaagtcgtatcagatcaattttaactggcggttttaattccgcaggtagatgaatgcatattgtggcttaggattgtattcatcacgatcttgtgtacgccgcaaccaacagtcataagatggtcatcgactccttcggtttctgatgaaattctaagcaaatggagaggcttttgcgcggttatagcaaatgcatactatattagaggaatggcttggtaagatcaaatatattcgattctatcatttttaaaaatccattctaagatgaaaaataaatgtttgtaaagagtgtgaaatctatgtgtatttacgaattacgacaatgctattattggaccttggtgtgagtgtaggctgcctgtgaagactcttcagttggagcagatggcggtgacaggacaatcagaggagccgtccgttgtggccagccgaatgagactggtgtttagcactctcgaggttagtcttattgtatctgtcttataaaaaaaagtgatatgttattgtgtctccactgtttcaaaatggattgttactttaaattcgccaaatattgcgtcaagagtcaaaaaactcgttggagtgttatgtttaataaaacttgattctttgtttatcgtattcgtaggtagtgagtcctcaatggccacgggtttaactatgatgttctgcagattgaaatatacgagttctaaggtatctttgttttgttctttgaatcttcaaaatgtttttatcgtcttgttaatcccattttgtaaatggttgtagaactact

SEQ ID NO: 648 - DNA, 1526 bp, Arabidopsis thaliana
tcggtacgaatccatcttttcccacccaagatctctccttcttgtttccccagatctgaaatttcaaaagctacccaattttaactcaagactctgaacaacacatctagatccatttccatggcgagcgcctggaaaaaagacaagaaccaaaaacttttatcaccaaagacactaatctcacttcttgtcctttccattatcttcctctcttctctcttcttcttcttctctaactcctctctccaatactccaatccaaatctctccatcaattccccataccctatccctccttttgattgcttcaaatgtccacaatcaaaacccataatcgcaaacgtcgtcgaaaatctcaagtacccttttgtttactctctcgctgatctcggtaatctcccggagaaaccacataagaacattgttaggctacttaaaggtaagccctttaggaaaccagatatctccgcaacgattcaggaggtattggatagtatgagagctagtggtaaaaatgggattgttgttgatgttggagctaatgttggtatggctagctttgctgctgcggttatggggtttaaagttcttgcctttgagcctgtttttgagaatttacagaggatttgtgatgggatttggtttaatagagttgcttctttggttactgtgtttgaagctgctgcttctgacagaacaggggatattaccttccataaggtatcatcgcatttctataaaacttgagattagtttagtgaaaacactcaaacagagttttttggtttctgtttatagatagattagcatagagtaaatgattctcttgcttcttattgatgctatagtgataatgaagccgaaaagtcgcaatgtggaacgattttcgtgtttgatagtgtcgaaaaagtatacaaagatgtatcttttgtgcataggcctaatctgcttaggtgaaactgaatgtttaacttggttttactgtactaggacctatcttgtttattgggtctagctaaatgtggatgccattgttgttgatacagttggtaggacggcttgacaatagcgcggtttcggaggtgggagcaaggcttgcattcaagtccaacaaagagatagcagtgcaagtcaaatccatacctcttgataaactaattccaccttctcaacctgttcttcttatcaagatcgacgttcaaggttgggaataccacgttttaaagggtgcgaagaagttgctttcagggaaaccagcagaagctccttatctaatctatgaggaagatgagagattgctcacggcaagcaatagtagctcgaaagagatacgtgattttcttaaaagcgttggatatagtaagtgtagccagcatgggacagatgcacattgcaccaaggagtgaaagacattggacttaccgacaaatggtaataagatgccatacaagttgaggaatataaggaagatgagcaataggtatttgcagagaaaaacatttagtttataagttgccaaatttggt

SEQ ID NO: 649 - DNA, 2469 bp, Arabidopsis thaliana
tcaatctcacacctcttcttcttcttcttcttcttcttcttcttcaacctcttaaatctcaaaatctcaatcatcaagcttctccttcttcttcttctttccatcttcgcttcaacaacaatgtctaatttcacttatacatctgctttcaacttatccgacaactccccttttaatcccgccattggttcttcgtcttcttcttcctccgcgctcgtcgtagcttccgatgatgataataataccgatgatgcttgtagcatctgtctcgagcctttcaccctccaggatccttccactgtcagattcttttaatcctctctctttttgtttttgtctataagctcttcggggtttaacgatctccttctcgcttttatttcgcttttacttgaaatctgggataatcggattttgtgccttgcgatattttgactcagattaataacgagatcgtttgattaactcgatcacttgttcttgaaccatcgttgaacatgtttgattgatcctctcgctttctcattttggtcctattggatctaacataaacatcttctattgttgtttcttctccgatatctaaagctttccgatggttttctcaggtcaccagctgcaaacatgaatatcaccttcagtgcatcattgaatggtacttgcaaacatgaatctgtgatcttttttatctttctttggacttgaatcttctcttcatatctctatcactgattgatttgtcattggggtttattattacacaggtcacagagaagcaaagagtgtcctatttgctggcaattgtttgttttgagagaccctgctaggtactctcatccatctttaaggagaaagaaagattttgttctcatgatactttgctcatagttaggtcttgatagtattattggttcctttgttttgtagccaagagcttttagctgctgtggaaaaggaaagacttttgaaaaccaggaatatatcttcatcctctccaatctctattcatcactctcatgacgattttcactctgaggaggttcgacaaagtctccagtgtgatttattaaaatttaggagttttaagttatagtagttgacttgataatgtttccaggaggaatcacagtttagcagctttgatgaacaattcttgaggcatcttactgaagctgcacatagacgttgtttgcttcgcagaagggatggtcaaatatcctctagtcttgtttcgtccagcgatcccactacgattcatcctactgatttggtcaatctttatcgtctctctgctatttcccatgttgaacatcaaaactcaaacccttgtccaagtcctggctcaatgactccatctcccgtctctggtcattcttccattcctgcagatagcaataacggatccaggtattgacatacacataatcaagtctggtttattgataacgagctttcatgatttattcgctttccatttgcttgtgctgtctctataaccagctttcatgatttgtatggtttccatttgcttgagctgcacaatgcagatgctcttatacttcctgtttcgcttagttactgggattatcgtctactgataaataatttagatggctctggaattctagaccatgtctctttattatgcagctacttcttggagaattggtcaagcctttaaattgtttagaacttacctaaaccatatgtaatatatcttcatcttttcttgtatctgtcatcagaatctctcctggcccttctccatctcgttcatctcaaagtccaaaatcacctgaagcatcctcgcttccggaagccattaaatcgaaactagctgctgcttctgcaaagtatggctatctcaattcctcttcatttgttcagaaattggttataaaaactgactgggacatacatgcatgcctccaggtacaaggaatcgatctctaaaagtaaacaaggtcttaaagagaagctacttgctcgcaataactcagtgaaagaattgagcaaaggagtgcaacgtgagatgaatgcaggaatagctggtgttgcacgaatgatcgaacgcatggatttttcttcaaaacgttttggagggtctgctcatgtatcaacctccactgctactgcttctggattcaatttctcattcaaagggaaacgtgtagaagccaattctaagtctaacaacaatggagacaaaaccgaaccccaaaagctgcaggtttcagacttctcccggtttcttgtcttctaacatttgtatctttaaaacataaagctttttatgggttttgctaatgagaatcgttgaattcatctcagggaggagaaacgtgctgaggcaatcagaaaaatggagagaggcctttaatgcaagcgatgtacgtttccattgaatcaacttacccgttggtcttcgcatcctgcattgttcagagctcacggtctcgtctctcgtct

SEQ ID NO: 650 - DNA, 2090 bp, Arabidopsis thaliana
tagagaatttgttgtctttttttctttttcttttgtggggtatttgtttttttttttctccttaaaaagtttttttttttgtgtgtatgaaaaaaaaagctttgaaattctctctcgacaatggtgtcggaccaggatctagcgaaaggagtcgagactttgcttcgacaatccgaccctagctctctcacatcgttaagcagtattgttcagcagcttgaagctaagttagggttagacctcacggagaagacgactttcatcagagatcagatcaatatcctcctccgtgctcaccaaaacccttctgcctccgtcgcctccgcttcatccgtacaacaatctcaccctcctcctccgccgtcttctcaccagcagcagaatttgcattccggcgtcaatgttcctccgatggcgaaagggcatttcacacttagccatccttcgcaattctctgtttcttctcaatcacaacaatatccttcacatttcgctcttcagcctccttatcactcttatgacctaaatttccggcagccttatccggtttacatgccgccgcaacagcaccagcatcagcagcagtctccgcgacaacaacaatcctctgtgatgctctcacatggcgggaatgcttctctatctgttaatcaagccccaaaagaaaggtagggtttgcaacatatttcaaatgttggtacgtaattttgctcaaggttgttccaatttcagtaatttagggcttttgctactttcatggaaaacatgattttccattttaggaatgtctaaatcttttgtcaattttgttcatttacgggtttttaggttttacatgctcatgtttagaattatcatcctgtgatatttttagcacattgattcatacaacgttctattatagtgtgattatttctttctgatctacctaaatttggcacatcaacgaaatttgtcaacttttcctttgcagtgctccggctggaactaaaagaaagggtggtcctggaggactaaacaaagtctgtagggtttctccagaacttgaagtagttgttggtgaacctgctcttcctagaactgaggttatcattgtctttcatttatgattataatgtgtataagcaattgtggttgttatttatgtgttgctgtgtttggcttttggttttagattgtgaggcaattgtgggcttatataaggaagaataaccttcaagacccgagtaacaagcggaagatcatctgtgatgatgcgttgcgtgtggtttttgagactgattgcactgacatgttcaagatgaataagttgcttgctaagcatattctcccgcttgatccatcaagtaatggttaaacacaagcgttttttgctgagttccaactgtgcttggtttgttcaaggttactgactgtttgagtcacttttggcagaggactctggtcaagcaaaaaaggcaaaaactgaggtggagactaagactgagaccaccgagcctattagttcaactgctattagttcaactgttacattatctgagccacttggtaagttctttggcactggtgagacggagatggcagacgaagagattattcgccgtgtttgggaatacataaaactcaacaatttagaggtaatgattttaatcttgaaatcctctggtttctccttattgcttcgaatttttttcctgtttgctgctaactaaagctggtattgtggtttactctataagataatttacagtataggatttcacataactttatgttatagagcatagtgaatggccataaacaagaaaattaagatttgtttattctgcttttcaattttctttcaggacccagtaaatccaatggctattcagtgtgatgaaaagctccgagatcttcttggatgtgaaagcatttcagctgtggggataaatgagatgctgaggcgccatatgtacaagcagtcgtgatatcttctggtctgacttaattaactaggaactactagtgtaagtgaagtttgatttaacagattatgatacttatatatcagcattgtccaaatatggtaattgacttctgtatcacaa

SEQ ID NO: 651 - DNA, 578 bp, Arabidopsis thaliana
ttaattaaacttgattaggatttaggatgcagcctacgagctcaatgaatgaagaattcctaaagaaatggcaaatgggtcttcaaatattccgtccttcgatagacaacacgagcgtccacgagagaaaaaaagcaataaagctctctgcagacgttgcaatggcgtctctaagaaaaggaacaacttgttggagccgagccctaatcgagaaaaccgccaccgaggacaatttcctcgtacgtcagatgctttccggcatcaaagcggaaacgttaatcaacaagaagttgcctaagaagactgtgtgtcataggaagatcgtgaggcgaagcaagaagatcttgaggaggaaatcgaaatcagcgagcgaagaggctgcagcaaaagctaagagactcgtcaagagacggactcaaggattaagaaacgttgtacctggtggtgagttgatgagcaatgacgtcttgttgcttcaagaaacgttagattacattgtgtcgcttcaaacgcaagtaaatgttatgagaagtattgttgatgctgccgaggccgaaattgagagataaaggcgcgcc

SEQ ID NO: 652 - DNA, 2832 bp, Arabidopsis thaliana
agcatgtatttttatggagaagatccagagataattaaacaaacagtttagcaaaagattttgagagggagaaaaagggcgatcgattagggtttttgtgttttcgtcttagtatcgaagatgatcggagctgtgaactcggtggaggctgtgataacgtcaatccaaggtttatcggggagtccagaggatttatctgcacttcacgatcttttgagaggagctcaagactcgctccgagccgaaccaggtgttaatttctctactcttgaccagctcgacgcctcgaagcactctctcggttacctgtatttcctgtgagttttaacctattggtagattaggtttttgttactagtttgtgtatactttgaggctgattgatgattttggttattggaacttgatgtgtgtgattaggtcgaagtttaacaaggagaattgtctatgttattcgatttctgatctttgagttttttgtatggtttgattgttacagtgaggttcttacctgtggtccagtgtcgaaggagaaagctgcttatgagataccgataattgcacggttcatcaattcttgtgatgctgggcagattcgtttggcgagctataaatgtaatttactgacacttaatgagagcttatcttgtcttaatgtgttttcttttcttttttctttggggagatggatgatgttattatattgattttgcagttgtatctctttgtaagatattgaaagaccatgttatagcactgggagatccgttgcgaggagtagggccactgttaaacgctgttcagaagcttcaggtctcctccaagcgtttgactgcattgcatccagatgttcttcaactctgtttgcaggcgaaatcgtacaaatctggtttctccattcttagtgatgatatcgtggagattgaccagccaagagacttttttctctatagctattatgggtaagcaatttttcctcattgctatctgtttttttcctttgatcaatagatgtgtaaacacattaaatccatccctgttgggtttgttttatagtattttcttattctggtccttgattacctggacttttgataggggaatgatttgtattggactgaagagatttcagaaagcattagagcttctttacaatgtaaggcatttttattttttcttacgtgctttttatacattaaggactttcgttttagttttaactcaacctaagtacttgtatcaggttgtgactgctcctatgcatcaagtcaatgccatagctcttgaggcgtacaaaaagtacatattggtgtctctcattcacaatgggcaggtaaggctgtgttctttatattttactttctttgtttatctagttttcggtcatgggagcatattgcacgagtctgaatcaactgtatgtttttgagaaatgttggtttcacaattacatcctgtgtctgattttaatttcaagcattggttaatcttatgatgtttttcttataatcttgtttgattttacttgtgcagtttactaacactctccccaagtgtgcttctacagcagcacagaggagcttcaagaactataccggagtaagtttgaacccgatcattagttgtatttttcatgtttgaatggagtctggtccctttttcacttcagtccaaagatttcagttgttttgtactccataccagctaaatctattttcaggcttatgattttatcgttcacccttttctcagccttacattgaactgggtaattgttacaacgacgggaagattggtgaactagaggcattggttgtggccaggaatgcagaatttgaagaggtaaattgcctctaaacatttaccatagtttctgtaccaatattaaatattcatccccttccataacttgggcgaaatgctctttcaggataagaaccttggattagttaagcaagcagtgtcatccctttacaagcgtaacattctgagattgacacagaagtacttgaccctgtcgcttcaagatatagccaacatggtccaacttggtaatgctaaggaggcggaaatgcatgtgcttcagatggtattgtgtcccacacttgatttttggaagctagctttattagtttaactggtatgttggacaatatcatttttttctttacaaacctgcagatccaggatggtcagatacatgcccttatcaaccagaaagacgggatggtcagattcttggaggaccctgagcagtacaaatctagtgagatgattgagatcatggattctgttatacaaaggtatgtctacagaactaagtgttttgatatggtttttttttgggaaacattgcttgaatgttgaaactcgtaataaggagtgcataattagcacttggaatcaagttgatatggagatgactgttttgccaaaggaaagtagtagcatcaaacaagttatgtgttttgataaaaatttcaggactattggtctgtcgaagaatctcttagccatggatgagagcttatcatgtgaccctttatacttgggaaaggtaatttaataccatattccattagtcttctgtcctggaaacccatgtttctctgactaagccgtttgactactttttttcaggtaggaagggaaagacaaaggtacgactttggagacgatttcgatactgttcctcagaagttctccatgtaaacagcgaaagtcgagaagcaccaacaaaacttggctcaaagacaaccgtagtgtgaatcttgagaatgttacttttgatttctttgttcatttttgttggtttaaaaagtttcatatttt

SEQ ID NO: 653 - DNA, 3754 bp, Arabidopsis thaliana
cctccactcgcgcagcccaaccaaaaaaaaaggtgccctgattgtttactcacccaaagtttctctctttctctcttctccttctgctgttttccgcctcacaccattactctcccagaaatggcggcgacgacgactgctacttcattattctcatctcgtcttcacttccagaatcagaatcaaggttatgggtttccggcgaaaacccccaactccctgcaagtaaatcagatcatcgacgggaggaagatgaggaatgccactgttctctcagctgcttccactgataaagccatcaccactgctcaatctgtagctccgacggcttgtgataggtgcgtttctgttacaagtgaaaaacgaaagctttgctaatttcgtcaatgtggggtgagaaaaagaagaagaacacttttgtttcctctaattcgaactgggttcttcttctctctctcggcctcgcttccaatttctgcaattaattagcttcttattgtttatgatttgctcaacagtgttttgtttattcagtttctattggcattgcgtgactagtaatgttatagatactaaaaattcaagctgtgattttagtactactgtagatcttcccttttccagtattggaatcgaatatgtctggtcaacatcaaagaagattctgtttcctctttttctccacgaatagtgactttgttcaactgaatatacttgtatgaggatttgtttatctggtcaacaagttatttctcggattaagtgttctgcgtctctcttactaaaaatctcgccaattgatttgcagagtaaggaggcatacaatctcggtgtttgtgggcgatgagagcggtataataaatagaattgctggagtatttgctagaaggggatacaatattgagtcccttgccgtaggattgaatgaagacaaggctctgtttactatagttgttcttggaacagataaagtcttgcagcaagttgtagaacagcttaacaagctcgtcaatgtcatcaaggtttttatcttgttctctattgaatctagtcttggctataacttgctgctttgtttaagaatttttttgagcttatatatactttaatgaatcatgactattatcttatactcataatggtttgttcaggtggaagatctctccaaggagccccatgtagaacgtgagttaatgctcattaaacttaacgctgatccaagcacccgctcagaggtaaagaataattcatcttgcaaaaatattgggtggatgttcaaagttgttttttcgttatgcttgatgcagttgcattaaaaacatcaaggatatggatgaaaggaagcatttattctttatgattaattgagtcacagtacagagtcttttttatctttctatgattagtcaagtcgcattaaaatctcaaggatatagatgaatatagatgaaaagaggttttcttccttgttattaatggagtcacagcaaatgttttttacttcttacgattgatcagttcacattaaaatctcaaggatatagattagatgaagctatgttttaaaaaaactgtttttttatgaagtttccatgtactgcagatcatgtggttggtggatatctttagagcaaaaatcgtggatacctcagagcaatctctaacgattgaggtcagaccttttcttcagtttatatgtgctcagatcatatggtcaaaatggttccactaagtctcattttttattgtgtaggtaactggagaccctggaaaaatggttgcactaacgacaaacttagagaagtttggaataaaagaaattgcgagaacagggaaggtaatttttcactttcaaccactttttgctccaatccttcttaactgtcaacaacgtctggctctaaatgtcttcaaattacatcttctgtcttgaaaaagcttgtttgaacggttggactcacatgtatcattacttgtagccacttggagcctcttttttttttttttttttttttggtctattatgtcacacatacagacccgagttcctttggtgaatctcaggacactctaaatggcagagcacatgaaattcccagtttagctttaaatacatgttcacatcttacatgaaaactgattaaattacttaatctctaatgcggattttatcttcttttccatgtagttaatttctgcgtttcactgactataatgagtaattttaagaatcagcttttttaatcctaactgttgttgtatactactactctagattgctctgagacgggaaaagatgggagaaaccgctccgttttggagattttcagcggcatcatatccacatcttgtaaaggaatcatctcatgagactgttgcagagaaaacaaaactagcattgactggaaatggcaatgcatcatccggggtatagaaatattagctaatttattttctccctgtgtatatctaagcactagtagattgaacgagattaactgatactttattttagggtgacgtttatccagtggaaccctataacgatttcaaaccggtccttgacgctcattggggaatggtctacgatgaagatgtaagacacgtttctcggatactgcattcgttttataattttctttttgatccagtaaatccttcgaaattagaggtcaaagtgaactaaaactgtttacctttttgcagtcgagcggacttcggtcccacacattatctttacttgtggccaacgttcccggagttctcaatctaataactggagctatctctagaagaggttataacatccaggttattatgcacacacttttgcttttagcttcaccgatgtgatgcatactactcatttctctcaagagtatgtgaaagttgttgcttttattgctctagagtctagctgttggtcctgctgagaaagagggcttatctcggattacaacagttattcccggaactgatgaaaatatagataaattggttaggcagctccagaagttgattgatcttcaggaggtgagctaatgattcgaaaccgtagtgtactttggttttaattttaattttatatgtctaataacgtttccctttcattggcttttctagatccaaaatataacgcacatgccatttgcggagcgagaactgatgctcatcaaagtagctgctgatacttctgcaaggagagatgttttagatattgctcaagttttccgtgctaaagccattgatgtctctgatcatactatcacccttgaggtgctgatatcatatctccctgaactttacaacaaaaagctctcgtagctttctgatatttcaagcttgagatgagatctagtagctgatgaaatccgtcgatttgcaggttacaggggatctcagaaaaatgtctgcattacaaacgcagttagaggcctatggaatctgcgaggttaaaaaaaagtttcttgatttatctctaatctcttcacagacacggtcactgttgtgtctggcgattcttatggtttgtgttttatgaaaattgaaggtggctcggacaggaagagtggcattggtaagagaatctggagtggattcgacttatcttcgtggatactctcttcctttgtagttctagaggttagtaatctcttttataatcacagatgcatcatgcattgttgtcgttttacatcatcatcatctgtgttatatatcaaaggaaattcttgtgcagaggacttgccgcaag

SEQ ID NO: 654 - DNA, 1209 bp, Arabidopsis thaliana
ctatgggccccagtatcgatttctactatgacgtggcaccacttaaatcacaatatccgtattccctctctctctccctttctatctgagcttctctctcttactctctccagagcaacaatggctgcgactgcttcttctcttacaatcgcgtcgtcattctccgaaccacggactcagatccattcctcgagacgtttgaatctccctcttcaatattcaatcccgtacaaggtgttacggagtaggagtagaagattaggactcgtcgtcagttctgtttcagctcccaacgttgagctccgtactggacctgatgatctcatttctaccctcctctctaaggttgtgtaacgatttctgatttgtatacaccgatcttgaggatctgacttagtttggcgcatttatttgaaagtttgtgaattgtgaataggttgcgaatagtgatggaggtgtgacgctaagccctgagcagcacaaggaggtggcacaagtggccggagagcttcaaaagtactgtgtcaaggagcctgtcaaaaatcctctcatttttggaggtaaaagtgtaagaacctagctgccattgcttcttccttggatcaatatgtgaacttgtgggatttggtgcagattgggaagtggtgtactgttctagaccaacctctcctggtggaggctacagaagcgtgataggccgtctcttcttcaaaacgaaagagatgatacaagccatcgatgctcctgatatcgttaggaacaaagtttccattaatgcttttggttttctagacggagacgtctccttgacaggtgactattgcaaaattcacatatgcattcagtctcatcttctcccgtgtttaatcttctcacctttgtgtgatcttatctgtagggaagctgaaagcgttggacagtgagtgggtgcaggtgatatttgagcctccggaaatcaaggttggatctttggagttcaaatacgggttcgaaagcgaagtgaagcttcggatcacatacgttgatgagaaacttaggttgggattgggatctaaaggatcattgttcgtctttagaaggcgtcaataatatatacgtttctccctcgtgcatcaaccaatgcaaatcactacagaaaaaaaggaaacaacatatggggtcctgcgagagtatgatggtcaatatccacaatgctgtgtacacaaatgg

SEQ ID NO: 655 - DNA, 2125 bp, Arabidopsis thaliana
tacaaaaccgaaggattaccaaaatatccggtttagttttggtttgtttcggttagccttttttagctcaatttagagcttgaaactgagcaatcgccggagaaactctcactcacagttatggctacggcaatggaagagccaaggaagctgagaggccacaaatcaactgccacttgttgtatagcttctcgtgaccggcctggaattgttctcacttccggcgaggtttcttaatctctaattcaaacctcttttttccgatgaatttaggtttcgttattgtagttacttcgcaagattcatagttttccgatcatacgattataggatggttgcatttgctggtttgatttgcgatgtaaagatgttcaattcatcatcgatgttggaacagaaccagtttcatctctttgtttcaagacaggttttgtctctttgtgttttgtctgtttctctctctttcaatttcttctctttgttgcaatttggtgataacttttatttgatttttcaggtaatgagaacattctctatgcttcttgtggaaacgaaatcaagtctttcgatgttcatacggtaatttaaaatgttcaaactttgattaactaactataaccatatccttcacttagttttaaagcttctctctttatgcaatttcatagctaagtgctacttcttggaagccattagagagttacaattacaacaaagatgaagttaaccaggtagagatactaaaaactcgacttttcgaaaaagttatcatatttacctatgacattgatgttgacatcttttgatttgttaaaggtagtatgtaacggaaggtcgtcttttcttgcttctgcagatgattccggcgatgttaaggtacactcaatagttgttcttaatacttaaaactcttaaagattacataaacatgaattttggtgggacggttctcggtttgattagtttgcttgtacacagatcatcgaccttggtcagaaatgcctttataaaacccttagagctggtcacacaagtgtatccttacttcgttttttttacccattctcgtctatgaaactctactagcctcgaaaaaatgtctcaaatcaacaccttaatgagacatataagatatgtagttctgtacaattcattccatggagaccttgggaaggtaactaatatcttattgtgatttgttattatatatacacatctcttctaaagtgtctaatttctttcagttataactggtggacttgattcaaagcttgttttatgggatttctcaaaaggtcgctcgcaaaagattatagactttggtaaagactatgccactaattctggtttctttagccatatatatatgcaacaaatctgattttgcaagtcatttctgtaatctttcaggatctgatacaaataataactcgggacaatgcctaaaccctgcgtttgttcactcaatagcaataccggaaatggacatggttgataagttagacaagatatgtgcggttgctagaggtgatggaattgtcaatttgatcaatatcgaatcagaactttcccgaaaaggaacatcatcaaaaggaagtagcagcagcagcagcaacaatgtggtcaaaagggtttgtttagactactctgttggtggacacaattctgctgtttcttgtgtagccttttctctgtttcaggagaaaggtagattcttaatctctggtggtaatgataaaacagtcaaaatctgggattgctttaaatgtcttgatccaaacaacaacaacaataacagtgatctcctccatttgaatattaacctaagcaagaaggtaactaaaagctcacattgttctttttgctcttttctcttttgtctgattctgaacatttgttggtgtttcttaaacaggtgaattggctttgcacgaatcaatctgattctgagaatcttgtagtgtgtgacacaacaagagtagttaaggtttactcaatctcttaaataggcctgatgggtccataaaaatagtctaaaagcttcatcctttttgacattgttattagtctaagagattcatttttatttttgacattagaatggttgcttgatctacaagttagt

SEQ ID NO: 656 - DNA, 1221 bp, Arabidopsis thaliana
tgtctgagcctaaaccaaaaaatctttcatttatgctttgattatcatagatcccaatttatgcgtttcttttattgcttttcaatttgtaatgcgagttttgctttattttgtccagccatggaagaagcagatcagttatgtttagctgctaaatccggcgacttgaaaaaggttcaaactttaatttactccggcgccgacgttactcactttgataacgacggtttaacgccgttaatgcacgccgctaaaatcggaaacgcagagatagtaacggcgttactcgaatccggagctccatggaacgcattatctccatcaaatctctcagcaggagatttcgccatggaagcaggacatcaagaaactttcgatcttcttctcaaaaccgggatccaatcagagctaatcttaggaacaatcgcaagaaaccaaacaaagaacgaatattctaatcaagaatatcttcaagacagagttagtttcagtgaagacaagttaatggatagtgaaagcaaaggtgtgatgatggcttgggaaaaaccattaatggaagctcacgctaaagctatttgtctcaacggtggtcacattcttaacgttggtttcggtatgggacttgtcgatacagcgattcaacgatacaatccggttaaacacacgatcattgaagctcatcctgaagtttataagcgtatgattgaatctggttggggagagaaagagaatgtgaagattgtttttggaagatggcaagatgttcttgataagcttgatgataattcttttgatgggatcttttttgatacttatggtgagtattatgaagatttaagagagtttcatcagcatcttccgaggctgttgaagcctgatggtgtttattcgtatttcaatgggttttgtggaagcaacgcgttttttcatgttgtgtattgcaatttggtgactttggagattgagaatttagggtttagcactcagttgattccattgccggttaaggattgtcttggggatgaagtttgggaaggtgtcaagcaaaagtattggcagcttgatacttattatctccctgtttgtcagtttagtgactgaagaagttttatgataccagcaattttgcgatattgtaatttttcttactcataaaaagtagattttttatccatttgaaaatagtcatagtcatccaataagaagaaaagaacagtaata

SEQ ID NO: 657 - DNA, 1445 bp, Arabidopsis thaliana
aaaaagacaacatctgcttcctctgcaattatgaagaactaatgatatatacaaacaattcttaatacataaaaatcttctacaaatattgatttaagaagctctaaaatcatacaagtcatggatgaagaagcagcgattgatcgtttaccattagaccttcttgcatatatattttcgttggctacttctttcaccgttttggcccagtaagtgttttcattgatgatccttacaagtttgatcctctctttttttgattaaataaatcattgttgtgagattgaagtttttggtgaattttggggtttttagggcaagtggtgtttgcaagaaatggagaaaagctgtaaatcaatcgatggcgagaagagaaactctgagctttgctggttggaaaatggacgatgattccacttctcgtctcgttcatcttgctttcaacctcaaagaactcgacatgtaatctctctctctttctctctgttttgctctttgtttgtttcttgtactatgatcgtacttgatttgtccttcaatggcggattaagagtaaacaagattggtgggatagtggagatttgctgaattttttggtcaagtttccaactttacctttagggtgtttgagataggatattgacttggtcaaaaaacagaacagaactataaactctgtttttttcttctttcatatttgaagatctcgaagcagatggggttgtcatataactgataatggtctttaccaaatagcttctgcaagatgtgtatccaatttaaactctgtctctttatggggcatgaccgccattactgattctggtgttgttcaactggtaaaatctaacaccgttttttgtgcactggaatcttgaagattccttttttgttttaatcatttcagagaatcttgattttgatttgacagatttcaagaacttcctcactgcaacacctaaacataggaggaacatttataaccgatgagtctcttttcgcaattgcagaacgctgccatcagcttaaggtaacaacaatcatctaaccaaataattctctctagattcatgagaatcacgctttcgaaattggaatcctttatgcagacaatcggaatgtggtgttgccgtcatgtgacagagagaggccttcttgttcttgtaaacaaatgcagaaaactcgaatccatcaacttatggggaactagagttcctgtagattgcttcattgctttacttaccatcagtcctgctcttcagatcaaacccatggaattgcttctcaatgctcagaatccaccaccgttgctgcatgctgtctagtgttgctcatcatatttcttgtttgttgtgtacatagtaattcatacaattgaatctgcatatatcttatgtgttctctcatcaatcaacaacatatatatataaatattcagtaaagtt

SEQ ID NO: 658 - DNA, 1428 bp, Arabidopsis thaliana
tttgatatatgtatggctcctacgcctttacttacttttccctctcattcattacacttcacgcctcctttatctctctttaataactccaaaaaaaaacaaaaacaaaaaaagagagagatggaaaaaaaactgaaacggcgtgaatcaatgtcaaccaccgccgcagaatcaccgccggcgaaacgaagaagaacagtcaccggaaatgaaaactccgctttaatcgaaggacttcccgatcacatctcagagatctgtctgtctctcgttcaccgtccgtcgttactctccgccgtgtgtacacggtggcgccgtcttctttactcgccggaatttccttcgtttccgtcactctacgctcttttcgtcgattcaacatcggatacgggtcgggtcaacccgtcagtccggtttatgtgtttcaacccggtttcttcaaaatggtatccgcttcctcctccaccacctgacccgcctcttcaccggattctttaccgtcatccgtcgtttatctcctttaatttaccgattcaatgcgtctccgccgccggaaaactcattctcatcgccggaagtaaccaacaactctctccggcgatctctcacccgttaattttcgatccaatttcgtcatcctggagctccggtcctcgaatcggatctccaagacggtggtgcgccaccggagcttgcgacggagctatctacatcgcaagcggaattagttctcagttctcatcaaccgtcgcgaaatctgtcgagaaattagatctaaccgaacaaaaccggaataaccaccggtttaattgggagaaattgagagatatgagagatttacggtttagtcgagaagctatagacgctgttggatatagaagaaagcttttaatggtaaatgttaaaggagacgcggttaaagaaggagctatatacgacgtcgttaaagatgattgggaacctatgccggaggagatgttggttggatggagaggcccggttgcggcgatggaggaggagattctttattcggtggatgagaggagagggacagtgagaaagtacgatgatgagaagagagagtggagagaagtggttgtggttgaaggtggagaagagatgcttaaaggagctacgcaagtaacggcggattccggtaaactttgtgttgttactggtgatgggaaaattgttgtggtggatgttgcggcggagccggcgaagatttggaatgttgagattcctgatggacttgaaccggtttcggttcatgttttaccaagaatgagtcaaccgaatttttgctgacgtattttttttgtgatattattattattattattattattcttttcctttagtatacggaactttttttattttctgttttcccgtttttctggtggaaaagtgtcatcttgtcgttat

SEQ ID NO: 659 - DNA, 1554 bp, Arabidopsis thaliana
atgccgtgaatgagttctcatcgattctcaattttgttgctcctactgaatccttttgtcgattgatgtaagatgtgatctctggttttaacttgttatattcagggaagagggcagattatgaataatgatacatcaaaaaagctgggaactttggtttctgatgatggaccagtgaatgtatatgtatgggacatggacgagactcttatcttacttagatctctgttaaatggaacttatgctgagtcttttaatggctccaaagatgttaaaagaggtgtagagattgggaggatgtgggagaaacacatacttaagatctgtgacgattttttcttctacgagcaagtaagtcttctcttaacgataagttcagaacgggaatgatgagatgccctcgtaaactctgtcacctacaaagcattagtcttgtgttctttgcaggttgaggaatgcaatgagccatttcttgattcattgagacagtatgatgatggaaaggatctttctcggtatgagttcaaacaagacgactttagtactcctactgatgacttgaacaagaggaaacttgcgtacaggcatcgagctgttgcggagagatacgaaaaggtactgatatgtttttacatgttttttgttgctgatgttatatgactcaagtacaaatgtcatctctttataattgcagggtttgtgtccattcattgacagcgaatcgatgagtgggttggatgagttgtataatgtgactgatgaatacacagaccggtggctttcttcgggtaaatgtcgaattgtctgcttcttctggttattttctttatcgcgtccactgcttagtatgacattgtattaattgcagcaagggctttcttggagcagtgttcatgtgtggaagagtctagtgatggaacaagtgcaatcgaacaaagctctcaggatatacatattctagtgacttccggggccctcataccgagcctcgtgaaatgcctgcttttccggctagatacattcctaagacatgaaaatggtaagctcggagacatctccttcaatgggatatcttagcttcggattcacatagttgttgctactctgcgagctccgtcatgcatttgcatttctatgttaactacatcatttaactctttttgcctttcttcagtgtacagttcaatagatgtggggaagctccaatgtttcaaatggatcaaggagcgtttcaaccacccaaaattcagattctgtgcgatcggggacggatgggaagagtgtgcagccgcacaagccttgcaatggccattcgttaagatcgatttgcaaccggatagctcccacagattccctggcttaacacctaagactgtaagctactactttgctgctgtatatgggaactctgatgctgattccagcaaagagtaactctcaaaaagctttttctttgtaaaatatgcaagtaaacccaacaaaagccatggcttttcatattcaaacccaacattgttcatagacttgagttaagtcagcatttggtatttataa

SEQ ID NO: 660 - DNA, 2170 bp, Saccharomyces cerevisiae
ttcttgtttgttgattaacccttaattaatccgggcgcgcctgatttatcacaagtttgtacaaaaaagcaggctcctgcaggaccagtatcggtaaaggggtgtgtgtttggtgatttataaaggagaagggcatgaggagagagaggcaaaggatgatgagtttcgaggacaaggacaaggacgaccttgacaatagtaatagtaataacagcagtgaaatgacagatacggcgatgatgccaccattaaagagattgcttattacgggcagtagcgatgatttggcacaaggatcatcgggtaagaagaagatgacgatggcgacgaggtcgccatcgtcatcacccgatttggcgacaaacgacagcggcactagggtacagccattgccagaatataacttcaccaagttctgctatcggcataacccggacattcagttctcaccaactcatacagcgtgctacaagcaggatttgaaacgaacgcaagagattaatgctaatatcgcgaagctacccctgcaggagcaatccgacatccaccacattatctcgaagtacagcaattccaatgacaagatacggaagctgattctggatgggatcctatcgacgagttgcttcccacagctttcctacatttcgtcactcgttacacacatgatcaagatcgacttcatcagcattctgccgcaggagctgtcgctgaagatcttgagttatctggattgccaatctctttgcaacgccacgagagtgtgccgcaagtggcagaagctcgcggatgacgacagggtatggtaccacatgtgcgagcagcacatagacaggaaatgtcccaactgtggctgggggctgcctcttttgcacatgaaacgtgcgcggatacaacagaatagtacaggatctagcagcaacgcagatatccagacgcaaactacgcgaccttggaaagtcatctacagagaacggttcaaagtggagtcaaactggagaaagggccactgcaggattcaggaattcaagggccacatggatggtgtgttaacgctccagtttaactacaggcttttgttcacaggctcgtacgactccaccataggtatatgggacttattcacggggaagctaatacgaaggctcagcggccattcggacggcgtcaagacattatattttgacgatagaaagctgattacgggctcgctcgacaagacgatccgtgtttggaactacataaccggtgaatgcatttccacgtatcgaggccactcggatagcgttctgagcgtagattcataccagaaggttatcgtttccggcagtgctgacaagacggtcaaggtatggcacgtggagtccaggacatgctacaccttgagaggccacacggaatgggttaattgcgtcaaattgcatccgaaaagcttttcatgttttagttgcagtgacgataccacaatccgaatgtgggatatcaggaccaattcatgcctaaaagtgttcaggggtcatgtagggcaggtgcaaaagatcataccgcttaccattaaggatgtagagaatctagccaccgacaacacttctgatggcagctctccgcaggatgacccaacaatgactgatggtgcagacgaatcagacacaccgtcgaacgagcaagaaactgtcttagatgaaaacataccttatccaacacatctactatcttgcggactggataacacaatcaaactatgggacgtcaaaaccggtaaatgcataagaacacagtttgggcacgtggaaggtgtttgggacatcgccgctgacaacttcagaattataagtggttctcacgacggaagcattaaggtctgggacttgcaaagcgggaagtgtatgcacacgttcaacggtcgaagactacaaagagaaactcagcacacacaaacacaatccttgggtgataaagtcgcccctatcgcttgtgtttgtattggagattcagaatgctttagtggtgatgaatttgggtgcgtaaaaatgtacaaattcgatctcaatgattaggacctgtgtgtggtcttttcttggtcaaaacatccgtagtaccctcgagacccagctttcttgtacaaagtggtgataaattggagctctgcagagctttcgttcgtatcatc

SEQ ID NO: 661 - DNA, 750 bp, Arabidopsis thaliana
atgaagttcaacgtcgccaatccgaccaccgggtgtcaaaagaaactcgagatcgatgacgatcaaaaactccgcgcctttttcgacaagaggctctctcaggaagttagcggagatgctctaggcgaggaattcaagggatacgtattcaagatcatgggaggatgtgacaagcaaggtttcccaatgaaacaaggagttctcactccagggcgtgtccgtcttttgcttcaccgaggtactccttgttttagaggacacggaaggaggactggagagaggagacgaaagtctgtccgtggttgcattgtgagccctgacctgtctgttcttaacttggtcattgtgaagaagggtgtaagtgatcttcccgggcttaccgacactgagaagccaagaatgagaggtcccaagagggcatcaaagatccgcaagttgtttaaccttggaaaagaggatgatgtgaggaagtacgttaacacttaccgccgtaccttcacaaacaagaagggcaagaaggttagcaaggctcctaagatccagaggcttgtgactccattgaccctccagaggaagagagctagaattgctgacaagaagaagagaatcgccaaggctaactctgatgcagctgattaccagaagcttcttgcctccagactaaaggagcagcgtgatcgccgtagtgaaagtttggccaagaagaggtctagactctcttctgctcctgctaaacccgttgctgcttaa

SEQ ID NO: 662 - DNA, 768 bp, Zea mays
ttcttgtttgttgattaacccttaattaatccgggcgcgcctgatttatcacaagtttgtacaaaaaagcaggctcctgcaggaccatggctcggcagcaaagcgtgcaggccttgtgtgtgctggcggcgcttctcttcgccgcctccctgccgtcgccggccgccgcgggggtgcacctctcctcgctgcccaaagcgctcgacgtcaccacctccgccaaacccggccaagtcctgcacgccggcgtggactcgctgacggtgacgtggagcctgaacgccacggagccggccggcgccgacgccgggtacaagggcgtgaaggtgaagctgtgctacgcgccggcgagccagaaggaccgcgggtggcgcaagtccgaggacgacatcagcaaggacaaggcgtgccagttcaaggtcaccgagcaggcgtacgcggcggcggcgcccggcagcttccagtacgccgtcgcccgcgacgtcccctcgggctcctactacctgcgcgccttcgccacggacgcgtcgggcgccgaggtggcctacggccagacggcgcccaccgccgccttcgacgtcgccggcatcaccggcatccacgcctctctcaagatcgccgccggcgtcttctcggccttctccgtcgtcgcgctcgccttcttcttcgtcatcgagacccgcaagaagaacaagtagctcgagacccagctttcttgtacaaagtggtgataaattggagctctgcagagctttcgttcgtatcatc

SEQ ID NO: 663 - DNA, 1828 bp, Nitrosomonas europaea
ttcttgtttgttgattaacccttaattaatccgggcgcgcctgatttatcacaagtttgtacaaaaaagcaggctcctgcaggaccatgtccacactgacccgatcccctgcctggctggctctgagtgcacatcagacggaaattgccaaccgccctctgcgcacgctgtttgatgaagatccgcaacgattcgacaaattctcactgcaattcaaagatctgctgctcgactacagcaagcaacctgtcgatgcaacgaccatccgtcttctgctggcactggcggaacagcaaaagctggtagactggcttggccgcatggctaatggtgaaaaaatcaatttcaccgagagccgggcggcactgcacattgccttgcgtgccaattcaccggttttcatggatggcgtggatgtcactcaggaggtcagacgggtattgcggcaaatcgaacagtttgtccagaaaatccacaaccagtcgcaccggggttactccggcctgccgattaccgatgtcgtcaatatcgggataggaggctctgatctggggccggtcatggtgaccgaagcactcaagccgtaccacttgccgcagcttcggactcatttcgtttccaacctcgacggcgctcatctttctgacacgctgcaacacatcaatcctgccaccactctgttcgtcatcgcttccaaaacgtttactacccaggaaaccctggccaatgcccattccgcccggaaatggtttctggcaggaggaggcagtaaacaggatattgcagcacacttcgtcgccgtttctaccaaccgtgaggcagtcagccagttcgggatcgatccggacaatatgtttgaattctgggattgggtaggcgggcgctattcgttatggtcagccatcggcctgccgattgcgctggcagtgggaatggaacatttccactcactgctggctggtgcgcaagcaatggatgatcattttctgactgctcccttcgagcagaatctgccagtcatattgggcctgattggtatctggcagatcaatttctttcatatcaccagccaggccatcctgccttacgatcagtccatgcatcgttttccggcttatctgcaacaactggagatggaaagcaacggcaagcgtgtcacccggaacggagaagctgtcgattacagtacaggcataatcatctggggcgagcccggcaccaatggccagcatgccttttatcaactgctgcatcagggtacacaaaagttcactgccgattttctggcaccgtgccgctgccatcacccgttatccgagcatcatcccatgctgctggcgaattttttcgcacaaaccgaagcactcatgcgcggaaaaactgaacaggaagtccggtccgagctggcaaaccagaatttatccgctgatcttgtggaacacctgcttcctcaccgtgttttcccgggcaaccacgccacgacctcgatcctgttcaaaaaactcgatccggcaacgctgggtatgctgatcgcactgtacgaacacaaagtatttgtacaaagtgtcatctgggaaatcaatccgttcgatcagtggggagtagagctcggcaaacaactggccggcaagattctggctgaattggccctggataaaccggtaaccggacacgatgcgtccaccaacggcctgatcaatttttacagagcacagcaataaagaaacgggaccaatctgaaaaccatgtcttcatctcctcgagacccagctttcttgtacaaagtggtgataaattggagctctgcagagctttcgttcgtatcatc

SEQ ID NO: 664 - DNA, 1213 bp, Xylella fastidiosa
ttcttgtttgttgattaacccttaattaatccgggcgcgcctgatttatcacaagtttgtacaaaaaagcaggctcctgcaggaccatgacgcaaacaattacggtgatccgcggtgatggtataggcccggaaatcatggatgccaccctgtcggtattaaacgcgttacaagcgaatctgaattacgaattcgcagatgcaggcttgagcgcacttgaaaaacacggagacttgctaccggaatccaccctgaattcaatcagcaagaacaaaatcgcgctaaaaagcccgctcacaaccccggtaggtgaaggtttcagctcgatcaatgtcgccctgcgacgtaaattcgacttatacgccaacgttcgccccgcaaaatctttcccaaataccgagtcacgctttagcgataacgtagacctgatcaccgtacgggaaaataccgagggtgcctacctgagcgagggtcaaaccatctctcctgacggagaagttgccacttcaagcgcacgagtgacccgtaaagggtcggaacgtatcgtccgttacgcattcgacttagcccgaacaacgggccgcaaaaaggtcaccgcagtacacaaagccaacatcattaaatcaacctctggactatttctgaaaaccgcccgagacgtcgcaagccagtgcccagaaatcgatttccaagaaatgatcgtcgacaacacttgcatgcaacttgtgatgcgcccagaacaattcgacatcattgtcaccacaaacttgttcggtgacatcctctcagatttgtgcgcaggcttggtcggcggtttaggcttggctccgggcgccaacattggtaatgaacaagccatcttcgaagccgtacatggctcggctccagacatcgctggacaaggtaaagccaatccatgcgcgctgctgctaggtgctgtacaaatgctggatcatatcggtcaaccacaaaacgccgaacgcctacgcaacgcaatcgtggccacactgaatgccaaagactcgctgactcccgatctggggggtaacggcaacaccatgggattcgccaaggcaattgccagcagactctaaaacaacgcgttagtaacctcacatccagtaaaggagaaaaactgatccactcgagacccagctttcttgtacaaagtggtgataaattggagctctgcagagctttcgttcgtatcatc

SEQ ID NO: 665 - DNA, 1560 bp, Synechocystis sp. PCC 6803
ttcttgtttgttgattaacccttaattaatccgggcgcgcctgatttatcacaagtttgtacaaaaaagcaggctcctgcaggaccatgatgcataaaaaaattgacctcaaccagctcagtgaagcggaaagcctactgacccccacctatgcggcccggggcctagccaattctgtcagtaaatatgaaatgccagaaacggaaatgctaccggcgatcgcctataacctcatccacgatgaactggggctagatggcaattcccgattaaacctggccacctttgtcaccacttggatggagccggaagctaggcaactgatggcggataccttcgacaaaaacatgatcgataaggatgaatatccccaaacggcggaaattgagttgcgttgcgtcaatattttgtcccgactctggaatgctccggccagtgcggaagccaccggctgttccaccattggttctagtgaagcggccatgttgggggggatggccatgaagtggaaatggcggcaacgacgacaagcggcagggaaaccaggcgatcgcccgaatttggttatgggcattaacgtccaggtttgttgggaaaagttttgtcgttactgggaagtggaaccccgctttgtccccatggaaggcgatcggtaccacatcagcccggaagaagcagttaagctaattgacgaaaataccatcggtgtaattggtattttaggtagcacctttgacggcagttatgaacccattgaagcgttgaacgatgccctggaaactttaaatcaaagaactggttggcaggtgcctctgcacatagatgccgccagcggtggttttattgctccctttttagatccagatttgcgttgggattttcgtttaccttgggtgaaatccatcaacacctctggccacaaatacggtttagtttatccgggggtaggttggatcatttggcgggataaggaagaattaccggaagaattaattttccattgcaactatttggggggagatttacccaactttgccctcaacttttcccgccccggcaatcaggtagtggcccagtattataactttctccgcttaggcaaagaaggttaccgcaaaatccaacagacttgtcgagatacggctctgtatctatctggcaaaattgcccaattaggcccttttgaattgctcaccgacggtggggatatcccggtttttgcctggagattaaaggacgaagtattggccaacacttgttataccctgtacgacatggccgacaaattgcgggaacggggctggttggtgcccgcctatcgcatgcccaaaaaccgtgaagatttggtggtgcaacgcattgtcgtgaaagagggttttagtcgggatatggcggaccttttgttagcggacatggaaagggcgatcgcctattttgccagccaaccggaccacaaaccgaagcaggaaggttcccactttagccattagctcgagacccagctttcttgtacaaagtggtgataaattggagctctgcagagctttcgttcgtatcatc

SEQ ID NO: 666 - DNA, 2063 bp, Synechocystis sp. PCC 6803
ttcttgtttgttgattaacccttaattaatccgggcgcgcctgatttatcacaagtttgtacaaaaaagcaggctcctgcaggaccatggtaaccacccccaccgctgccccccgtaaaccgtccaaggtagaaggcatcaaggaaagaagcaattatttacgggaacccctggccaccgaactgttgaatgatgctaactattttacggacgatgccgtccaaattctgaaattccacggttcctaccaacaggacaatcgggacaatcgggttaaggggcaagaaaaggattatcagtttatgctccgcacccgcaatccggggggattgattccggcccaactctacaccgccctagatgatctgtccaaaacccacggtaaccaaactctccgggtgaccaccagacaaggtttgcaaatccacggcattgtcaaaaaagacctgaaaatggcgatcgccacggtggtgaataatttggggtccacgttgggagcctgtggcgacattaaccgtaacgtgatggctccggcggcacccttccgagataaaccggaatatggttatgcctgggactatgccaataaggtggcggatctactcagcccccagagcggtgcctattacgaaatttggctcgatggggaaaaggtcattagtggggaggaagccccggaagttaaagcggcccggcaaaaggatctcaatggcactaacctgaatgaccccaaggaaccgatttacggccaacagttcatgccccggaaattcaaaattagcgtcaccgtgccgggggacaattccattgacgtttacacccacgatattagtttggtggtaatcaccgatcgccatggggagctacggggttttaatgtattggctggcggtggtttgggacgtacccacaataaagaggaaacctttgcccgggccgctgaccccattggttatgtgagcaaagacgatgtctatgatctagtcaaagccattgtggccacccaacgggattacggcgatcgccataaccgtcgccatgcccggatgaaatatttgttggcggactggggggtggaaaaattccgcaaacaagtggaaacctacatgggtaaaccgttccaatctttcaaacctctgccagcctggcgttaccaagattacctcggttggcacgaacagggggatggcaagctctttttcggtttgtcggtggaaaatggccgcatcaaagacgagggggattttcagcttaaaaccgccctgcgcaaggtagtggaccaattccaattgcccctgcgcctcaccgccaaccacaatatcctgctctacgacatcaatgcccaggataaagcggcgatcgagcaaattttccaacagcacggcgtagtcaccgacccagaggcgatcgacaccctagtccgttactccatggcttgccccgccctgcccacctgtggcctagcagtcaccgagtcggaaagaattatgcccagtgttaacgcccgtctgcgggatttgttgaacagtctggatttacccaatgaaagtatcgtcacccgcatgaccggttgccccaacggttgtgcccggccctacatggcggaaattggttttgttggtagtgcccccaacagttaccaagtgtggctggggggaagtccgaaccaggaacgtttagcggcagcctatacggaaaaaatgcccctggaacagctagaaagcctttttgaacctttatttgtgtacttcaagcagagccgtaaaggtaaggaaagttttggagacttttgccatcgagtgggcttcactgccctacgggaatttagccatggttacacagcaccggccaagggcggtaaaaaccgcaaaaaccaacggcgggtcagcctgtccgatgaaatgtatgcccagcttaaggcccggtctgagcgggataattgccccatgaatcagattgtgcagcaagccctcaccgcttacctgggcaaataactcgagacccagcttcttgtacaaagtggtgataaattggagctctgcagagctttcgttcgtatcatc

SEQ ID NO: 667 - DNA, 1593 bp, Chloroflexus aurantiacus
ttcttgtttgttgattaacccttaattaatccgggcgcgcctgatttatcacaagtttgtacaaaaaagcaggctcctgcaggaccatggggaggtatatgcgtcgcacaaagattgttgccactctagggccggcgaccagcacccctgaacggatcgccggactgattcgggccggtatgaacgtcgctcggctcaacttctcgcatggtacccatgccgagcacgcagcacggattgcaatggtgcgacgggcagcggcggaggctggacggcatgtagcgattctgcaggacttgcaaggcccgaagattcgtaccgggccacttgaaaatgggcaaccggttgaactggttgccggacagcggtttgtgattacgactgagccgatcgttggcgatgcgcatcgagtcagtaccacctatcgtgcgttgccactcgatgttcgtccgcgggatcggattcttctctcagatggcctgatcgagctggttgtgaccggccataccgacaccgaagtggagacggaagtcgttcacggtggtcggctccgcgaacatcaagggattaacctgccgggagtgcgggtcagtgctccggctgcaaccgagaaagacctggccgatctggcgtttggtctcgaacagggagtagattatgtcgcgctctcgtttgttcggcgcgccagtgatgtgcgtgaggtgaaagagtttatccggcgggcaggtaaacaaacaccggtcatcgccaagatcgagcgtccggaggcgcttgacgtgttgccggagattctggctgaagctgacgggatcatggtggcgcgtggtgatctgggcgtcgagatgccaccggagcgggtgccgattgtgcagaaacagattattgccgccgccaatcaggcgctgcttccggtcattacggcgacccagatgctcgagtcgatgatccacaacccgcgaccgacacgggctgaggccagtgatgtggcgaatgccatcattgacggcactgatgccgttatgctcagtggcgaaaccgctgctggggcctatccgattgaagcggtgcagatgatggcattaattgctgatgcggttgaagcatcgtataccggtggccagcactcgacaacaccgcggtggtcgattgcgccggcgcaatcgacgccgcgtgccattgccgcagcagcatgcacaatcgccaactcattgccggtacgtttcattgtcgttctcacccaaagcggtgcgagtgcccgtctggtatcgcactaccggcctgaagtgccaattctggcattctgtcccagtgaagagaccgcccgccgtaccagtctctactggggtgtcacccccattgtgatcgaggcgcgtgatcgcctcgacgaacttgaacaacagattgtgcgcatgatgcgcgaaaccggaatggttcgaaaaggcgatttgatcgtactgagcggtggccatccggtttaccgctacgggccgaccaatttcctaaaggtgatcacgatagagtagctcgagacccagctttcttgtacaaagtggtgataaattggagctctgcagagctttcgttcgtatcatc

SEQ ID NO: 668 - DNA, 861 bp, Synechocystis sp. PCC 6803
ttcttgtttgttgattaacccttaattaatccgggcgcgcctgatttatcacaagtttgtacaaaaaagcaggctcctgcaggaccatggctgagctagatgcggccaacttaatgaaacaggcagtgggtaaagccgccgctgaccgagttaaatccaacaccattgttggtttgggtaccggttccaccaccgcctacgccctggaattcattggcgatcgcctgaaaaaaggagaattggaaaatgtagtgggcattcccacttcctttcaggcggaagtattggcccgtaaatatggcattcccctaaccacgttggatgtggcggatcgcattgacattgccatcgatggagcggacgaagttgacccccagaaaaatttgatcaaagggggaggggccgcccacaccagggaaaaaattgttgacgccttggcggaaacttttctggtggtggtagacagtggcaaattggtggataaattgggttccacttttttactgccggtggaagtgattcccatggccctaactcctgtaatgcgagctttagctaaattaggtggtaaaccagaactacgcatgggggtgaaaaaagctggccccgttgtcactgaccaaggtaacctcgtcattgacgttaaatttgatgccattaccaacccagcggagttggaaaaaaccattaacaatctccccggtgtgttagaaaacggcctatttgtgggggtagcggacgtaattttggtaggggaaattattgacggccaacccacggtgcgggaattctagctcgagacccagctttcttgtacaaagtggtgataaattggagctctgcagagctttcgttcgtatc

SEQ ID NO: 669 - DNA, 1359 bp, Arabidopsis thaliana
ttttaaccgattaaagcagaatcagagaagaatttaaccggcttttggtttttggctaaagccctcaatttgattgattcactcagttgttctctagtctcctcctcctaatagctctcgatgtctaacgccgacgaaccaccgcagaaaaccaaccaaccaccgtcgtcttcattgacgccgccgtcattgttctcactcccggtggacatcgtattgaacatcttagccttggtaccaaaacgatattacccaatcctctgttgcgtctccaagtccttgcggagtctaattcgctcgccggagattcacaagacgcgatctttacacggaaaggactctctttatctatgcttctcgaccagaactacatacccgaaccggaaccggacgacttttcactggttcactctccggaggaatgataacaagatgaatacgactgagaatgtcttcgtctccatcgatgttccttatcgtcccgggcatgcttcttaccctctttccaatatcgcaattgatacagagatttactgcattcccggatataattttccctcatcatcaatcgtatggatctttgacacccaatctggacagtggcgtcaaggacctagtatgcaagtggagcgattatcagctaccgtaggactagtcggtggtaagatctatgtgatcggaggcaacagaggcgaagagatcctagcggaagtatttgacttaaagacacaaacttgggaagcagcgccgattcctaaggcaaaggatagaaacgaatggttcacgcatgcaagtgtttcacttgataggaaggtttatgctttaaattcgagggaatacatgaattcttacgatactagagatggttcttatcaaagatatacgatacctgaagataattggtggaagacaggaaaatgcgtgattgacaatgtgctcttcgtttacttccttagatttgggttaatgtggtatgactctgagctgatgttgtggagagtggtttatggtttagatcttgacaaagctcgatgcattgggatcggggaatactacggaaagttggcgtttatatggggaaaaccaagtaatgttagtgaaagcaaagagatttggtgtagaatgattggcttgcttaggagtgaagtaggaattcatggaactgaagaaccgtctcaacttctcagaatcgttcctaacaactatagtttgcgccattgtctgtctctttcgggttaaacttaatcaagagatatattgttgacgttagatgtttatttagtctttctttagtcattatgatcaatatcactacaatgtgtttacaagattcattgctgttgcggtttcagcatcttg

SEQ ID NO: 670 - DNA, 1867 bp, Arabidopsis thaliana
tctctctctctctgttcccaaggagatgaaaagcttcaatctcaaaacatagcagctctctcaataaaccaaacccaaatgcaagctgtgtagagagaaacggagtgaggaaggaaggagatgggaggggtgacgtcatcggtggcggcgaagtttgccttcttcccgccgagtccaccgtcttacaaggtggtgaccgacgagctcaccggactgttgcttctcagccctttcccccaccgcgaaaacgtagaaatcgtaaagcttcggaccaggagaggcacagagatcgtgggcatgtacgtgaggcatccgatggctacctccacgctcctctactcccatggcaacgccgccgatctgggacagatgtatgagctcttcattgagcttagcatccatctcaaggttaatcttatggggtctgtttttctttctctccctttgtaattcgattgattttattattatgatgctgatttaaaaatgttatctttgtatgcttcttttgattgatttggtataggatttgccctgttttgattctcacgtttctagctctgtttctagtatttgctctgtttatgtttggagtgtttattcaccaccccaataaaaaaggaaacttgggctaggatctgcttggaatcaatcagtctttgatattattggttgtgatgttgcagatacgattactccgggtatggacaatctactggaaaggtttgtcctttaccccatcaatctgattggtctgatgatccattatgagttttaggaccaactctcaaaaatctttctttctcttaaatgattgattgtagccgagtgagcataacacgtatgctgatatcgaagctgtttataagtgtcttgaagaaacctttggctctaagcaggaaggtgtcatcctctacggccaatctgtaggcagcggacctacgttagatcttgcttcccggttgcctcaacttagagccgtcgtccttcacagccccattctctccggtttaagagttatgtattccgtcaagaaaacctactggttcgacatctacaaggtagaccacgtaccaattctttctattaatcctacacattctccaaattgtaatgtaagaagcttgttgtgtgtgagtgtgtgtttttccgcagaatatcgacaaaatcccatatgtcgattgcccggttctcatcattcatgtaagtcaggtttcagatagatacattttcgtttgaatttttgataagctttttggatccaaacagtttcaaatatgtgcagggaacttcggatgaggtagtggattgttctcatgggaaacaactatgggaactctgcaaagacaagtacgagccgctctgggtgaaaggagggaaccactgtgatcttgaacactaccctgaatacattagacacctcaagaagttcatagcaacagtagagagattaccatgtccgaggatgagcagcgaccaatcagagagagtgagagatgcgcccccgaggagaagtatggacaggagagtgaagccgaggcagagcacagagcgtagagagaaagagaagccaccaaagagtcagtcgaagatgagtagcagcagcagcaagctcaagatctcgtttgatcaacttgatcgctcgcggaggagcgttgactgccatgaaaagactcggaagagcgttgaccagattgagagggggaggaagagtgtggataggttggatagagttcgctccgagtaaaaaccacacactcacactcacacacgtataatacgtatgtagatgaaaagagtacataactgtttctatttaccgaacaaaataacatgtggatgtcgctcctcatattattgatttgta

SEQ ID NO: 671 - DNA, 2388 bp, Arabidopsis thaliana
tttttcttcttcttcttccttctgcatctgaaagtttgtatttttcctgggtttttacctttcttggtttgaatagacaaaagggttttcaaaattctgtagatttcattgttacaaaaaatgggagcggtgacgtcatcaatggcggcgaagtttgcgtttttcccgccaaatccgccgtcgtacggcgtagaagtggtggaaggaaagctgaggctgattggtgtagagaacgtgaaggagaatgttgaagtattgaagctgaagacgaagagaggtaatcaggtggttgcggcgtatattaagaatcctacagcttcacttacgcttctttattctcatggtaacgccgcggatcttggtcagatgttcgagcttttctccgagcttagcctccatcttcgtgttaacttaattgggtaattagtttgttaactcttcttgcttggagtttgattgattttaagacaagatttgaaagttgtttttcatggattaggacaagttggttttgttttgtcggaaatgttctaaaaagtagaaagtaaaacatttgattgtctagaatcaaactgttggatctgttgtggttttggtgaacttgtagagcttaaagaaccaaatattggagctgaattgcctcaaaaaccgacacttctaggaatcgagattctatatattttgtctttggtgcatagcgttggattgatataagtgagatccattggattgatctcagcaagatttggtagataatggatctgttgtggtttttttgaattttgatgaacttgtggagcttaaagaaccgatattggagctgaatcgcctcgaaaaccgacacaaatatgaattgacatattcgatatgtatcgcctttagtcagtagcataggattgatataaagtgagatccattggattgatttctgcaatttttggtagataaaatttcgagcaatcttgaagctgttctcattagggcaagtttttgttttatcggttagtgtcggctcatcttgaggttgtagatagttagaaacaaaggagaatcatgtgaatggatcttggtttttagatcagacataagtgagatccattgtatgaatattgatttgtttatgtgactgtgttgtgtaatgattcaggtatgattattcgggttatgggagatcttcagggaaggtatgatccattgtttttgatttttagtcaatcaaatttctcaagaatgatgtttttttttccaacagcctagtgagcagaacacgtatagcgatatagaagcagtgtatagatgcttggaagagaagtatggtgtgaaggaacaagatgttatcttatatggacaatctgtaggaagcggcccgactttagaattggcttctcggttacctaacctacgagccgtggttcttcatagcgctattgcttccggacttagagtcatgtaccctgttaaacgaacttactggttcgacatttacaaggttcttgtacaaacttttcttttttccacattccctactttacttatgtgctaaattttaattgttgtgattgcagaatgtcgagaagatatcgtttgtcaaatgtccggttttagtaatacacgtgagtattatctcacgtttattcggtttttaatgtcgtttagttattgatccgaggatatcgaatgtttgtgcagggaacatcagatgatgttgttaattggtctcatgggaagcaattatttgagctatgtaaagaaaaatatgaaccgctttggatcaaaggagggaaccattgtgatttagagttatatccgcaatacataaagcatctaagaaaatttgtatcggcgattgaaaagtcgccgatacttagaaatggaccggtgccactaacagagaaggcaaggagtagtacggatattagagaacctgcaagaccaagcacagatcagagagataaatcaagaacaagcacggatcaaagagagatgccgaagctgagtacagatatagcgagagcaagcgttgataagagggagagaacgagaagaagcgttgatgggactgagaaaccgagtaattccgcggaacagcaactagtacaaccagagaaaggaaggaatagcattgacaggtacatttctcagagtttctatgatgtgttgatgatcatgttgttgatgatcatgtatgataacaggtttggggagatgataagatcagtaggattttgcaacatagattgtttcaagcctacagcaacagctaagtgaggtaaaagagaagaaacataaacacactcacagacaatacacatggatccaagacatctaactttagttgtttgattttggtttgttatctctttctccacttacttcctcttatgctat

SEQ ID NO: 672 - DNA, 1602 bp, Arabidopsis thaliana
gcagttctgattcactctcttgctttttaattccttttttggtgattcttgtcttattttgttactgtgttcttgatactgttgtctccgtactaagctctttttgtaatggatctgcagatggagactgtgagaccaatggttgttgctcctaagggtaacaaactcagacgcaagtttgctaaagttcttaacattcataagctaacgggtgttgctccagaaggagaaatgaagaagataaagttcgattccaaaaccgctaagttgtctgagtcgttctacaagcttgaggaagagtatgagagaagtcagggattggaagctcttcttgcgaagctttttgctacggtttcttcgatcaaagcggcttatgcgcagttacagcattctcagtctccgtatgactctatcgggattcaaaaagcagataacttggtagtcgccgagcttaagactttgtctgagctgaaacaatgtttcatgaagaaacaagtggatccaaatcccgaaagaactctggttctcgcggagattcaagagctgaggagtctattgaaaacgtatgagataatggggaagaagctggagtctcagtacaagcttaaagactcagagattatatttctgagagagaaacttgatgaatcgatgaaacagaacaagttgacagagaagagacttaaccaaagcggacaactttgcaatccacttgacaatcttcacctatctgcgctaaatccaacacatttcgttacttatctgcaccacacagtcaagtccaccagaggtttcgtcaagctaatgatcgaacaaatgaaactcgctggatgggatatttcatcagctgctaattcgatccatcccggtgtgttctactacaagcaagaccacaagtgtttcactttcgaacactttgtctccaatgtgatgttcgaagcgtttcatctaccgtacttctcaacttcaagcgagtcaagaagctacaagaagaagaaacagagcaatgcagatagagaaatgttctttgaaaggtttaaagaactcaggtcgatgaaagcgaaagattatctaaccgcgaggcctaaatcaagattcgctaggttctgtcgagccaagtacttgcagcttatacatccaaagatggagcaagctttcttcggacatttgcatttgagaaaccaagtttctgctggtgaattcccggagacgagcttattctctggatttcttgaaatggcgaaacgaatttggcttttgcattgcttggctctctcttttgaacgtgaagctgagatctttcgagtacctaaaggttgtagattctctgaagtgtatatgaagagtgtagcagaagaagcgtttttcccggcggcggagagttcgccggagtctgagccacgtgtcgcgttcacggttgttccagggtttagaattgggaagacttcaatacaatgcgaggtctatctctcgctttcatgatcgccgtttgatctaagatccgaaaacggacggtgaagattcttgggcggtttggtaatttctgaaaatggtggggtatgtttagaaaattgagaaaaattgtgggccgttggatttgaa

SEQ ID NO: 673 - DNA, 703 bp, Arabidopsis thaliana
atggctccaattactgtcggcgatgttgtaccagacggaactatctctttcttcgatgaaaatgatcagcttcagaccgtctccgttcactctatcgccgccggtaaaaaagtcattctctttggtgttcctggtgctttcactcccacatgcaggtacaaactacaaagtctcaaacgtttttagatttatcctttgcattagttttataagatgtgggttttgttgttagatttgatttgagaattttgtgttggtttttgtgaggttagtatgagccatgtgcctggattcattgggaaagcagaggagctgaagtcaaagggtattgatgagatcatttgctttagtggtaagtatgaattgatatgtttttgatctctcctctgttttggcctctatgagtttttgtatacttaggccatgaatgtttgcatcttttgttgcagtgaatgatccatttgtgatgaaggcatggggaaaaacatatccagagaacaagcatgtgaagtttgtagcagatgggtctggagaatacacgcatcttcttggacttgagcttgaccttaaggacaagggtcttggtattaggtcaaggagattcgctttgttgcttgataaccttaaggtgactgtagccaatgttgaatctggtggcgagttcacggtttccagcgcagaggatattctcaaggctctttaa

SEQ ID NO: 674 - DNA, 2410 bp, Arabidopsis thaliana
tcctctaatcaattgtgtatatcccaagctttctctataaattagggtttctgaatcaacgatttttcttttatccgtaggagaatcactgaagcttttgcctcccaagtagaaagagatatggtaagcgtttctttaactctattttcttcattgtttcagttattggcgattgtattctctgtttattgtaatcgtattgtgttaattttgatttgactcatcttctctaaagttcaatttcaaaattagggattccgagatcatagatattgctttgtttccgagatttgagttattcttaagcttgttttactaactttcaatatgttggatttgttataggcaactcttgaagattctttccttgctgatttggacgagttatctgacaatgaagcagaattggtgagtgttaaaacacttttgattactattatctgtttacttggaggagctatgattgtaattgtagtttgtttgattatacatatgcaggacgagaatgatggtgatgttggaaaggaagaagaagatgttgatatggatatggctgatttagagacacttaactatgatgatctcgataatgtttctaagctgcagaagagtcagagatatgctgatattatgcataaagtagaggaggctcttgggaaagattctgatggagctgagaaaggaactgtcttggaagatgatcctgagtataagcttattgtggattgtaatcagctttcggtcgatattgagaatgaaatcgttattgtccacaactttatcaaagacaagtacaagcttaagtttcaagagcttgagtcgttggttcatcaccctattgactatgcatgtgttgtgaagaagattgggaatgagacggatttggctcttgttgatctcgctgaccttcttccttcagctattatcatggttgtttcagttactgctttaactacgaaagggagtgcactgccagaggatgttttgcaaaaggtgttagaggcttgtgatcgggctttagatcttgattccgcaaggaagaaggtccttgagtttgttgaaagtaagatgggatctattgcacctaatctttctgctattgttgggagtgctgttgcagccaaactcatggggactgctggaggtttgtcagcacttgctaaaatgcctgcgtgtaatgttcaagttcttggccacaagaggaagaaccttgctgggttttcttctgcaacgtctcagtcccgtgtgggttatctggagcagacagagatttaccaaagcacgcctcctggacttcaggctcgcgctggcaggctcgtggctgcaaaatcaactttggcagcaagagttgatgctactagaggggatccgttagggataagtggaaaagctttcagggaggagatccgtaagaagattgagaaatggcaagaacctcctcctgcaagacagcctaagccacttcctgttcctgattctgaaccgaagaaaagaaggggtggtcgccgtctaagaaaaatgaaagaaaggtagcctttttcatcctactttgtgtccttaattactgtagattgagttctattcacctgtatttattttgttgcattcttacgtttctctttaaatcaggtatcaagtaacagatatgaggaagctggccaacagaatggcgtttggtacacctgaagagagctccctcggtaatatatcttgtagttacacttgttaatggccacttataaggcacttagtctaatatctactcttcatgatgataggtgatggactaggagaaggttatggaatgcttggccaggcaggaagcaacaggctgcgagtatccagtgttccgagcaagcttaagattaatgctaaggtcgccaaaaagtaagtgttcctctatttctcctgtgttttttcggatttatcatgttaatatttttactcttacaaattatcctgccctgttcttcttccatcatatctcatttgcgtctttatatcaattactttttcaggcttaaagaaaggcagtatgcgggtggtgcgactacctctggtttgacatcgagcctggctttcactcctgtgcaggtacaaacatttcattcgattcttgacaaaagtttgatcctgtgttccatttgcatcactgtctgactccaattggttatctatttgacagggaatagagttgtgcaatcctcagcaggctttaggattaggaagtgggactcaaagcacttacttctcagagtcaggaaccttctcgaagctgaagaagatctaaaatatggaagacagagatacaagtcttgaaaagccgagcactaaaagtgtaaaaatgaaacaaaggtggaaagaaactgctttctctatctcatgtctgttttaaggtttcttcggtcac

SEQ ID NO: 675 - DNA, 2626 bp, Arabidopsis thaliana
tcttcgcattgtccgccattcttatacttcccctagagaagcttcttagggttcttagtttcttcctctgccgcgtcttctcaagtttaaaacttgtctcttcttcttcaaatccaatcaatgggtagagattttctagttctaagtattctcattctacttctctctgggattgtatcttcagctccttcagctaattctcctgcaagtaagcgtaatcacatttttttaactctctcttctcttcgattctttgtttaattgttttcaaatcttactccttttgcagagattcttaatgggtttatctcaaatcatggctcttcactaatgaaatggttatggtcactcaaaaccacaaccaaaacaagttcgaatcctcttccattttctgatcataaagtttgctttttaatctttttctaacgaataaaggtttctctttttttatgaatcagctattgcaacgagatcgatggtgaaattcgaaaatgggtatagtgtagagactgtgtttgatggaagtaaacttggtattgaaccgtattctattgaagtcttaccaaacggagagttacttattcttgattctgagaacagtaacatctacaagatctcatcttctctttcattatgtaagtacaaattttgtggtttattgattcttgaagagattgtgatgatgttgagaccacgattgtgcttttgtcatcacttcaaactgaatgcacatggggactatagtacaaaaagatgctgcatatggaaaaattgatggaattttttggtacttcaaattgaaaattctaaagtctgagctttattactattttatggagattttgctgtatctttgtcgtttctggagtgagtttgtcggggatgatatcagtatacgggtatagtttagtagtacatttgtttgctgaatctgactttttcaaagatgagatctaaaacaaaagtgtttgtttcaaatggttcagaatagaaacaaaagcttatattggtttgcaaaagtgtttctttctactatttggttgagttttatttatatggaaagtattggaaacacttgcagatagcaggccaagactggttactggctcccctgaaggatatccaggtcatgttgacgggagattacgtgatgcgaagctgaaccatcctaaggggcttacggttgatgacagaggaaatatatatgtggctgatactgtgaataatgctatccggaagataagtgaaggaggtaatagcttgttcataactgcattcatagaagggttatatatacgtttgcatcttgtactgagttttaaatgcctatgatgtgaaggagttacaactattgccgggggcaaaacggttcgaaatggagggcatgtggatggaccaagtgaagatgcaaagttttcaaatgattttgatgttgtttatgttggaagtagttgttctctgcttgttattgaccgtggaaacaaagctatcagagagattcaactccatttcgatgactgtgcttatcagtatggaagcgggtttcctcttggtaaacttacaaaagtaccaaacttttttttatgtttgtctctttttttctttgaataactctgaattcaatgtattgcagggattgctgttcttgttgctgcaggtttctttggttatatgctagctctgttgcaacgaagagtcggctctatcgtgtcttctcataatgtaagtgctcgtctcaaagactaccctggcttattattattctgctaaaactattcaaatatttcttacacaggatcaagaaatgttcgaagctgatcctgatcaaaagcctatgaaacattccagaccatctctgattccggctggagacgagcagctagagaaacaagaggaaacatttgtggtatcgctgggaaaactcgtttcaaatgcttgggagtcagttatggagatccttagaaaaaagcagacaggcaccagctttcagcagtaccatgggacaacaaagcagtctgctgcatttagcacatcaactccatggccaattcaagagagctttgtgattcgagacgaagacggacctcctcctgttgagcccaggaacccaactccaagaaagacttatgcttttatgtccaaagatgcagagaaaatgcagcagctacgtcagagccgcgcattctacagtagctgggacgctgagttccccaaccagcagcaacagcagcaaaagcagcaccagaagcatcagcatcagcaacaacagcagcagcagcatcgaaggcattactcatcgatcccgcatacttattatgagcaggacagtgaaaagtctaatgagatagtctttggagcggtccaagaacagagcagcaagcgtgtggctaagcctaagccgaagcctatagagtctggagatcaaatgaataataatactcaacagaatcttcactacagatctcattctgttagttacccatatggatactatcctaatacatgaaaagtctccggttttgtgcgtttctgagattatcagtcttccttaataagattatgcagggaattaaattttttgggtataggtgtttgtattggggaattttaagagtatgctctcgtc

SEQ ID NO: 676 - DNA, 2521 bp, Arabidopsis thaliana
atggcttcgttggatacataaaagcgatagagacgcatctctgagtcagaagcgagccagcgagagagagagagcgagtcacaaaaattcgaattttaagccgccgtgtgagacggcgtaatggctggtggagctatcactcccgattctctcatcggtcttattgctgaaatcaatgagattccggggaattttggtttgtttaagaaggattgttccgatctcgcgcgacgagtcggtctcctgacgcatttgattgaggaaatcagggattcttctccgccgtcggaatctgatgcttcttcttcgttgaattctcatgaatgtgattggtggtctgatcttgtggtgggacttcaagccgcgaagcgtcttttgtcttcagctactagtttccaagctcgcgagtcctctgtaagcattctaaaccattctcaacgattgaaaatggatttgtgatttcacgaagatttggtctcgccatggcaggaacgtaatttataggaagaatttgtttttagtttttttagattggaagatactattgttgacatttgtgtagtgaagagcattattaatatatacatgaggagctctctaaactttgatgtgtgattttgattgaaggatggggcagccaagaggatctcattccagttccaatgtgttacatggaagctggagaaagcattaggtgatttgacatatgatagatatgatatctctgacgaagtccgtgaacaggtaaaagtttgttcattatgtagaatgtatgaagatttggttttcctatccatggaggtgtttctaagggtttttttttgcttgtgattaggtggaactagcaagattacagttaagaagagcaatgcagagatatggatcgttaaattcgaagaagttctcgagtggtttatctgagccaatggagaaagatgcctcaagtaatagaaaagttattgaaaagttggagagtattccagagacagtgcattctttatcagatgagaagaaatttgaatcaccccctccttggaagagctcttcagtatcattggccttctttttatcaaaggatggtgatgatgagagattagagaaagcagttaccgagaacagcgatgactcacagaaatcggataatctcacgattccagaggactttctttgtccaatctctctggaactgatgaaggatcctgctattgtttccacaggacaggtctggtttaaaaaatcaaatctttatatagtgctaacgtatggttgttgatttgaaaccttaacaatgatcttctctcttcgttggcagacatacgagaggtcgttcattcagagatggatagactgtggaaatctgagctgcccaaagacacagcagaaacttgaaaactttactcttactccaaactatgtcctcagaagcctgatatctcagtggtgcactaagcacaacattgagcaaccaggtggttacatgaacggtaggaccaaaaacagtgatgggtctttccgtgatctaagtggagatatgtcagcgatccgagcattggtttgtaaactctctagccaatcaatcgaagaccgcaggactgcggtttctgaaatccgctctctgtcaaaaagaagcacagacaaccgaattctgattgcagaggcaggagccatccctgttttggtcaagcttttgacctcagatggtgacactgaaacgcaggaaaatgctgtcacttgcattcttaacctctccatatacgaacacaacaaagaactgatcatgcttgcaggagcagtcacatctatagtgctagtcctccgagctggaagcatggaagctagagaaaacgctgcagctactctctttagtctttcgttagctgatgagaacaagatcattataggcgcatcaggtgcgataatggccttagtggatctgcttcaatatggaagcgtcagagggaagaaagacgcagctacggctctgttcaacttgtgtatttaccagggaaacaaaggcagagcagttagagccggtatagtaaagccattggtgaaaatgctgacagactcctcgagcgagaggatggctgatgaagccttgaccatactctcggttctagctagtaaccaagtcgcgaaaactgcgattttgagagccaacgcaataccacctttgatagattgtctccagaaggatcaaccgcgaaaccgagagaacgcagctgcgatactactgtgtctttgcaagagagatactgaaaaactgatctccattggtagacttggagctgttgttccattgatggaactatcaagagacggtacagagagagctaaacgaaaagctaattctttactagagcttctccgtaaatcatcccgaaaattaggttcactctaaatagcccttaacatgaattaatttagttttgctggctattgatctgtttattatgtcctgtatcttattgagtttttggaagactaatttaatttccatttgaggagaaggtggagtcaa

SEQ ID NO: 677 - DNA, 2033 bp, Arabidopsis thaliana
ttcttatcctttgtcttgttctgtctcttggtcgtgatatgaattagttctttcttcttggttaaattgcagaacaagtgaaagagcttaatatccacaagactcttgtttctttcttaaatggctaaagtttattggccttatttcgatcctgaatatgagaacttgagctccagaatcaatcctccaaggtaaatcattattacatttcacacttgaaacccattgatgctacttccaagaagctcatactttttttctatgttgttgcagtgtttctatagataacactagctgcaaagaatgcactcttgtcaaggtaagcatcttcttcctctgattttagttgattcgatgattaaactgagattttgatgcatttgtgactgttaattattaggtggacagtatgaacaaacctggaatactacttgaagttgtgcaagtcctaaccgatctcgatctcactatcactaaagcttatatctcttctgatggtggatggttcatggacggtactaattttgcatatatgtatatacattcataacttattatttcattacaatgaagcatctcactgattctattttcacatctttttagtattccatgtcaccgatcaacaaggaaacaaggttactgatagcaaaaccatcgattacatcgagaaggtatattcatataagcagtagtttgtataatatatgcaattggtttgttatgacattatatgtgattctttttttttcttttttcttttaaaaggtgttaggaccaaagggtcatgcttcggcttcacaaaacacttggcctggtaaaagagtcggtgtccattcattaggcgaccacacatcgatagagattattgctcgtgatcgtcctggtctcttgtcggaggtttcagccgtactagcagacctcaacattaatgtggtggcagctgaagcatggactcacaaccgtaggattgcgtgtgtcctctatgtgaatgacaatgcaacttctagagccgttgatgatccagaaagattgtcttccatggaagaacagcttaacaatgtgctgcgtgggtgcgaagaacaagatgagaaatttgctcggacgagtctctccattgggtcgactcacgttgatcgaaggcttcatcagatgtttttcgctgatagagactacgaagcagtgactaagcttgatgattctgcttcttgcggattcgagcccaaaatcacggttgagcattgtgaagagaaaggttactccgtgataaacgtgagctgcgaggatcgaccaaagctcatgtttgacattgtatgcacgcttacggatatgcaatacattgtgtttcacgccacgatttcatcaagcggctctcatgcttctcaggagtatttcatcagacacaaagacggttgcactcttgacacagaaggagagaaagagagagttgtcaaatgtctggaagctgcaatccatagacgagtcagcgaggtaagtaaacacattttgttggtgtatgtttcttgcgttagaagcaacaataccttaagttattgtctgaaatttgattatagggttggagtttggagctctgcgcaaaggacagagttggattactgtcggaagtgacaaggattctgagagagcacgggctatcagtgtcgagagctggtgtgacaacagtaggagaacaagccgtcaacgttttctatgtgaaagatgcttcagggaatccagtggatgtgaagacgattgaggcgttacgcggagagattggacacagtatgatgattgacttcaagaataaagttccgagcagaaaatggaaagaagaaggtcaagccggaacaggaggaggatgggccaaaaccagtttcttctttgggaatttgctggagaagttactgccttgagagaaaaggtaactatgtgtggataaaacgtactgtaaaatgtgtattatgtatgatctagagggccttagtgtgatgtatgacttggtcagggattttggtggtttgcccgaagtcaaa

SEQ ID NO: 678 - DNA, 2580 bp, Arabidopsis thaliana
attatttgtagaaaaagtgtctacttttcaacttatctctaaatacaatccgaaaactgacccgtacatacccgacccggatctattagacactcgttcttcgtcgttatcaattcggagatgattccgtttcctctgttaccaacgccgattgaaaccaactacagagcttgcaccattccttatagattcccttccgataatctcaagaaagccactcctactgaaatctcctggatcaacgtcttcgccaattccattccttctttcaagttcctctctctctactttgacctcatttagatactgctcatgggtcgaatcaagttttgattttgaaaccaaaaattgcttcttttaggctcatattccaatagtctgcttgattaattgcaaattctgtcaaaactcatgaaacttttagcccttaagctattgatagtgtagttgctagttgttgctttgactttcctctgtgtttacttaacatcacgagattgtttctggaagcttataggaaacagatggaatcctaattttaacaataattattctccattgttctaaagctgtttcatttgcaggaaacgtgcagagagcgataccagtgttccagatgctcctgctagagctaaaatttttgaacaaaggtaacatatttttttgcctttgcgtattaatgtggtaattctcaaagttttggtttgtaggcaaatgttttgctaatgtcaccttcataaactagacgagttttgtgtcctgtggtttgcgtttgatatgtcttactttgaatctggaagatatgcgggatttcttgaaggctggaagaaagatccagagagtaatggtgggccaccagatggtgttgtaagtcgaaaacaccttatgatctttctctttgatgtagtgagttttgttttcatggattattttggcttgttttcagattctcggccgagttcgtgagcatttactcagagagttaggatttagggacatattcaagaaagtcaaggttcgaattttctttcaagggcacttgaggttttcagatacagagatactctttctctcgcccgctctctctgattagatgagcttgcattcaatgaataggatgaggagaatgcaaaggctatatcactatttcctgaagttgtcagtctgagtgatgctattgaagatgacggagaacggttagagaatttggtgagagggatatttgctggaaacatctttgatcttggttctgcacaggtattccattacttgaacaacgctggtttcttcagttgtctctctttggtgctcccacaggaaaagcttgtcctaattacgcgctcttttcttttcgcattttgaagcttgctgaggttttctcaagggatggcatatctttcttggctacctctcaaaacttggttccacgaccatgggtcatcgatgacttgaacaagttccaagccaaatgggtcaagaagccttggaagaaggtcacttgtttgttttgtgctttatctaatgcgatgttcagacttcagaggttaaccgcttgacaaaattaattgtttatgacaggcagtgatttttgttgataattctggtgcagacataattttgggtattttgcctttcgcaagagagttgctccgtcgaggaattcaggtacggtacctttgaaaatgaccgagtctttttttacagtcccctgagtgatgcagagtactatctaaattgttctttctttatattcccccctgaaggtggtgctagctgctaacgagctgccagctatcaacgatgtaacatatactgagcttacagatatcgtgtcgcaggtgatgaatgatgtaattcttgatattaactaattcatgaaaagtgaatctgatttattagacttaatctaccagttaaaggatggaaatggccaattgataggcgttgatacttcaaagcttctgattgcaaattcagggaacgatttagcggtaagacattagaaactccagagacagaaatgggtttattcattagattcttaaggtttttttctttttccctctcgaaaatttgtttcaggttattgatctctcaagagtatcgcacgagcttgcttacctttcatctgatgcagacttagtcatcctagaaggcatggtaggggcccatacaatgtgaaagtgaagcacgatttaacaactagtcttggctttgttagctaacttcttggctgttgtaatcagggtcgcgggatcgagacaaacctttatgctcagttcaagtgtgattctctcaagatcggaatggtagtactttctctatgtcacgttactctctctttattctgacttgtcatgaacatctttggttatgcaggtgaagcacgttgaagtagcacagtttctcggaggacgactttacgactgtgtctttaaattcaatgaagttcagagttaattacatttcaatgatattgtactgaatcatccattcgatatatcattttatcaaacgaaatcaacctagattcctaacaaaaccaaggaaaaacaaaaaagacttgcaattcactcaaca

SEQ ID NO: 679 - DNA, 1404 bp, Arabidopsis thaliana
tcgtctatacgacgtcgttagtgtcttcgttattataataaatacgagcattttttcaaatatcaaattcaggctcactttcagttacagttaattcgttgctgctgacgtcacacggcgatggttttcatctctgaaacttccgacgacggctccaatggcggcgatccaaccaagaatccgcaagaagaagaagaagagaatcttcctccgattcctcaaggaatcccagacgaactcatcgaaagtaccgtcttactaatccggagatgtcattacccgacgctatctctcctctccaaaacctttcgtcgcgttatctcttcttcggaactctacaaaagccgcttcatcctcaacctcaccgactcagttctttacgccttgatcggattctctccttataataccacaaacttgtacattctcaattgtaacattccaagaaacatctctttacacttgagagaaatcaaatcacttcctcctctgaatcatggatctgcggtggtcacaatcggataccatatgtatgtaatcggtggacacaaccgcctacatcaacccacatcgaatgtgtctatcatcgatttgagatttcatacgtcttgctcgctcccgagaatgcagagaactcgcgtctacgcagctgcaggagtaattgacggaaggatttatgtgatcggaggttgcgtgaagcgaaatgatcattggatcgaagtgttcgatatagagaatcggatttggagtagtgtgcctcatcatcgatactgtaacggttctagtttgagaggagaagggtttgtgacatcagtggtgatgcaaaacaagatttacattttggattctctgtttggttttgcttacgaaccaagacacggtacattgcagtcattaggatttgaaactcagttcatgtttctttggcgcgacccgtgttgtgtgattgagggtttgttgtattgtattgatcctatgtgtgttcttggacatgcaatagttgtttatgatccgaatgagttgatttggagacgtgtgaagggggcatatattttgcctaagttttgttattatcagtgtaaaatggcgaattttggtgggaagttggcaattttgggatgttctaattccagccagcgtggtttgaaagatgtttggttcgtagagattgagttggaaaatcgtcaaagtggtgagatttgggggaaggtcgattcattggcgattgtgcttagatcagtgaagtcgccttccattgatctgtttcgctctgttacgttttgatgattcgtttgcagttgcaaggtatgttaatctttgatgtggattgactgttgatgatgatattattatgttgagatggtttcttgagcctcaagtcttagttaagctttcatgaatttg

SEQ ID NO: 680 - DNA, 1515 bp, Arabidopsis thaliana
attagcccagctttgtttagggtttttgtgtatcttcaattggtgtgttggtgtatactctcataatttccctttgccgcagagaaagaaaaaaaaaaatcattgttgcaatttgaaagtatgacgacgatgatctctaatcttccaagggttttgatagaggagattttttttagggttcctttgaaatctttgagagcagtgagattaacttgcaaaagttggaacactctatccaaaagtaggagctttaggaagttgtacattagtaaaagagcaacaagagaagaggagtccatgatgatcgctatgatgaatttcgatctttattcaatgagggtcgtagttgacgacgacgttgatccatctaaagcgtttaaaaaaaaaaggaataaaaaatctatagcgtttaaacgtcaacctattttccttgatgaacaagtcaagatatctcaagtttttcactgtgaaggtttattgttatgcttcttaaaagaagacgatacaagggttgtcgtttggaatccgtattgcggacaaacaaggtggatccaactcagatattctcaccgtccacacaaagacaggttcatttacgctctaggatacaaggataaggaatctcgtggtagcttccaattattgaggtttgtagattatttcctaggagcacccaaaaatcaatatttttggtatgaaatttacgattttaactctgattcatggacaactcttgatgtcactccacactggtgtatatactgttgtgaccgtggtgtttctctcaacggaaacacttactggtgtgctaaagaaaggaaagcagaagacgatattgtcgatcacatcatatcttttgattttacaaacgagagatttgggccgcttttgcctttgccgtctaaggttatggaacatgaatatgaaattgtaactttatcttatgttaaagaagagaagcttgcagctttatttcagcattacgaagcagattggaatgagtttgatatatggattacgactaagattgatgctgaagtggtgtcgtggagcatgttcttgagaatggatacgggacctaggatagaggttccacatatatgtgaaggtttcttcattgatgaggagaagaaagtcgccatgggttttgaagaagacttcgatcgcaaaacatttatcatcattggagaagctggatacgtaagaaaattggatatcaaagcacatgtagacagaaaatgtcggccaactgtgtgttcttatgttccaagtttggtccaaatcaagaaacctgcacgaggcaaaaggaaaagacaaagcagcttagaaaagcgtctatttgatcaaaacatgttgagacttgaagcatttaaaaagctaggcggctacttctagaagcaatatgcaggaggagttagaagtgaaagggatgacttgtctcaatatataatttattatgttacaaaacttctatttattttctcaattactttattttggcatgtacgtcaatag

SEQ ID NO: 681 - DNA, 1632 bp, Arabidopsis thaliana
tctctgatacccaattcgaaaaccacttctcagcctccgccgattcagacctcgcatattcagcttcccagtctttctctctgcgtcgttctagggtttttgttactctttgcttcgaagatgggaaaggcaaagaaacctcaaaagtttgctgtcgtgaagaagatgattagccacaaagctttgaagcagtgagtaaacgattcgtcttccttcaaatttgatccttttttaaagagattcttagttttgtttttatttatatagttacaaggaagaggttctgaatccaaacaagaaggacctcacggaacttccgagaaacgtgtaagcttcctaccactgttagctttcgttgccaagttgtaattatttgggtttcgtttgatttgtttttggatcagaccgagtgttcctgcagggcttttcttttcttacaactctacattggttcctccttaccgtgttttggtggatactaacttcatcaacttctctatccagaataaggtcggttcatcttcaattgcatttctctatcacagagctataatcagaatgtgtatcgatctttgtagagtttatagtcttggtgaacctgattggaatctctcattgtttgaaatcctttttgacttattttgctctggtgtatctaatagatcgatcttgagaagggaatgagagactgtctgtacgcaaattgtgagttacttaaagattttgataggtctatataggttctctctcttgttaaccacctgtaattgtttctggtttgaaggcactccttgtatcacggattgtgtcatggctgagttagagaagttaggtcagaagtatcgtgtagctctaaggtaaatcttttagactttttgaacaaggcttttctgtttatggttttgtttcgtggattcgtaattggtttactataatatttggtaggattgcgaaagatcctcacttcgaaagactaccttgtatacacaaagggacatatgctgatgactgtctcgttgacagagttactcaggtaatacatcgttcccggcttgttgaactttgtattcaagactctgaaatgatataccgatgctctggtcccatggttcttggtgtatacattttatcttttgtatgtttctgtaatattcatttctcataatatacagcataaatgcttcatagtggctacatgtgatagagacttaaagcgaaggattcgaaaggtaaagatagtttgttgtatcagtgctcttgtttatatccatggctgaagtctttggatattatcaacttttttctatgtttgtttgcagattcctggtgtgcccatcatgtatgtgactaatcgcaagtactcaatagagaagttgcctgaagctacacttggtggaggtatgtatcttccggctgagacatctgaatctactgctactatggtattagactatgtgaattcgcttttgtaacctttggctgtttttttttggtgcagctccaaggtactgataatttattagagaccttatgaattccatgaagccctgaagcctcaagcctgagttggtatcggtttacgcgctgaatcaactgagttggaatggctatgttgtgagccattttgttctc

SEQ ID NO: 682 - DNA, 1430 bp, Arabidopsis thaliana
ttgttgattaacccttaattaaatggatgttccacggccagctttcaaatgttttgatgacgatggccggcttaaacgttcagggacggtttggaccgcgagtgcgcatatcataaccgccgtgattggatctggtgttctatcgcttgcgtgggctataggtcaactcggttggatcgcaggtcctacagtgatgttgttgttctcttttgtcacttactactcttccacgcttcttagcgactgctacagaaccggagatcctgtctctgggaagagaaactatacttacatggacgctgtccgatcaatcctaggtggctttaggttcaagatttgtgggctgattcagtatttgaatctgtttggtatcacggtcgggtacacaatcgcagcatctataagtatgatggcgatcaagaggtccaactgtttccacgagagcggagggaaaaacccgtgtcacatgtcgagcaatccatacatgatcatgtttggtgtgaccgagatcttgctctctcagatcaaggattttgaccagatttggtggctctccattgtcgctgctatcatgtccttcacatactctgcaatcggtttagctctcggaatcattcaagtcgcggcaaatggagttgtcaagggaagtctcaccggaattagcatcggcgcagtgactcagacccaaaaaatatggagaacctttcaagcacttggagacattgcctttgcttattcatactctgttgttcttattgaaattcaggacactgtaagatctccaccagcagaatcaaaaacgatgaagatcgccacaagaatcagcatcgctgttacaacgacattttacatgctatgtggttgtatgggctatgccgccttcggagataaagcaccgggaaacctcttaaccggttttggtttctacaatccgttttggctccttgacgtggctaacgctgccatagttatccaccttgtaggagcttatcaagtctttgctcagcccatcttcgcctttattgagaaacaagctgccgctaggtttcccgacagtgacttggtgaccaaggaatacgaaatccgaatccctggttttaggtcaccgtacaaagtcaacgttttcagagcagtttaccgaagcgggtttgtggttttgaccactgtgatatccatgcttatgccgtttttcaacgacgtcgtagggattttaggtgcgttagggttttggcctttgacggtttactttccggtggagatgtatataagacagaggaaggttgagagatggagtatgaagtgggtttgtctgcagatgttgagctgtggttgtttgatgatcacgttggtcgccggagttggctccatcgccggagtaatgctagaccttaaggtttacaagccgttcaagactacttactaaaattgga

SEQ ID NO: 683 - DNA, 1774 bp, Arabidopsis thaliana
aaataaatggacatttcaaatgggccgagaaatgacgaaaaggcccaaatagaaccgaaagggccgaatcatcacccttgactttgagagagagcatctcaattgctcctcctagtctccatgaagaagcgcatgtggagaatctcactgatttcccagatatctgatctgctctgcctttcccgtggctcttcttcaaccttgaagactctgaccccattctgctttaccctctccaggtctcccttccaccaatccgggggcgatgatgatgcttcgggattgaaaaaccaattgttgcgcttccgtaatgattccggtaaagttgcctccgttttggagaggaacaaaatccaaggagctgcgtttgttgagctccttaggcagttacgtccatggcccgttttgtcccaactggtatacatacatcttttttgtcttcgaatttcacaaccacaaaagaaaaagccttttttccgtcatgtttgatgttgttgctttgcaggtgttcgactggagaagaaacaaggcactatgcgatgggttgcctatgactgctgatgaatacgctaagggcattaccatttctggtagactgaagaatgtcgatttggccctttccttgtttcacgagtctgcaaacaagaccacctccgtctacaatgctttgatgggtgcttacctctgcaacggtttgtctcatcattgcgagcagctcttccttgacttcaattctcaacaagacggaccctcctcttctactccatctgtctctacttacaacatcctcatttctctttatggccgtttgattatggttgagcggatggaatcagtattcctacagcttcaacaactcaatatccttcccgattccagcacctacaacaacttgattgctgggtacatctatgcttgggattgggataagatggaagcaactttccactccatgaagaacggccttgttaagcctacgcttgccacctatttgctgatgctcagagggtatgcaaactcgggaaatctgctacggatggaggacatgtatcaagccgtcaagcgtcacgttgacaggaatgagattaagttaatcgagtccatgatttgcgcatactacaggagttgtcacaaggataggatcagaaaaatcaagactttatccaaacttatccccaagaaaagttacaagccttggttgtatttgctcttgatgcaggtctatgctaaggatgataatctacatgccatggagaatttcatagaccaggctattacaaaaggactccagatagagacagatggtattatgagatcaatagtggctagttacttcaggtgcaatgcggttgataagcttgccaaattcgtgcagcgtgcaaactctgctggatggaaaatgagcaggtctatgttccatggcttaatgatcatgtatggatctcaaaagcgttttaaagagatggaaaacgtcctctctgaaatggaaagctttaaaataagccggtccaagaagacgctttgtattctgcttagagtatacgcagcaacgcatggacaggagcataaggttaatcaagtcgcaggaatgatgttaaagcatggacatgatttccaacgacctgaagcgagtaaaagagttatgggaaaataggatactagagagagagatatgaataaatacaagcagcatattttgttgggaaggattgtatgcatccagggattcgatttgaaccctatagcatcaaggaatcaaaccattgaagcagaa

SEQ ID NO: 684 - DNA, 1035 bp, Arabidopsis thaliana
catcaccgggactatctatatatatatactcacaaataatctcatgtagcggccaacttcataactcacagtccaaacttaaccacaacctaatccacaaaagagttatagaatcatctgatggcgtctactgagaaccctgaccctgaaactggcaaatctgaaccgattcccgcgtcggctacaccaccaccctcatcagccgccagtttcctagattgtcgtaaaatagacattataacaagagttctgcttttctccgccactctgactgctcttatagtaatggtgactagcgaccagacagagatgactcagctccctggagtttcgtctccggctcctgtctccgccgagttcaatgactcgcccgctttcatgtttgtctctttaattaattaaattcctccatgtttgatcataatcatggaatgttttctagtttaaacttaatgtgttaaattggctatatatctatgcagatacttcgtggttgctctcgtggtagctagtttctatgcgctcatatcaacacttgtctccatctctctactcttgaaacctgagttcactgcacagttctccatttacctagcctcgttagacatggtaacttgttttacaaggaactttgaaacttccatataccatgttaattagggtgttttaagtaataattccggaatatgtatatatgaacaggtgatgctggggattttggcgtctgcaacgggaacggcgggaggagttgcgtacatagcgttgaaaggaaacgaagaagttgggtggaacaagatctgtaatgtctacgacaagttttgtcgttacatcgcaacttcgcttgccttatctctatttgcttcacttcttcttctagttttatccatctggtcagcactctccaagagaacatgaacaaaagcttataaatccatcctttccctgtactgtgtatttgttcacacgtgtttgtctgtgtcttgatttgttttgtttatgttatattaatgtaaaagcatgcgtttctatatacag

SEQ ID NO: 685 - DNA, 1844 bp, Arabidopsis thaliana
gaatttggagtttttgtgtagtgtatacttgttttctggattgcttgtcacttactgttgatttatggtttgcagagacaagttgtatccctcgtttgctttctgcgaaactaaggtgcaatggcgaagataaaaccgcaggctcttctaaatcaaagcaagaagaagaagggtccaagtcgcataagtatttccactattattgtctgtaatcttgtagttgctgtagtcatattatcgttggtcacaacctatcgccattggtcccaaaggtttgttttcatctttgaattgttcctttttcattacttctgttatagtagattctccttttactttatgtgattatctataaactaaaaaggatatcattggttatatctcctaggtcaagaaacacaattgaacatgaaactcggagtcagagatttgaggtattttcttgagagattttttaatgtatagcttttgagttttgatcctgatgaacttccgagcacttaggtttagagtttagggtatttaccatatgtgatctggctttggtttctgcttcaggacactaatactgcgtcagggcaaaaaacttacgatcttcctggttttgctgtaagttaatctccctgtttgcttgcttaagtttcttgttttaatccttgttcttatttctcatcatggtattatgttctgttcatcagtttttgaagtaaaaaaaatgtgatgtgtcttatctgaatattgattttaatgatatcttgcttctattttcctatctcatgtaggatataaacacatcaaaaggacttataactgtcgaactcttcaaagaaggttcccctgaagttgtggacaagtttctagatctatggttagtattggaattcgtttgttttcctttaagttagatagaaaaagaacagtagagtaatttgattaagctaggtcatgacttgttcttaaataggagtattacttctagcttgataggattcaagtagctttagtttcttgattgactgattttgatccttaagtcctcttgtactcttcttggaatttttgtttggaacatgaaacctcattaaagagaaatgggctgaatcagtctgtgacgatattgtagcttaatataatagtagaagttgaacattgagtattgttgcagtcaaaaagatcacttcaagggaatgccgtttcagcgggttataaagaactacttggtacaagctggtcactcaccgagctctatacctgtagaagaatggacagctaaaggaaagctcagaggtcgccttcacattgggtataacttgcttgctctgcttttggcttttaagtgtcaatgtttatcatctctcgctggttttaaaaaataaaaaactacatatgttctgttacagcccaaaacatgaggcattcatgttgggaacaccaaaaaacaaagggaacaacaaggattttgagcttctgatcacaacggccccaatcccggatctgaatgatcaacttatagtgtttggaagagtccttaagggagaggatgtagtacaggtttgatccaactaagcacagtctatcagcttgaatggtttgtttaatagtttcatgtgttaaaagattaaatcatattattacaggagatcgaagaagtggatacggatgagcatttccaaccgaaatcgccaatagggatcactggtgttgtactgaaactagagacatgaaatgaaaatttctcttccttgcttcctctgtaaatgaggctcacgccaaatccttcttcatactcgctcttttgtataaatcctcttttgaggttttttctttctttctattttacagtt

SEQ ID NO: 686 - DNA, 1649 bp, Arabidopsis thaliana
tttgttttgggccgcatgaagtcaggcccaaatatttaaaggcttatttgattaatgatatttgaagacatgtccttgaatcggagttttcgaaaattttgaagggagcttttctgacagatggctagattctttcttctctgttgcctcttcgcggcggtgctgacgtcatcattgacggaggccggcgacaataatcaagtctactcgccttgttcagattctactgttgcgatcggcgatggattcactttcggcattgccttcgctgcgaaagattctttcttcagtacaaatcgatccaaatccgttcagtactctccctgcgatcatcgccatctctcgctcaacggaaactctgaggtcgccgtgttcagacctaaagtcgatgagatcacactccttaccatcaatacctctagttcctccagtttccgcccggttcgttctcatctctggtttatcttggtgaattagggtttcgattgcaggtttttgatcagattagaatggattaggtcactcttaaggaaatttagtatagatcggaatcatatgcccagattagttgacttgtctaaatcctggcttagaatgttagctctggaattctaagctaattgtcgagattacttggattggtagattcaattttcccgtaggtaacgaaggtttaggttttaagctctgttcttggacgatctggttcctttctgcatttgtttcagtgagatgaaaggttcaaaacagagacttgccatgttagattcctatagattaagagtttggtttctgacgaagtaggtggaaatcaggttaacttgtaatgtgtatatcattagactttcagtgtagatacctctggaaaaagtgattttagtagtagcttcgtcacagtttctcccgaacattactatacgatttttgtttatcctcggaagtagaggtcatgaatgtgttagcctatcaaattatttgtttgtctgatgatactttgtgattccaggatgcttccaagggatatatggtagcattcgctggtgcaaaatacgctgcaagatcactcccaattatggttgcagacagcaatcacatcgtgacaagcttcacccttgtaattggataagctcatatcaaccttcattttcatttttcttatagaaagtttccatctcttattagttatgtaatcgtcatatatcttgggtgaattctaggttcttgagttccagaaaggaaggcttgagaacatgttctggaagaaagacggatgctcgaagtgttctggagattcgaaattcgtgtgcctcaacaaagaagaatgtgcgatcaagccgcaaaactgcaagaaccaaggaggacaagtagattgtagcttggggatccaattggcgttttcgggcacggataagcactacaccgcgttgaattcgtggtatgaggttgcaaatctgaagcagtactcgctctatggcctctactccaatctaaaggactcactaaccaacccattcaagaacatcttctgatgactttctttctcctttgtgtgttgctactcttgtaattttgtattattttttcacctgctttctttgtattatttcttccgtatgatttttgctatatattgtattttattacttggg

SEQ ID NO: 687 - DNA, 1560 bp, Arabidopsis thaliana
tgtcttgtctgctagaaataattgtaatgagttttgcaaatttgaaaaccaacatgtgaagaaatctataaatataggttttaagaaacaaagaagagcataagaaagaaagtcgtgaagatgagaggcgtaacaccaaactattaccattcttacactttcttcttcttcttcttcgttgtcttattagctctgtttcttcatgttttctcgataaacactttgtcatctacagaaactctaacaatctcaagcaaccgaaccattgtgtctcccggtaacatcttcgagctaggtttcttcaaaactacaacaagctctcgaaatggtgatcattggtatcttgggatttggtacaagtcaatctctgagagaacttatgtatgggttgccaacagagataaccctctttccaagtctatcggaacattaaagatctcttacgctaacctcgtccttcttgatcattctggtactcttgtttggtcaacgaatctaacgagaacggtgaaatctccagtggtggcagagctgctcgataacggcaacttcgtgcttagagactccaaaggcaactatcaaaaccgattcttgtggcaaagctttgattatccggtggacacattactcccggagatgaaaattggtcgggatctcaaaacaggacacgagactttcctcagttcttggagaagcccttatgatccctcaagcggagacttctcgttcaaactcggaactcaagggctacctgagttttatcttttcaagaaagagtttctattgtaccgatccggtccgtggaatggagtcgggtttagtggcataccgacgatgcaaaactggagctactttgacgttgttaacaacttcatagagaacagaggggaagttgcttatagtttcaaagtcaccgaccatagcatgcactacgtgagatttacactgactaccgaaagattattacagatatccagatgggatacgacatcatcggaatggaacttgtttggcgttttaccgaccgagaaatgcgatttgtaccaaatatgtggtcgtgatagttattgtgacacgaaaacatcaccgacgtgtaactgtatcaaaggctttgttccaaagaatgtgacggcttgggctttgggagatacatttgagggatgtgtgaggaagtcacgactgaactgccacagagatgggttttttcttttgatgaagaggatgaagctgcctggtacaagcacagcaattgtggacaagacaattgggttgaatgaatgtaaggagaggtgttctaaggattgtaattgtaccgggtttgcgaataaggatatccaaaatggtgggtcgggttgtgtgatttggaccggaggagctcatggatatgaggaattacgtcgtcggaggtcaagatctatatgtcaaaataggcctctataattagacatgaaaattggatatcttgatatattttagaatattggaaattcatatgatccgtgctttatagatatctatatccactaaaaaatatttaagaataataatacaaaattaaaa

SEQ ID NO: 688 - DNA, 933 bp, Arabidopsis thaliana
tgtgtacattagcaaaaacaaacacccttggacgatagcaagaaaataaaaacaagccgcttctccctcactcactcctctaaaaccagaaacaaaaaggcaaagacgagagcttaattaatggcttccccgacgataagaaccgtcgcaagttacaacactcacctagagtactccgtcgatttctttggagacgagttcatcgtcaccgtaacgtgggattcttccgtcatcagccgttggattcgcaacgtcctcttcaacaaccgtttctcctctcaccctctcgtcgttggagttggcgtccagtggacaccgtttagttattactccgatccaagaccgaataactactacgccgatcctccgccgataagatactactcagataatccagcggatattctccagttatgcgtgggtaatcgatgtctcatcatccagttaggttactgtgaccaagtacctaacaacctccgcagtttcttagcagatccagaaaccacgttcgtcggtgtctggaatggtcaagatgcaggaaagcttgctcggtgttgccaccagttggagatcggagaacttctggacataaggcggtacgtgactgattcgtggggaaggagcatgaggcgttcttcgtttgaagagattgttgaggaatgtatgggctatcaaggagtgatgctagatccggagataagcatgagcgattggaccgcttacgatctagaccttgatcagattcttcaggcgtcactagatgcttacgtttgccatcagcttggtgtttggactcgtctctgggaagtttgaaaacaagtatcaaaatgaataaattgctacttggatttttctgtcttttgttgacaagtgacttgaatcttctttttgttttgttatgagaaaaaaattgtggtttgaatcttttcgttt

SEQ ID NO: 689 - DNA, 855 bp, Arabidopsis thaliana
atggcggaaagaggaggagaaagcggcgcagagcgtggcggtgaccgtggtgacttcgggcgtggattcggcggtggacgtggaggtggccgtggccgtgatcgtggtccaagaggccgtggaagacgtggaggccgtgcctcggaagaaacgaaatgggttccagtgaccaaactaggtcgtctagtggctgacaataaaataacgaagctagagcagatctatcttcattctctcccagtaaaggagtaccaaatcatagatcatcttgttggtcctacgttgaaagacgaggttatgaagatcatgcctgttcagaaacaaaccagagctggtcaaaggactagattcaaggcctttgttgttgttggtgatggaaatggtcatgttggtttgggtgtcaagtgttctaaggaagttgctactgccattagaggagctattattcttgctaagctatcagtggttccggtgaggagaggttattgggggaataagattgggaagccacacactgtgccttgtaaggttactggtaaatgtggttctgttactgtgagaatggttcctgctccgagaggttctggtattgttgctgctagggttcctaagaaggttcttcagttcgctggtattgatgatgtctttacttcttcaagaggatctaccaaaacccttggaaactttgtcaaggctacattcgattgcttacagaagacatatgggttccttacaccagagttctggaaagagactagattctccagatcgccgtaccaagagcacactgatttcctgtcgactaaggctgtttctgcaaccaaggttatcactgagggtgaagaccaagcttaa

SEQ ID NO: 690 - DNA, 961 bp, Arabidopsis thaliana
ctctcttctcttatctttttttttatatatttatatatcattttttgccatcttcttcttcaatctcgtaattcactttttctttgtggtttgattgattctttgaagcagcaaccaaagatgatgaacagctgtggaatccaacaaaacgcttttgaagagatgaggagaaacgccgccgtttctgatcggagagacgccgtgatttgtcctaaacctcgtcgtgttggtgctcttaatcaccactcttctcgatctctccgttggcaactcaagtaagatactttttgtaataaagttcaaaacttttttgaggcaaatcacttgaagcaatcagatttattggtttttgattttgtagtcatcagatggaattatgtgaatcgaattcaggaagtgagattttggatttcatcctcacaaaggtatatatatgattcaataacaacccttttgcttgttgatgattgtttgattgaattgatatctaaagtttagatttttatttgttatgtgatgatttttacagggtggtggtggtggtggtgagcaagatcagacgaggacggtgatgacgccacctctgttctttacagggtcacctccaagtagagtttctaacccattaacaaaagattcgctttttcgagaagagcttctcatggtggcttctccgagtccatcgactccacgagcaaccaaaccgcagccaccgtcttctccaaggaacggtagttgtgttatggcggcgacgagtttcgggaacaatcctgtggttcgtgttgtggggtttgattgtgacagacgcagcagcaacaggagcatttcgactcttgcataagagtagtccaatatgcatatatatataacagagagagtattaaaagaacaactaagaaaggtttaggtattgattatgtgggagggttttgttggtgaaaatgtgtaaatatgttgaaaa

SEQ ID NO: 691 - DNA, 1065 bp, Arabidopsis thaliana
gtctctgagcagagtttcatctttctatcaaactaaggttagttttcatttactcatcatttctctgtttctcattggtttcactaatttgttttgaaaactccagcaaaacggaccatcatgatctgcacggagtcaaaccaccagcggttttcgtttgctggtgatctcggccagtccgataaaggaactcctatggaacaacaaccatcaggcccggtccgaagagacaccactcttttggattcatcaaactcagatttcgagttccacatctcaagcaactttgatcctggagattcctcaccagctgacgagatatttgcggacggcatgatcctcccagttcttcctttccaagtcacagctacatccaccatgccaaaacgtctctacaaatatgagctccctcctattgtctctgctccaaccttatcctcttatcttcctcctctgcctttaccattgcctgaacactcaagaaaatacagcgtgaaagaaactcgaggaagcctaaatggacgagggagcggtgcaaattcggattcagaggcagagaaatcatcaaagtcgttttggagcttcaagagaagctcaagcctgaactgcgatataaagaagagtctgatctgttcgtttcctcgtttaacgagaagcaattccacaggatcagtggcgatttcgaagagggaaatgcttagggacattaacaagcatagctcgcagagacatggagtcccacgtccaggggtgaatccatcatctcatatgcgtcctccttcctctttctgctgcagctcgtatcagttcaggccacaaaaacacgccggaaagaatggtggcggaagaggaggaagtttttggattgctccggtgatcggtggtccatctccgtttgggttaggatccatcttacgacttacgaaagagaaaaaaaagaagtaataacagtttttgttttccttcccaaagtaggaccagtttaataccagactcttttaaccaactctttgtttcattttgtaacgcatgagattatgcaactaatgcgaaattttgttagtc

SEQ ID NO: 692 - DNA, 1248 bp, Arabidopsis thaliana
gtttaggtcgatcgattttgaaaatggtatagagcttcgtttatttgtgagaacgaccaagctttttctattgtgatgttatggtataatgatatgcatagaattctacgtgaaccaggaatggatcaatatgggattccagtagagagaaaagagatgaagcataaggggagaaatgttatatggtctgttggaatggataagtgtttgattgaagctttggctgtccaggccaaaaacgggaacaaagttgacaaatgttttaacgataaggcttacactgctgcttgtgttgcggttaatactcgtttcaatcttaacttgactagccagaaagccatcaatcgcctcaagacgatcaagaaaaggtacagagttatgagagacatacttagccgggatggattctggtggaactcgagcacaaaaatgatcgattgcgaaagtgatgagctctggagaagatatattgctgtaagtcccattatcccttctcttttactaagagatcatccttcttttgtgcatcattatcaaacttaaaaatggttggaataggtaaacccagacgcaaaagcatttaggggaaagcaaattgagatgtacgaagaacttagaacagtatgcggtgactatcaaactccaggtaaatataacaaagtgaagaaggaaagcagtcatcatcttaatgacgtaaaacaatttgaagaagactctgtttccttccctttaggaagttctgaagaacatagcgatacagatggaacagagtcatacgcaggagcaagtgagtatatgcatgaagagtctcaagatcttcctcctcctcgagatcctttaagacgaccttctaaacgttctcgaaactcggatccttgtcaagaagcaatgttagtggttgcttctagcattcgccgcctagctgatgcagtggttcaaagcaaaactttgattaacacagaggaattgttgaaagcagtgatggagattgatgaattggaagaagcaaaacagatgtatgcgtttgagtatctgaatggtgatccagtcaaagctagagctttcatggcttataataataggatgaggaagatgtttttgtttcgacagttttggtggtggaagtaaaaaaattgatttgctgctatggctaaaagaatcctcctcttcttttggggtaatgtagagtcttgttaatgttaaaagctggaaatatttgttgaggccaatttgattttgttgtgaatt

SEQ ID NO: 693 - DNA, 729 bp, Arabidopsis thaliana
tacacgacacgcgctacgactgagtgtaaggattctcataaactgctctattttattttgctcagtcgcagacaaatctcaaaacagattcgatcgataagcaagaacttccaatctctaatggcagatcaaacagaatctccaagatcgtatcatatcttcatcacaatcatgagtaaaagacggacatgggtttgtctcttcatcgctgtctacgcaattctcgtatcttcttcatggaacctcctgagatcagttcttaactggtacaagcttcaatacacgtcatcaaattcagattattctccttcaagattaccggcggtatacgcgtcggtggtgctcggtgcgatgtttggagctatgtcgatggtggctgctatgacggtggcggttccggcggtgatggtgatttggatatcggtggtggtgttgcttgccttctttgggaaatcaagaagagttttagtggttgaaggaaggaagattacgagagaagttgtcggatttgtgtttaaggttcttttgaaagaaggcaatgttgttgctgctttttgtgctgttttagcttattttctgcttattagaagagattttgactcatattaaggttcttgatttttagattatttagggaattttgatctagattatcttgagtcactcccgaatgtaaatgtaaagttaatttagaaaatcaattgttagtagtagaatgaagaagttcat

SEQ ID NO: 694 - DNA, 1695 bp, Arabidopsis thaliana
caaaaccaggtctcttctctttgggattttttttcattggaattgagcatacacatgtgttttccgaatagtttttggagtgagaattaagtttggattgttgattctcttcctctggtcatggaggagccttgtgagacacttgacagtggtgaagcctatcaaatatctagatatcataactataaccaacacagctccagaagctcatctccctggttggatttgagagtgttctatgtccggataagcaatttcgtggtggaagattcaactcctgaggtcctcactatcaatcacattcctctggatccagatacgcttttggagattaacggtgttagaatgggaatgtactcagaaggaggttcttcacagcttaggagagatcgggttgataagaaatctgaagaagctacttatgtcagcacagacaatatcaggttaactggtagtgtgaagtttgaggtttatgacaaaaatgagctagttttgtctggaactcttgagatgtctggtagtaatggtttcactggggaatcaaagaatcgatggaaaatgaattgtgaggctgaggtcactgcagggtctggtttccttaaggagaagagcataaacggtcaagagttatcgtctccattgccaactatcgaggtctatgttactggttgcttctcaggaacacccatcatcttaaccaagactctgcaacttggtttgaaaaagaagcagagtagaagaatggcattggatgcaattcctgagtatgaaactgcagagcctcagaaagacacctcctatgcacttgatcttcaggtaactttcaagttgtcatatgccatgatctaaattcgttctttcattgttctaagatatagcatatgcgtgataaaaccctctttcttcgcaatgctcacagttttcttgaatattttgtttgtgttcaacacattaattactatccctgatgaaaaacttataagtcataaaatgttgtgatggtttttggatcctcttctttccccattgaatgaatacatgtttgttggtagttttatgaagataaaagtccttaataaattgaagtggaccagtctcctccttataaatttggcatgtggcctagacacagtttacgaatgaagagataaataggaatctctcatttgcctcctttatctttaagctcttatccttttgtctgctgcttctatgacccacatatgttggtcacttacaatcccccaatatttgctttggtgtaatgttatgatttgaagtttgttctattcttcggagatagaccattttaaatttcatcattctctgtatagtaattatcattccttttgtctgtaggcaacaacagagtacgggaattacaaagaggaatacgaaggagacatgtattggagaagtgagtgcattgatggggagatgtcatggtttaatgcaggtgtaagggttggtgttgggataggacttggtgtctgtgttggtcttgggattggtgtcggtcttctcgttcgtacttatcaatcaactaccagaaccttcaggaggaggcttctctagtttagtaatatatacatttgcacctcttttttttaccttgcaattttgaaagaattctctttttttgtatttgggtgtgatgtgaatcaaacactttggtgtgtggatatgatggtacta

SEQ ID NO: 695 - DNA, 1725 bp, Arabidopsis thaliana
ctgttcttcacatttctttgaaggttttcttagtctataaagttgtacatcataataatctgtggtttgatgatattgttttaagacagtcttgttgttgctctttatcaggtgtgcaaaatgattggatcgtttctaacaagaggactagtgtaagactctaatctcttcattttgaggttctaaagtattagtttgatcaaagaatttacggattttgtttgtgtttcatttgttggcagaatggtatttggatatgcgtatcctgcttatgaatgttacaaagcggttgaaaagaataagcctgagatgcaacagcttcgattctggtgccaatactggtttgtgatgtttggctttttcatctgttcttatcttgagtttatgccttgagttttctcttgtaaagtttagctttcttcttgaaacttgttgcaggattttggtggctgctttgacaattttcgaaagagttggcgatgctcttgcttcatggttggtattattgatacaggaatgtacctttcaaatgaattgagatatattatgtagacttactttgtttgtgtcctgttgtcatgaagggttccactatactgtgaggcaaaactggcatttttcatatatctttggttccccaagaccagagtaagtaaactctagtagcagctaaaagagagttagttagtatctgtatatatgtgatccattggagttcgttctatctcactgcactttcctttctttccacagggaactacatacgtgtacgattcattctttcagccatatgttgcaaagcatgaaaatgaaatcgaccgcagcttgattgagctaaggaccaaagctggggatctggcagtgatatactgcagaaaagcagtgagctatggacaaacaagaatcgtagagatcctgcattttgtagctctccagtcaacaccaaaacctaagcctaaggtaatattatgcacctaacaaataccatgaaatgctaatcatggatctttcgcttttcaacttcttacatgctcactagaggatcatttaacaagtttctccttgcacaatagtgatattgtttgatggatttgtcttgattctaattttcattaggaaaagaagcaggcagcagcaccagaagaggaagaacagaaacaaccggatcttaaggcgacgagccaagcagcttcttctaatcctcaagtgcgtctgcaatcgaagaaaccacagcttgtaaccaaagaacctatatcaccaaagcctctttcatccccacgtaagcaacaacaactacaaacagagaccaaggaagcaaaagcaagcgtgtcacaaaccaaactcactactctaactccaccaggaccaccaccaccaccaccaccaccgccaccatcgcccacaaccgccgcgaaacgaaacgctgatccagcacagccatcaccaacagaggcagaagaagcgtcacagactgtcgcagctttaccagaaccagcgtctgagattcagcgagcgtcatcgtcgaaagagactataatggaggaaacactaaggatcactcgtgggagtctgagaaaagctcgttctgcgggagcaccgcgctaagagaatgattaaaaaagaaaaggggaacacataattttaaatctctaaccccttttgattggtttctctttaaaacagcaataatggtttttatttggttatttgttgtttttagtccga

SEQ ID NO: 696 - DNA, 1841 bp, Arabidopsis thaliana
gtaaccaagaaaataagtaacggcttcttcgatcatttatatgtttatcctaaactaataagaaagcttgtgataatttcagtgttctcactctcatctccaatctgtgatatatttctcatgtctcatcagacagtagcgctagcctctaaggctaagtctcctaaacccaaaagtaaagtgttcacgacccatttagcatgcccacatgtatcatttgagcatggctccaatttttcaaattaatttagaaaatttaaatatgcatataacttggttgatatatatacatataagaataacaaagtatgcataagatttacgtataggttgaaaaggtccttatatattttttcttttaaattcttaacatttttggaatgtttttttgtttttgtttttgtgagtcgaaaaagggtctatgcatggaaacatatttgtgggattatgttgtttatgtaggaggaaagttagataaggaaaaaatgactgcattggagaaacatgtttccttcttcgacaggaacaaagacggcaccgtttatccatgggaaacctaccaaggtacgttacatacacaattagctaagtgttgaaaaacttttgacaaaataaatgttaagtaataatatattaacgagattttgatatattattctggttaactttacaaacatatttaattcgttgatgtatgtatatggaaaaaaggatttagagcgctcgggacagggcgtcttttggcggcttttgttgctatattcatcaacatgggactcagcaagaaaactcgtccggtaccaattataacacttcgctttccttttcgtttttttccttctccactcttggttttgcattgcgattaagcatatgtgaaaaaatttaacggctaaaccgatatattaagaaagcaagaaggaaatgtgaatgagtatttaattagttggttgattagtttttgtttctaggtttaattatgcaaacaatctatatatatatatatgttaaactatgcggatatattttaccattgttttttgaagccatagtgattggtgattagggaaagggattctcgccgttgtttccaatagacgtgaagaatagtcacctttgcatgcacggtagtgacaccgacgtctatgacgatgacggaaggttttttttcatctcttccttggcatctttttcttttgttaatgtaataatgtacatgtgtgtgtttttgtacgtaattacaaaatccaactttacaaaagtgtagttacttatcgcctaaattttacagatttgtggaatcaaaattcgaggaaatattcaacaagcatgctcgcacacataaagatgctctcactgcagaggaaattcaaaaaatgcttaagactaacagggatcctttcgatatcacaggatggttcgttgtttctgaattatttcaaacgaattaaattatagtcacaacgtaacgtatcattccgattttcgtaaaaaacaatatacatatggcacgatgcttatacggttatacctaagtattatctctgtacaggctttcagattatggagaatggaaaatattacatacgttagctcaagacaaaaatggtttgttatcggaaaagagcgtcagggccatctacgatggtagccttttccaccaactggagaaaaaaagatcttcttcttcttctcgtggcaagaaacaaaaactaccataaatgtttacatgaatcttcttatattattatgtggagatcacataacattcttggtttataattatataattttgtcaaataacttttgtaatgaataattacatagatcaaacactcttt

SEQ ID NO: 697 - DNA, 2111 bp, Arabidopsis thaliana
ttaagtgactccttctctctccttttttttggggtatgcaccaacctttatttataagtataagcaagaataaataagaacaacaaagcaaacggctcatttctcagaaacaactcaaacatgggttccttcgacttgcctcacagttcatcgttcaaggttctttctcaaatttatattttttttgaaggagaaatatcttttgttacgataatacacaatctgcatctaacagggagaaagtgaaatatttcttcggaatgtgttcgagaatatattgaaaacgtacctaaggaagaacccgacggcgaagacaatatgggaactggttcagtcgttggacaacgaaaagatctgctacgaccacttcactttcaggacactaaaggtaataattttactcttcaagatttggtgaaactaattgtttaaattattattttgtttttacttttttttctttggggttatgagtttaggtcgatggttatggaatagactccttgtcgagttttttcatggcttatggatataaaattggtggtggacttgattttcccaagaagaaactacgagttctttggttttctccacctgatgttcacgttcctaatgatggtcacggtctaggcaacggccctttgccgcgacttgttatagctgaggttcttgtggacgaactaagccctgaatcacaggtatatatgttgatcgcagacacaaaaatttcattatgagtttttaacatatctaatttcgcttttgttggtcctatatattgattaggggataataaggaagtatttgaaacaagaaggtggcaagcaagcggttctttctagtactttggggtctttaatatgggagaagcctacatggaccgacttcaagcagcttgccaagtatatatattaactttcaattaatagtcatatatctttacttgataaatttcagaaaagtaattcattctatcaaaatctaacagctagctaattgtaaatacattaatttattttaaataaataaaaatgaatactcttacacgaactatactgtattactctactagtacatatttagtaactaactatttattaaataagattttgggtgataggttcgatggtattaaggacaagttttgatgaacaagtacaaaaaaatggtagtttctaacaaagctttgagaaattgatagatcagcacttaaacagaaaaaaaaatgatagatgaacactatttttttctgaaatgtttataaaaaaagaagaagaagtaagaattgagttttgtttttgtttttaaatttttttattttataactattttaatggttagagctaattatttggaattgtatgtatgaatgatgcagagaaagcgaatttgcggcatggacgcttatccacggctacacaatgaatcatcttgcttttgcggttcatcgattcaaacatcgtttcagtgacatcaaattcgtcaaacagcgtcttgaggaaaagggattcaaactcaacagtgacggagaaatcctcaaaggttttttaatacttatattcccatcatgagttactttcttgaaacgtttctatttaaatatgttgttcaatagaaatgattaatgaatgtggacatacatattgcagtgagtcaagatggtctactatttcaagtttcatcgatctcggaaaggcttccggtaacatttgcagatggagtaactgaaacaatcccagcttcatacattgaattcactcagcgtcaagttcttccagagttcaaagatgtgccgcttgatgaggtaattgatgtaagaaagaatcgcgaaataaatgatttgcattttttcgcattattttgtttattcagaatttttttcattgccatgcactgtgatgcagatcaaagaatttcatagacgtgaagcttttgaactcgataacgccaaccacgtaatggaaagcacccgtttcacaactaaattctagaaccagacttgtcttgctcgacttagtatatgccaaatttgtgcaactatatatgtgagtgtgtgtttgtgtgcaatctttccatatatatgcatgtgtgtatttgcgatatctttatgt

SEQ ID NO: 698 - DNA, 1110 bp, Arabidopsis thaliana
ccaatcaacaatcctcttcacatttctattttctcctccgaggtcgtctctcgaccaaaccacaaaaaccagaacaaaaataactaaaaaacaatcagatctgagatcgaacaaaacaacatgaacacgttaatcccatcggagaaaagatggatcatcaccggcgttttactagccggtttagttggcggtgctttgcttttcacaagcttcatacgagccgctgacgaaacgctcttcctctgttccacagcaagcgccaaaagcagagcggtggctgcggcagctgattacgaagcgactccgattcagcttcaagcgatcgtccactacgcgacatctaacgttgtcccacaacagaatcttgctgagatctcgatctctttcaacatcttgaaaaagctagctccggctaactttctcgtgttcggtctcggtcgtgactcgctcatgtgggcttctttaaatccacgtggcaaaaccttgttcttggaagaagatcttgaatggtttcagaaagtgaccaaagactctcctttcttacgtgcgcatcacgtgcgttacaggacgcagcttcaacaagccgattcgcttctacgttcgtacaaaacggagcctaagtgttttccggcgaaatcttatctccggggaaacgagaagtgtaagctagctctcacgggactgcccgatgagttctacgatacagagtgggatctgctgatggtcgatgctcctaaaggttacttcgcagaagctccgggaagaatggcggcgattttctcggcggctgttatggctaggaaccggaagaaaccgggagttacgcacgtgttcttgcacgatgttaatcggagggtggagaagacttttgccgaggagtttttatgccggaagtatagagtcaacgccgccgggaggttatggcattttgctattcctccggcggctgcgaacgctacgattgactctggtgattataggttttgctaagattgcgacacgatttatcttcttatttcctcttttgcccttttattttacttttttgaggaattttattacagcattgggttcacttattatctgatttagtgccgacagttttggatc

SEQ ID NO: 699 - DNA, 1416 bp, Arabidopsis thaliana
aaattgggatgacttgagtttggtgttacatccaaatccggttatatataggttaaattgttgtgtgcgaatcaacagagagagagaaaagggcacataaaataggtgagtctcctaaacatgccttccttcaactcctccggcaatctcgcggtggccgttgctcttctctttgcgggcgccttatatttctatttctcatcaattacggtttctgatcctatgtccgatctactacacaatgtcgaaactgtaagttactttataatagaatcggaatttgagagtaaatataggaagattttaaatgttttgtgttaaatagagatggacagagtatcctgtggacgagctagaggcggtcctagacaaggcagcaatgggaaacaacaaaacggtgattatagcaatggtgaacaaagcttacgtggaggaggttgaaggagggaggacaatgctggatctgtttttggagagtttttgggaaggagagggtactcggccgcttcttgaccatctgatgctagtggcagcggatcagacttcctacgatcgttgcctcttcaggaggctccactgctacaagatggataccgatggggttgacttggagggagagaaggtatatatgtcaaaagatttcattgagatgatgtggcggaggactcacttgctcctagacgtcctcagccgcggctacaatcttactttcacggttaggtccgtcccttggttttggaatgtataacaaaacacctaatttgtttctctataagtagtgtatgtatatgtcaggacacggacgtgatgtggctaaggagcccttttccccgactaagctacaacgagagcttggatatgcagataagcgtggacagtattggcctggttggaggacacttgatcaacacgggattctaccacgtcaggtccaacaacaagaccatctccctcttccagaaatggtacgacatgaggctcaagtcgacgggcatgaaggaacaagatgtccttaagagtctcctagactctggtttctttaaccagcttggcctcaacgttggcttcctcaacactaccgaattcagtggcttctgccaagacagccatgacatgggcgttgtcaccaccgtccatgccaactgttgccgccacatccttgctaagatctctgatctaactcttgttcttcgtgactggaaacgctacaaagcctcccatgtcaacagcaattggagcccccatgttgagtgcgggcgttcatggagtgacactcactatatccccaagctctgaccttcttcgttcatatatgccaattaatgagattgctatagtatacacaacttcatcatctattaactgcatatgttcttcagattaatcctagctagctagaggaacaattctcttttg

SEQ ID NO: 700 - DNA, 663 bp, Arabidopsis thaliana
catttctcttcttcttcttactgttttctccaatccaattctaatcttaattcttcataaaccctaactttattaatcccttttttagtttcatctttaaaaacatttgttttcttgaaaatgtcggaagaattcgacgaatctgagatcattttctctgacaattactttccgattcgccggcgagaagacggtaacgagaaagagaataaccgtccggtggatttccgggaaaattctgagagagtgtggaacaagtcatctagacggagtaaaacgacgccgttgccttcagcggtgacggcgttttctagttcgcttccggttaacataccgatgaggaggtattcgacggaggaggaatattccgatgacgacggaggaaggaaaatgattccgccgcatttgatagttggacggaggatggaaggaggtcaaatggcgttttccgtttgtacaggtaacggaagaactcttaaaggacgagatctgagccgggttcgtaattcggttctcaaattaaccgggtttttggaagcttgaaattggattaaaccggactggttttggattttgattaatttttttcgatcttccaatttttttttttttgtttttagtcgaagaagtaatcagcggttctcgtaattgttttttttttag

SEQ ID NO: 701 - DNA, 2546 bp, Arabidopsis thaliana
taaattgcttttaggttctcattatatcatttctctttaacttcgcaaacttctcctcgataaaatttctctctctaaaaaaaaacaattagaatcttgccttttacagagtaacactacatgccgacaatggggaataagaattcgatgtgtgggttaaaaaggtaataataattggtatcaaacgaatcttgcttgctacgttggtttctatatatacaagtatttgtaactcttgtagatagacatatgaatatataacttatatgtgttgttgtgtatatcatcaataggtttccgaactacaagaagtctccgatcggttcatttgcgaaaaactcatcatctcacgacggtattaaaacaatcgaagctgttaacagttgcagtttttctagaaaagcagatctttgcatccgtatcatcacatggaacatgaatggaaatgtacgtacgtatatgtaccacatattcatctaattctgccatatgaaaaatcctccttcataagtagattcaactatgttactaaatgtactatattaatacatgtgaaggtttcgtatgaggatttagttgagcttgttggcaaagaaaggaagttcgatttgcttgtcgttggcttgcaagaagctcccaaagcaaacgttgatcaacttttgcagacagcttcatctccaactcacgagtaagtaataactgtttatttctacttatatccataataactatactctactgtttatttctacttatatccataataactaatataccaaaaatttgtcttatcttcatgtaattttaacattgcaaattaaagttctatatcgaattgaaatgcaggcttcttgggaaggcgaaattgcaatcggtccagttatatttgtttgggccaaagaattcacatacattagtaaaaggtcagatttttataaatttttgtttacttcattttaaatttactgtatttgatattctatgaaaatttgttatattaatacttttaccaatttggatctaaggttaaatttttcattcatacaaatatttattttaaattttttacaacacttaatttgaaacaaaagaagtattttggaaactaagaataataattttgtttattgtatgattaattgcagaattaaaggcagagagatattcggtaggaggatgtggaggtttaataggaagaaaaaaaggagccgtggctattcgtattaactacgatgacatcaaaatggtttttatctcttgccatctctctggtacctatttttattttttggtctaatttctactctttttcgtaatttacaattaattagaattacaaataattattagtataatcatgcagctcatgcaaaaaaagtggatcaaagaaatacggagttaagacacatagcaaattcactattaccaagagacaaaaggaaacgtgaccttactgtttggctaggagatctaaattacaggatccaagatgtctctaaccatcctgttcgatctcttatccaaaaccatcttcaatctgtaagtcatttcttcttcttcttcttcttctccaaataacaagaatagaaataacaaataacaactattaaaggaaaaaagtagaagaaaattaataaaaatatcatttactctgttttgtttaaaaaaatatatcttgtttttttgttttcttttcaaaatcttgaattaaattaagtacattaattcattaaggttaatgtacttaatgagttagccttataaaatactattctaatatatgtaaaaggaataaggtcaaaataaaaccgagtaataatatgagacaaaaataagttgtcaaattaccttataaaaaagaatggagtgctttaacaaaagaaaaaagaagacgaatggagtgagtatactctcttcaagtatatgtaatttaagacaataagtttttagaatatttttattcggtttcattttttccggttgcataaatattggttttgatttagcaaaatggactattaccaatcgattataaaaaaaaaaaaatgttttctattttatacaactttggtactcagttaggtttgctaatcactcttaatcctattggttttcatcactttgtgcaggttcttgtgagtaaagatcaactcttgcaagaagcggagagaggcgaaatattcaaaggttactctgaaggaactttagggtttaaaccaacctacaagtacaatgtaggaagcagcgactatgatacaagccataagatcagggttccagcttggacagataggatcttattcaagatccaagatactgataatattcaagcaactcttcactcttatgattccatagaccaagtatatggttctgatcataagcctgtcaaagcggatctttgcttgaagtgggtcaacagttaaataaatgcatacaatttaatatgaaggataatatggtatatatgaacggattattactattttgagattatatagttcaaacactttgagttctttattaatgtttttgaatgtaagaaa

SEQ ID NO: 702 - DNA, 852 bp, Arabidopsis thaliana
cttatagcaaaatctctaataattgattatatgaattaatggttaaattttatagtaattaaacttgaattaatcagtgattaatttagagattaaagaagagggtgaagttgttgttgcatggcaaaaggtcgaaagccgacgacaatgaaccggagcgatcgataccttggaagctacacttacggtgacagtcacggaaactccgttaccgacgaattagagctcggtgaggaagacatctggtcaccggccgtcattcacgacgacaccaccgagaatgaggaatcctacggcacgtggaacttacgcgctaccttgggaaaaaacgggcgcgtgggaggattgtcgctggctttcgagggctctttggttgctccgccgtcgtcttcgccgatgatagtgcagaagattcacggcggaggaggtgagggagaggaagaccggagaaaattggcgtcttcggcgccggtaaacgtaccggactggagtaagatataccgagttgactcggttgagtcaatacacgagttagacgacgaggatgacgaggatgaggaatccgggatgatgccgccgcatgagtaccttgctaagagtcaagcacggcggagtagaaagatcggaggtggtggtgcgtcggtgtttgacggcgtcggaaggactctcaaaggcagagaactaaggcgcgttcgtgacgcgatttggagccaaacagggttctacggctaagtataattaacaaaactaaaaaaaaaaacattttagatttcaattaaaattacttgtttttgccagtatagaagtaatttttgtgattatgcaaatttttaattttgagttttattatga

SEQ ID NO: 703 - DNA, 1481 bp, Arabidopsis thaliana
tactagtttttttcatgatcaaatacttctttgagctacttgtgattctctttacatgatctttatgtagaagataagtattgctgtgttttaattagttaggtacttgttttcaggtcaatggcctcttcttcggatccatggatgagagagtacaatgaggctttgaaactctctgaggatattaatggcatgatgtctgaaaggaatgcctccgggttaaccgggcctgatgctcaacgtcgtgcctctgcaattcgaagaaagatcaccattttggggactcgattagacagtctgcaatcccttcttgtcaaggttcctggcaagcagcatgtgtaagccattctgattctggttgcctgttcaaactcctcatgttagacaacgctaagtttcatgttggtcttgaactatgtaattatggtttatgtgtatgcaatttgctgataaacagttcggagaaagagatgaatcgtcgcaaggatatggttgggaatttgagatcaaaaacaaatcaggtggcctctgctttgaatatgtcaaactttgcaaacagagacagcttgtttggaacagatttaaagccggatgatgcgataaatagagtctctggcatggacaaccaaggaattgttgtatttcaacggcaagttatgagaggtaagatgtggtatgtaacactgttctaggaccatagtaatgatcttggcgtctgtattaatttctctttgattgtattttatttccatgagtagaacaagacgagggacttgagaagttggaggaaacagtcatgagtaccaaacacattgctctcgctgttaacgaggagctcaccctgcagacaaggcttattgtatgtctccgctgttgttcattgcttttcttgttgattttgatttcttattctaacgaaatgggactttcttccatgcaggatgacttagattacgatgtggatatcactgactctcgcttacgggtaagtatatgcttcgaacaaattagtctcattagtcactagcttaagctggtccattgataagctaaagaacaataggaaggcaagcaagtgattttaacaatatactggtctattatgtctaagaatctctcggtcgttgctttttttttttatcataaaaagcaataattttttagtttaatgtgattcacatctcgtcttggatttgatgtagcctgtttgtgtttcttgatgattgcagcgtgttcaaaagagccttgccttgatgaacaagagcatgaaaagtggttgctcatgcatgtctatgctcttgtctgtgcttggaatcgttggtcttgctcttgtaatttggctgctggttaagtacctgtaatgccaatgtggtggcaacttgtgaaagctcatccttttctctcagcctatcctctgtgcttaatggttgttttctattccttctatcgattgattcgtgtctgtgaggcaaagaagaata

SEQ ID NO: 704 - DNA, 817 bp, Arabidopsis thaliana
gaattcagatgatagtagagttatcagctccgttctcttgatgaagcagaatctggttgcagttgacattttacttaaccagatgagagataggaacataaagctggattcttttgttgtttcagcaatcatagaaacaaactgtgaccgttgtagaacagagggggcttcgttggcttttgattacagcttggaaatgggaattcatctcaagaagtcagcgtatctcgcgttaattggtaactttctgagatcaaacgagcttcctaaagtgattgaagtggtcaaggagatggtgaaagcccaacactcgcttggttgttaccaaggagctatgttgatccacaggctcgggtttgggagaagacctcgtttagccgcagacgttttcgacttacttccggatgatcaaaagggtgtagctgcttacactgcgctgatggatgtttatatctcagcagggagtccagagaaagcaatgaagatattacgagagatgagagagcgagagataatgccttctttggggacatacgatgttctattgtctggccttgagaaaactagtgatttccagaaggaagtggcgttgttgaggaaggagaagaagagtcttgttgcttctgcacgtttccgagaaaatgttcatgttgaagacaaaatatgtgatcttctctttgctacaaatctgttgtaatctggttgcaggtgaaagtcaacatgtacatgtttaatctaggcccattaaatatgaggcctatactgtttttaagcccattactcatcattttttattattatatttaatttaatttct

SEQ ID NO: 705 - DNA, 1148 bp, Arabidopsis thaliana
caaccaaaccaaggatcaacagtaagcagccaaatcctaaacgaagcaacacaatgtgtagagagcatcaatggtgtgaaagaaggaagatggaaagcaacactcaactattacaaacccatgttaaaagaccaagcgaatcaattggagtttcctcgtgattttctagggatttcacttgcggatcagccgaataagtactatttcattatcaggacgcagaggattgtcttggaagctgattcttcgattcagttgattatggagaagcttcagtcttataaatctaaagtggctctttactttgatgggtttcagtatcagcttggtgattttaggttgagagttggtaaagttgttcctactcattctgagaatgttagaggcattgtcatggaggtaaacaaagtttccagctttttcttgtttaagacagatatgatgaacactgaacagtggtgattaattttaaagatgaaaatcttgtttttctacagatttttcttgttaaaagagtttcttgtaatatcttttagtgatgatccttgatgctgtttatgatgttaagacagatgatgaaaattgaacattgttgattgttgactatgcatctacaagtttctttagtcttgtttcgtgtaatcacaatgatgatgaaaaaatccttgttttcttaaatccctatagtctcaatgctaatctaatcacctaaagggtatatggagctgttcccttttggtgattgtcttgtttcttgtaatctcaattttgagtttgtgtgttgttacttgcaggtggagtatcttcctatatcatcaatggaaaaggcacaaaaggtgatggaggagttcttggagatatggaatgaagctctggctaaaaggtcgttgccgggtaagtttgtgaacatagatctcaactttggggagtttggacttggagacatctacactccacaacacacagctgttcgttacgctctcgtgatggctcacatgattgctaccgttcaagctgtgagaggctaaaccaaaacataacttagtatttctaggtaaaattatgtgctttgcaatattagtgatttctttctttggtcatgtttatctataagaagcattgagaaaaaatgaacttataaaagactt

SEQ ID NO: 706 - DNA, 468 bp, Arabidopsis thaliana
ctagttcgatggccaattttgtgcaatttctttggacaataattatttacgtctccaaatatattgtcttcacacacaaggaagaaaaaaaaaaagaagctaaacttaaattcaagaaatatgtcaggaaatatgtcgaagagtgaagagaaacaagagttgccactagaaacaagtccgtatacaaagtacgaggatatagaggattacaagaagaatgcttatggaacttccggtcaccaggacgttaagcctggccacggcggcggcacaaccgacgcaccgaccccctccggtgatgctgctccctccgccatagattccgctaaccaaaaagctaagaagtgaaccactcacaaaatgtttctcttgattctgttttagttactctccaatgtgattcatttgacgcattgtgataattgacatgtttttgttttttctccttttctccattgatatgatcca

SEQ ID NO: 707 - DNA, 1678 bp, Arabidopsis thaliana
aaataaaaatagtcacaaatctccgttattaatttttgccataagcttgagaacacttgaaaagacaagattcgcgagttcttcgttctgcctttttttttttttttgtgtgttcgagagatgtctgcctttgaagacgattccttcgtcatactcaacgatgatgcgtctgagtctgttccagtctcaggctcttttgacgccactgattctttctcagctttcgacggctcactccaagtcgaggactccgtcgacgatgtttttgcagcgccgtcttctgactacggtgcttactccaacggtgacggcatcttcggatccaacggggatcacgacggtcctatcttgccaccaccgtcggagatggaatcagatgagggatttgctcttagagaatggagaaggttagatctactcaaagttttgatctttgttgctttttgtttacttcttcctgaagaaaatcgataaagtggataaatttagttgagaatctctttgataatctgagaatttcaattttgaattttgattcacaatttttgtgaattgaagttatctgctagttagtgtccattgttctcagaagtaatcagtttattagattggatctgttacttttgcttagagtttattgctcaaatcgtgtgttctagaataacatcttgatccgtaagcttgtaatgcttgttgagttgattaagatgtatagatctgatttcgtgctatggctttattatgtttatgtgtagacaaaatgcaattcaacttgaggagaaggagaagagagaaaaggaattgttgaagcaaattattgaggaagctgatcaatacaaagaagagtttcataagaagattgaagtaacttgtgaaaacaacaaagcagctaacagagagaaggaaaaggtttgttcttttgctaaaagatttgaattttttatcatcttttctcaatctgtgttgttgtcatgtggtttgtggagaattgtcaatgcaagtcaatggcttgttgatattaaaattttcaaactttgaccatcttagtcttaagtcaactgtgattgattatcttaatgcattgtcagttttgagattatcttaatacattgattatcttcattacgtgtgtgatctttgatacctttttatctgcatattgcattgttacagtgttgattaaactttcacttatgtgtttatttgtctttgaacacttaagctgtatctggagaaccaagagaagttctacgcggaatccagcaagaattactggaaggcaatagcagagctagttcctaaagaagttccaacaatagagaaaaggagaggaaaaaaagagcaacaagatcctaagaagccaacagtctctgtgattcaaggtccaaagcccggtaagccaaccgatctaacaagaatgagacaaatattggtgaagctcaaacacaacccaccttctcacctgaaactcacttctcaacctccatcggaggaggcggctgctcctccaaagaatgttcccgaaaccaagcccactgaggcagttactgctgcttaaaaacctcctttgttttcttattcgttgcttacatctgtgtgaattcagtctttgcatttcattatgtgttataaacagctgagagattttatggttcatgtgtgttattaacataattat

SEQ ID NO: 708 - DNA, 2636 bp, Arabidopsis thaliana
tccattttattcactcaatctttgtttggtataaaatctatatatatatataacatatgctttgcgtgtatcatagaaaactatactataatttgcatatttcaaaaaatgttgaccaaaatgtctctccctatcccgccgaaatttcttccaccgctaaaatctccaccgattcatcatcaccaaactccgccaccgcttgcacctccacgagccgcaatatcaatatctataccagacaccggtttaggacgtaccggtaccatcctcgacgagtccacgtcttcagctttccgtgattaccaatctttattcgtgtcacaacgttccgagactatcgaaccggtcgtaattaaaccaatcgaaggttcaataccggttaacttcccttccggtacatactacttagccggtccaggactatttactgacgaccatggctcaacggttcatcctttagacggtcacggttatctccgtgcgtttcacatcgacggtaacaaacggaaagccactttcacggcgaagtacgttaaaacggaagctaaaaaagaagagcacgatcctgtaactgacacgtggcggttcactcatagaggtcctttctcggtgttgaaaggagggaagagatttggaaacacgaaagtgatgaaaaacgtggctaatactagcgttttgaaatgggctgggcgattgctttgtttatgggaaggtggtgaaccgtacgagattgaatctggatcgttggataccgtcggaagatttaacgtcgagaacaacggttgtgaatcttgtgatgatgatgattcttccgacagagatttatctggtcatgatatatgggacacagccgcagatttgttgaaacccatacttcaaggtaatgtttatgttaaagtagtaaagttaaaataacttaaagtatgtagtcctttattcagacagcggcgtaaaattaattaatgcaacaaaactatatagtaaaactttttattcaaatatgtaggtgtatttaagatgccaccgaaacggttcttgtcacattacaaagtcgacggtcgaagaaaaagacttttaacggtcacttgcaacgctgaagatatgcttttacctcgaagcaacttcacattttgtggtaaataatcttttaattctttaaaaacattatgaaaatagtattttattattattgtagttgtaatggcaattaactatttacagagtatgattcggaattcaagttgatacaaacgaaagaattcaagatcgatgatcatatgatgattcatgattgggcattcacggatactcactacatactctttgccaaccgagtcaagcttaatccaataggtaaagttatcttgatagtaataagttctgtttcaagtcatttacgtacacgaagaataatacttgcgttacaagaaatctgatgatgtaaaatatacacacgcaggttccatagcggctatgtgcggaatgtcaccaatggtatcagcgttatcgttaaacccaagcaacgagagttctccgatttatattctccctaggttttctgataaatattctaggggaggtcgagactggagagttcctgtcgaagtgtcttctcaattatggctaatacactccggaaacgcttatgagactagagaggataacggcgatttaaagattcagatacaagcttccgcttgttcttaccgatggttcgatttccagaaaatgtttggtaagttaagaagtcaccaaatacaaacctatataagactatttcgaaataacctctttcacaagttagggcttttagggtgttcaaacgacagctattgaacattttttcaaaaaaattcttataggctatgattggcaaagcaacaagctggatccttctgttatgaatctaaaccgtggcgacgacaaactactccctcatctagttaaggtgtctatgactttggactctaccggaaactgcaatagttgtgatgtagagcctctaaacgggtggaacaagccgtcagattttccggttataaactcatcctggtccggaaaaaagaacaagtacatgtactctgctgcctcgtcgggaactcgaagtgaacttccccattttccattcgacatggtcgtgaaatttgacttagactcaaacctcgtccgtacttggtctaccggagctagaagattcgttggtgagcccatgtttgtcccaaaaaactctgttgaagaaggagaagaagaggacgatggttacattgtcgtggtcgaggtacgtatatatatcaacactttcgttttttctcttttagatatgcatgttgtgcgtatatttgatacaaatttgtcatttgctatttttatagtatgcggtttcggtggagagatgttacctagtgattttggatgctaagaagatcggtgaatccgatgcggtcgtgtcgaggttagaggttccgaggaatttgacgtttccgatgggttttcatggtttatgggctagcgactgaattttgttgataattattttatctgattattatttgtacataatgtaattttatgggctagcaattttatgatatttttttctgttagaaattttgtaaggaaaaggtgttacagaagcc

SEQ ID NO: 709 - DNA, 588 bp, Arabidopsis thaliana
tattcactgctcctgatctttatctccttttatgattataatatctcaccagcttctacctacgttatatatatataagctcttttacgggttacctccaaagaaaaatagaaacaaaaaatggggaattgtttaaggcatgaatcagaaatgcattgggctggtgaagactgggatgaattcatcacagaagatgaagaagatcatcattatagctctaaaaccacaagagatggcaaaccagtaattgtaacacgtgacagtaaatcctctgttccatctcatgagatcaagatcaggctcacgaagaagcaactccatgatttactgagtaaagtcaacgtccatgacttgaccttccagcaacaaaccttctcatgtccaatcctgaacaatcgcgggtacgaagaagccaatcaacaacggttatggagaccggttctacagagcataccagaagttaactgagttttgttttcagagatggccatgtttgtatatgcttagggtttcttcactttcttgatatgtgttagggtaagagttttgatgtaaattttggtttggacacatgacgcttctgttttt

SEQ ID NO: 710 - DNA, 1473 bp, Arabidopsis thaliana
tgttaaatcaagctggaatctgaaatttcttgcagatccaatgaagaagatccaagttatatagtgagacctcaaaccttagcttgagctctgcttcttctctctttcactgcattgaagatgggatctgtatctttaaagatcggcgatggaacagccagattccgacgaacatcaatttgttcatccgccgtgaacctcctcatgctcttctccgtcgtcaccacaaatctcttcgccttatacgcgttctcctctcattcccaagcaaactcgccacttctccacagctccaacaatatctcactcgtttctcaacatctctctttgattctccgagaaatcgattcgtctcaacgcaagcttgctcagatggagaaacagatgcttggttacgaatctattgatatctctcgacctaacattgttcctgagctcaaattgttcctccagcgtcatcagcttcctttagggaaagattcgcgtaccgggatcactgaaatggtgtcttccgttggacattcttgtgggaaatctacggatttgctttctcagtatatgtcatataaggtgtttgatagatgtcctgatgattggagtcttggccagaagttgattcttcgtgcttgtgagccgttgccgcggagacggtgtttggcgaaaacggtgcagaagcaagatttgagtaagtctcctgattcgttatggagatctgttagtaacaagagtgttaattggagtggacttggttgcaagagttttgattgcttgaaaggtaagaaacttagcaaggaatgtgttggttgtttcgatttaggggttgagaaagataggtttgtgaaggttaaggggaagaatgatttcttgattgatgatgtgttgggtttaggaagtgggaaaattcgaatcgggttcgatattagcggtggatcagggactttcgcagcgagaatggctgagaagaacgtgactgtaatcactaacactttgaataatggtgctccgtttagtgagtttatagctgcgagagggctctttccgttgttcttgagcttagaccatagatttccttttcttgacaatgtgtttgatcttattcatgcttctagcggattagatgttgagggtaaagcggagaagctagagttcttgatgttcgatcttgatcgggttttgaaaccccgtggattgttctggttggataacttctattgtgctaatgatgagaagaagaaagaacttacacgtatgattgagaggtttgggtataagaagcttaaatgggttattggagagaaggctgatgcacaagtttatctctcagctgttctgcaaaagccagtgagagcttgatcgggaatgcaaaaggaagttcgtaatggtaagaccgaccataagagtaaaactctctatttatagttacatttgatcataggttataaatttggaggtcattaggtgatatttattcca

SEQ ID NO: 711 - DNA, 1541 bp, Arabidopsis thaliana
cgaccacggcagtttcttctttctgataaaacaatttcctctgtttttttggattaaagactcatacttccgtcgaatagaatcaatcaatatatcatgatgctcaagttgatcaaatcaatggttcaagcaataactcgtccgatacaatacttgatcatctcttacctccggtatcttgtcggccctccttcgctgactcaccatgataatcaagtcacggttatcatcgaagagacttctgagaacggaaggatcaacgtgatccatggcgccactcaggcttatcttttcgacaaaatcaaccttgacttcgtggaagaacgtgagttcgatgatatataccaaggggccaagctcaagtggaggattttcgtggataaaaataatattggaaacatccctaagcaatgcttcgagctgagatttgacgaaaagcatagagatttggtcttcgactcttacatacctttcgtggagagcaaggcaaaggagatcaagagcaagaagagaatcctcgagatgcatacatactctcactgctgtgacacttgggaaaccaagatccttgaccaccattcaagctttgaaacgattgttatgaaggaagacctcaagcgtagactcatcgacgatattgacctgttcatcagcaaggaagatttctacaaaagagttgggcgacattggatgagatattacttgctgcatggtctaccgggggccgggaagactagtcttgttgctgctattgctaaatatctcaacttcgatgtctataacataactcaaggggtgaaaactgacttcgacactcggagactaattcgcagagtcgaggatagctcgattctcctcgtagaagatatcgacacctccctcgaggttagtgaacttgtgctaataatctatacagtcaagtcaatgggccaaattacacacagttgatgattaattttattagtatatattttcaaactaattaccttttgttttgttttctttggtatgattaacagggctcgaaagtggcattatcgcaactgttaagttccctaacttggccttggtcgaatggcaaggcacgcgtcgtgatattcacgacaaacaacaaggagaggtttgaccaaacattgctatgtcgtatggaaatgaaaatttacatgggacattgctgttttgaggatttcaaaacgttggcttctaactacttgggcatctctcatgacaatgatgccccacaccgtctctacccggacatcaagcgtttgattgatggacaagctgtgacaccaggtcaagtcgtggaggagctaatgaagagccaagatgttgatgtggccctccaaagcttggtgaggactttggagatgacgagtatcatatcaaataagattgatgaagatgacaaagacttatgagttacgtttccttgaaacgagtttatgaaagttgtgctcattttccacaaaacatcgatttcttttattattatacctttaacacctaaataaccaaattgcgtgtgttgattaacctag

SEQ ID NO: 712 - DNA, 777 bp, Arabidopsis thaliana
tgacactatcagcttgcttcttcaactactacatgccactaaatcaatgttaggtttccttttgagatccctagtgacataaatatggttatcttctcaaaaaaatgagcagcaagaaagatgatgaaacctacatcaaaatcaattcagagagttggtcgtttcttaaagaagactcttgggagcatcaagtccactatctgctctagtgattacaaaaacttacctaacgacactcctctcttgagcccttactcctgcagccgccgctgtccagaagattcccaaacccaaaccaaagaaagctacaccgttatctgttgtgacacggctgtggcagatacaacacaccagaagagtctcaacaaccaacataaaaagaaaccgaagaaagtcgctgagccattcgaggatgcaaagaaaagaggtgacgcgttggcgcaaaagatgaaagatctcaatatggtggatctgagagacgtggatcacgcattggatgtaagggaagcgcttcgatgctattcaagcatcagaagtcctgtgtatcttgacattgttgacaatttcttcacagacatgtattacgagttctctgatcctcgtacctctgctaagatcaacggttcaaggagaaaggcaggctccttcaggctttaaagttcctctggatcagctttgctttcacgggctatctgtagttctttcatctatagagtatgcacttcttaagaacagtgttaaccattacacacaccgctttggtaaaatcacctgtca

SEQ ID NO: 713 - DNA, 1246 bp, Arabidopsis thaliana
tcgcctgcacaaaaaaaaaacctccagatcgaaaaaaaatcgagaagcgaatagcggaagaacagaaaaagggaaattctgagaatcaaatcggaaaggtagaagaatcgagtcggaaaaatggaaacgacgaagagtaacagcagcgagtccgatgtcaacgccaaatgggacgcttgtctcgatctcactgctcgtcgctttgtctactcttccctcggcggcgctttcgccggtcttctcttcttcagttcggtgttttccaatatcccccactttattcttatgattcaattccgttcacatagtgttgattactgattaggtttctgggtagagaaactgagaattcatgatcatttagggttttgagtgttgttccgatttgaatcatttaggatttattaggtttaaatggttttttgtgttttgacgattaattgttgcgttgtgtgccctagggagtccggttacgagatgggcgtcgattgcttttggtgctggaattggtattggttctgcatacacagattgttctcgtgtttttgatgcgtcttcttcaacttcagctactttattagcagctcccaagagtacggagacttctgtatctcaggttagtcggaatctagttttgtgggatcgttttgttcgtaacagttgaagttagaaaagatgctaatttaagagggtttcatagtagcttagagggaaatatgatttggaagaatggttacagatttgtgagaacatatgcatctttagtttttagctcttaatagttcaatattctgaccattgacatgtaagagttttgtcgctgttgatcttacgagcaaagaacaaatgcctgattgtattgtggcatagagtatcacgactggactacgtattggaaattaatgattagtaatcggatatcttacttcatcactatcatagttagcaagttactaggtgttttggtaggtgcaaacatgtttaatcttgttccaatgtgtatgcatttggtcgaaagcaaatccgttcatgtttctagtcatcgaagtccttacaaagtagaatcaaattagctgagtgtgtctgtttttatcttgttgattgattacaggcagcagaagagtgaagacaacgaggaagcttggaggtaaaaaaccaaacattgatagagttacattacgaaatggtaattgatcttgcaggacaaggcttttgagataacgccattgttaaaaaaaaacttttg

SEQ ID NO: 714 - DNA, 3758 bp, Arabidopsis thaliana
tatttttttgtcattaaactatataaccaaacacaaacatcatctttctccttcatttcacaaacttaaaattctctgtttttgtttcttcttctttcaaaatctcaagcaaaagaaaaaatggagctattcacaaaaggtaacaacgttaagttacgtagccacctagataagtttttagtcgccgacgatgaccaagaaaccatccgtcaaagccgtaaaggagatgcacggcgtgccgtttggacggtggagcccgtcgtcgataaacctaatctgataaggttaaagagcagccacggcacgtacttaacggcgagcaacaaaccgttattgttaggtatgaccggtgagaaagtgactcaaacggcgtcgtttaacaagctgatggattggcaaacgcagtgggaaccggagcgagatgggtttcaggtgaagctaaaatcttggtgcggtaagtggatgagggctaacggtggaacgccgccgtggagaaactctgttactcacgatgagcctcatacgtcaaagacaaagaactggttgatttgggatgttataactattgatggttctgatcttgaaaacatgtctgatggtgatgaaagctctgtttcttctccggtcgggtctgaattcggatcagaacccgggtcacctgtttctgccaggtctacgaagagtagtattagccggtttgcttctcttggtttatctacgtctccgagatggtcctcaaaaccggtaagtttgactaagtcttttattcagtgtgcattgattagtttttcttaatttctgtgtttaaattaaggctaatatagaaatttattattgtgagttgaacttagacaattctgtatataagaaattagttggcatgcatgaacatatggaaaaaaagatgaggattacccgtattagtatctacaatttaaagaaaattacatgatctgtatcatttcttttctccactaacatagataatgctccacaagcacacacatcgttttaccaacctaataccaccaaaatgtataggattttttaattgtatagttttgattagtttatctattataatagactatagttgaaaatatgacacttaacaatccaacttaagtttacttcaatgattgaaggatagttttgaaatgcttgtagtagaacctctaaaatgtaactaagtgactgtatatttcttacaaaagctatacctaaggatgattaaagaagaaaaatacgattattattccttaacaataaaaacttgtacctaatggcttaagataaacaaatctagtgccagttaacataagacaagtgtaacaaaaagtaaggtaaaaaagttggtagttatgatttagtgatggagcatatggtccagggatgcaattaggagagtcccacactcatgaatttcctctcttggtctttcttgcgggcaagggtttatagatttattttctaaatattcgcttaaatcctatcttttcgatccattcttttatggcatagggacactattatttttggggaaaagggcatatacttttatctttttaattatttatttatatttttcaatattttccatttaatattgatttgcttataccacataattgcttataatctaactgaaaatcacatattattcatcaagaattacgtccattagttccgattttgatcttatcatagaactaaatacgtactgaaaaattaaaagataatggaaaaagtatagagtaacaatgtaaaatgatactttattgggaaatttggttacctatctctatcgtaatttattctcttcatatagattattatatacatagcaaataaaagtttaccaaatgtatgtaccataccttttattattatttcaaatgaatcttcaatagtcaacattgactcctagtattatgtttaaatcttctatgaattgaagaatctgaaataaacatcatgaatgattggaagatatgtaagagaaaattgttccaactgataaaagttttcacaaagtcattgtagtaattaatagatatatagaaaaataaaacacaatttaaggccaatttttttcatcttctcctataagatttaacaccaaattttttaaagaaaaattcaaagcattgatttttttatatataatcaaatacaaactttagttacaatctaaatcctgctttgtttcttgaaaatctgtttaaattaacaatagttggtgtcttggaatcctcgtaattaactttaatctcaagatttacaaacattacaaagtaacaaaatccaaaacacgtgaaacaacaacgcgttacaagctctaacaaatactaataaggaaagaaatccaaatcataaatttctgctgacgtggatattagatacgcgctctaatccagctagcaacgacttttccagatttcttaccttacctagtccgcgtaaccgtaaaaaactaaaaaacccaatttagaccagtccagtgtcagatccaccacacatataaaataaccatatctctcacttcttcttcttcttcttcttatcactattcgctcatttccccttctctgttgttacagaagtcgacggcgagtagcttcaaccaaaaagaaacaccagtatctgtctcagcaatggaatttttccagaaagcaaaagctattcgaatgcgtaacagtcacaacaagtatctaacagcagacgacgatgaagaaaccgtaactcaaaaccgtaacggatctaccaaaaacgctcgatggaccgtcgaaccggttcgtgattctttccatgttattcgtcttaaaagctgttacggtaagtacttaaccgcttctaacgagcggttcttgctcggggctacggggaagaaagtgattcagttgaaactgagtcgggttgattcgtctgttgagtgggaaccgcttagagaagggtctaagattaagcttaggactagatctggtaactatttacgaggtaatggtggtcttcctccttggagaaactcggtcacacacgacgttcctcatttgtctgctactcaggattcgatttcttgggatgttgatgttgttgagatcttgactgattccgaattcaagacggagtctgcgaaagcgccgccaccgaagacgacgtctccaccgccgcatcggagaccgacgagttcgccgttgtcggctgagtctccaaggacttcgtcttctctttcagacagatccgattcagatgtgagtacttttcctaaattcctaaaacacctttggttttgtttaaaattacagttgtaccgttttccggttattgaaaattttgattttgattttgaccagtcggttgagtctccgcctaaatctgatggacgaaccatatattaccatgtcgctgacgaggaaggacacgtggaagatgaaacaaccgttggatatgctttcacgtttaaaggaaatagcgtggcggagctgactcagacattgcgagaagaaacgtgcatggaagacgctgtggtgtgtactcgtagtcctttaaacggcaagctgtttcctcttcgtttgcaacttcctcctaacaacggaacattgcatgtcattttactaccctccagcgcgagcctctagaatcgacccgagacaattagaaatgagtgattgtgtgattgtttggtgaagcatatgatatgaaccgtataagaagatagtaagagttggtagttggtacaagactcgttgttacataga

SEQ ID NO: 715 - DNA, 1339 bp, Arabidopsis thaliana
cacaccaactcacactggaaaaaaaaaacaagagagagagagagaagagacaaaatttgaagtttgaagtgaagaaacaatttcattttgcggcgacgaattcgaattttccgatcgatcatgccgtccggtgcgaagaaaagaaaggcgttgaagaagaagaagcaacaggaagcgattggaacaagtatcaacggtacatttcgtagttcgattttggtttcaggatttgtttgtttgttaggtcgatagattatgtcttgaatggtgttgaaggattttagtatagcttctcgcctagaaattaactattttcgtggttggtgtatagagagatctgtttgattacttctctcaatatctgtttcgagctaacaatgcttcattcatgactttagcaagacttttttttataactctgatcaaatgctggattgttttctcctatcatttttggaagttgcaagtctttttgtgttcttagtagttccttttttaatctcaggaaatgatgaacatggaagccaagatgggaggggaagtgatagcagtttgagttctcctggttctcaaggaaatcaagaatttgggactaaagattcatctgctcttctatcttctgctgtggtgaaaggtgcttctaaagagatatctagagatgcaggtgttactcagggactaggacccaaaactggcaatgctattgtggaaaaatcaactaactcctcttctgataaccgtactcgccccgccaaaaatgtagcttgtggtaattcagttacagaaatcactccagttgttgattctgttaaacctgtggtttctatctccaaaacagtgacttctgaaaagagtgggcttgttgagacctcaacacactcaaatttggtcaaaaagaagtctgagaaagatgaagagtatcatccgtctccggtattggaaaacaataatagtaaggtggttatgcttccaagatctgctcctgaaacaagcaaaaaagtagagagcgtaagaaaatctgaagttccagtatcccctgaggaaaaggtagcatctctattctcctttttgcatacatgtgtttttcgtctcttttcagttggctgaatcttctgcatgtatgcagcctcttttgctacctggtccaccagtcgtccgaaggacttcatggctaagctgctgcggtttgtttgatgctatgactggatctgatagataaacacaggttagtcttggtttatgatttttggtagatgtactttatctggttgagtctcctgattactaagaactcacatggcctacaatttgtgaactaattaagaacttcacttaatta

SEQ ID NO: 716 - DNA, 1166 bp, Arabidopsis thaliana
gatccgtcacacttcacctagagaccctcccacagctttctcgataactgacaatccaacggttgagattcagttcttctagataaattcacatatccaaaggacacgtggcggcgagagatgaaagaaagtagccggaagcaaggagctgcgtcaccgtgtgctgcgtgtaagcttttgcggcggcggtgcgctcaagattgcgttttctcgccgtattttccggccgatgagcctcagaaatttgctaatgttcatagagtgttcggtgctagcaacgtcaacaagatgcttcaggtttctttcttcttgttcttcttaagaatatctaaaacgtgcttactcatatgttgggttaggtttaattaggatgattttcttgtttcttattttagatgagacattactatcatttccataactttttattgacaactaccacatgggccgacccgtttatattataagtttagggatttaaaaacaaaattgttgaattttaagaatttaggaatatgttacatttattagctgatgttgaattttaaccatattaacttttgttagctaatgttaatgatatgatttacatttcttagctagctgatgtagagtctacatttgagatggattatataaattttatatagtcttgcgagattaattggtctagtggctgacaaaatgttttaaaaactcaacaggaattaccaatccaccagcgaggggacgctgtgagcagcatggtttacgaggctaatgcaagagtgcgggatccggtttacggttgcgttggggcaatttcgtccctccagcaacagatagatgtgttgcaagctcagctagctctagctcaagctgaggtggtgcatctacgtgtacgccagtcgactaatttcccagggcacggactatgcccggatagtccgagtagcagcgggtcaccgtcttcgaagcaagtgagtccacaggacaacaagggcatgtttagccatatggacattgtggatgaagccagtttgggagagtctatgtggtcttgctagtcaataatgctctctttctgctactgcaatttcctcttccttttttgggaaatttcgggattattatatattaaatttaggggtaggatatgaaaatgctctgttttgactacagagtga

SEQ ID NO: 717 - DNA, 1914 bp, Arabidopsis thaliana
tatttcaatgctggtaccgaaaatcatcatttaaacaaaaagtcttatattggctctctcttcaacttttaattttctaccaaacatatacatcaaagcttgactctctttttctctcccatggaatcaacaaagaagcaagtctcgttggagctacttccatggttagttgtccacaccgatggaacggtagagagactagcgggaaccgaggtttgtcctcccggtttggatccaataaccggggttttctctaaagatatcattatcgaaccgaaaaccggtttatctgcccgaatctatcgacccttctcgattcaacccggtcagaagattcctctcatgctctattttcatggcggtgcatttctcatctcctccacttccttcccctcttaccacaccagtcttaacaaaattgtcaatcaggctaacgtcatagccgtctctgtcaattacaggtattaatccggtttaagttgacttgtttcacccaattttgaatggtccggtcgcattggtttaatgccatcgctgtcttgtcaataacgaaagctaatccggtttacgttgacttatttaacccaatattacatggtccgctcgcattcgtttaatgttgaatgcaagaacgtattgaatttaaaactcaactaggcatttttgttgttttcggtttagttcgggttaaaatcgaaataaaaccgagttattagatcattttagcttggtttgaaaattttggttccatttggatttgagtttggttgaaaatgcaaattataatataaatatttaaattaattatatatttagtagttaactttagaaatattttgattaatatggttagattaccaatggttggctttggtttgatttcatcctttattaaacttggttttctgcaaaacaaccattcaaatcaatcttgtttgcaagtttaccttccaagtatgaattatgcaagtcaatcctacaatctcaaaagtcacccgcaatacagtcctcccgtgtagtgatgacgtggtactcgataactctttttaaaaacataagggttttgaaaacttaatatagttatagagaaattgggtttgagttattttggtttgatttggttgttgtgtccaccataacaataatcaaaattgttttatattatctttttgatcaattattggacatagactagcaccagaacatccacttcctacagcgtacgaagactcatggactgcgctaaagaatatccaagccataaacgagccgtggatcaacgactacgccgacttggacagtttattcctagtgggagatagcgcgggagctaatatctcgcaccacctcgcatttcgagccaaacaatctgaccaaaccttgaaaatcaaaggcattggaatgatccacccatatttttgggggacacaacctatcggagcagagatcaaagacgaagcgaggaaacaaatggtggacggatggtgggaattcgtgtgcccatccgagaaaggatccgatgacccgtggattaatccgtttgcggacgggtcaccggatcttggagggttagggtgtgagagagtgatgattactgtggcggagaaagatatattgaatgagagagggaagatgtattacgaaagattggtgaagagtgagtggaaaggaaaggttgagattatggagacgaaagagaaagatcatgtttttcatattttcgagccagattgtgatgaagctatggagatggtacgatgcttggctctctttataaaccaagttgaagcttgatattatttgttttgccaaaatttgatggcttttttaatgtttgtataatttttacatgtttgttaatgttgttgttattgtcttttcttttaaatttgtgtattacatttatatgtggtt

SEQ ID NO: 718 - DNA, 1437 bp, Arabidopsis thaliana
tttcctttagttaaaaataaggcactaacattttttaaattatcagatgcgtccttcatttgatttgttcttaaactcgtctcctgaaggctgaaaccctttgctctcactcccaaaacgatgtcgtctctatctcgcgttctccgtggcaccttcaacacttgcccgatccgccgtttttcctccgccgccaccgtagtctccgaacccaccgcagtcactgccgcaatctcgcctcctcaaaagtcactaaccagtctcgtgaatggcgaacgaaaccccaaacggatcgtggagaaattcaagaaggcatgtgagtcggagcggttccggaccaacatagccgtgtacgatagaaccgtgcgccgtctcgtagccgcaaagagattacactatgtcgaagagattttggaggagcagaagaagtaccgcgacatgtcaaaagagggattcgcggcgaggatcatttctctgtatggaaaagccggcatgtttgaaaatgcacagaaggtgttcgaagaaatgccaaacagagactgcaagaggtcagtgttgtccttcaatgccttgcttagtgcatatagactttccaagaaattcgatgtggttgaagaacttttcaatgagttacctggaaagttatcaatcaaaccagatattgtatcttacaatactttgattaaggcattgtgtgagaaggattctttacctgaagctgttgcattgcttgatgagattgagaacaagggactaaaacctgatatagttacattcaacacacttttactgtcttcgtatctaaagggacagtttgagctaggggaagagatatgggctaaaatggtggagaagaatgtagcaatagacatcaggacttacaatgctaggctgcttggattagccaatgaggcgaaatcgaaagagctagtaaatctctttggagaacttaaggctagtgggctcaaacctgatgttttcagtttcaatgctatgattagaggatctatcaacgaaggaaaaatggacgaagctgaagcgtggtacaaagaaattgtgaagcatggttatcgtcctgataaagctacctttgctttattgcttcctgctatgtgtaaagcaggtgactttgagtctgcgattgagctcttcaaggagacattcagtaagcggtatcttgtcggtcaaacaacgttgcagcagttagttgatgaattggtgaaagggtctaagagagaagaagctgaggagattgtgaagattgcaaagaccaatgatttcttaaagttgaagctaaatttgccgtcccaggaagagtaagtcatttgctactctctcactaagtgtctcgttgaattgtgtctgagcagcttaagctatatgtatttgctggtgttgctttgtggcttttctacttctctaaactttcctctgtggaag

SEQ ID NO: 719 - DNA, 867 bp, Arabidopsis thaliana
cccaatgtctctctgtttagggcatcttctccagatgaaccaaaaaccccaattcgttaccattgctctgtttttcaaatctgtgaactcataatagagcttttgaagaagtgcttaaagatgagcttagttctcagattcaggcaacatttatctcaaacctcatccagattatcacttctttctcgaatcggcggttaccggagttacacccaaccggcgaagattgaagatgaagaagaagaagaattcgatcagagaaagctcccaacagattacgatccagctacttttgatccaacagagcatcgaagtccaccaacggatcgtgtattcagactcgtagacgagatctcatctctaacattattagaaatctccgagcttggttcgattataatgaagaagaaaggtatgacggagttaccaacagtcgctgttatgaaacctggagctggtggtggtgttggtgttggtggtggtggtgggatggtgagtcaaagtggtgtgagtgaagaagctaaagtggagaagacagtgtttgagataaagttggagtcttttgaagcatctgctaagattaagattattaaagagttaaggagttttactgatttgggtttgaaagaagctaaagctttggttgagaagactcctgctattttgaaagctggtttgtctaaagaagaaggtgagaagattcttgagaagttgaaagcacttggtgctaaagttgtgttggagtgatcatctaaaggttcgatttttctgcttttgttccgtgtatgagctcaagatacaaagctgattaaggttttataaagggtcatagttgttacacttgctctttctttctcattgctaaat

SEQ ID NO: 720 - DNA, 2120 bp, Arabidopsis thaliana
caacccgaaacccgacccagtaattattctctcccctccgaaagcatcgataaatcctctggtttcctttgtccaacgagtccattttcgcgagcttccgtgtccaagagctcctcgaccatggcgtcttgtttacaagcatccatgaattctctgcttccacgctcttcttctttttctcctcatcctcctctatcttcgaattcatccgggagaagaaacttgaagacttttcgttacgcctttcgcgccaaagcctctgccaaaatccctatgcctccgataaatccaaaggatcctttcctctccacgctcgcttctattgccgcgaattctccggaaaagcttctcaatcggccggttaacgctgatgtgccgccatatcttgacatctttgactcccctcagctcatgtcttctcctgcacaggttaactattctcctccattttccgatcccgatacaatgatttgtatgcgctttgcgtttagttaagtcgtcaagtatccagcctctagttattgcacacagactgacttaattctgagagctccttgaatttgcaagagttactgtgagatgtgccagattgattacgcaacactgtgatttgatgagtttgatagtcgccacatcactttgatttcactgtttcaaatccgttgacggaatctattggttgaaattaggttgaaagatcagtggcttataacgagcaccgaccgagaactcctccaccagacttgccatctatgcttcttgacgggagaattgtttacattggaatgcctgtaagttatgtggattcttatggattttttggttgggactgcatagactgatgatgacatattttgctttcagcttgtgccggcagtgactgagctagttgtcgctgagctaatgtatcttcagtggctggatcccaaggaacccatttacatttacatcaactccacagggaccactcgtgatgatggagagacggtaagtttgaaaactttgtgaatcttttggaccatttctcttgttagttctaatttcagtgaataactcactaaacaggttggaatggaatcagaagggtttgcgatctatgactctttgatgcaacttaaaaacgaggtaatgttaaaatatgagttatcagcttgtgaaatgcaaacatgtaagtaataagttttgctagagattgcacaagctacttgatctgttaccgagataaacactttttcgtctccacggtatttttcatgtgagcatgttggttcttatttgtgcaggtacatacagtatgtgtgggagcagccataggtcaggcctgtctattactttctgcgggaaccaagggtaaacggtttatgatgccacatgccaaaggtatagacttcgactgcattctggccgcttctatggctcaccattgataatcagaacctctcatacgtttgattcattatgtcacagcgatgattcagcaaccacgtgtaccttcttctgggttgatgcctgccagtgatgtcctgattcgggccaaagaggtttgatgaatcgctctacacacttaatattctggaaatttaaatttgatcgagattttctctttctgctttgcttctacctactttcctatattatatctctgataatttggacagaaatttctcacttaagcatttggttcagaatttcatgacctaattaggtgaagaatctgagtttgattacttcatcttcctcattcctgttatgcaattgcaggtcattacaaatagggatatacttgtggaactactatcaaagcatactgggaatgtgagtgcgaaatattttcataactttgtggagaaatttgatagctgattaaaacattcttatatgtcatatagtccgtggagactgtagctaacgtaatgagaaggccatattacatggatgcaccaaaagctaaagaatttggagtcattgacagggtaagtttgggcactgtaattttttgatgttgcttttcatatgcacatactaaaagattaaaggttacatatcgtcaccaagcaaagtaacctttccagtcaagtttccctctcttctaccttttcctgatgtttgcctgtgcgtaa

SEQ ID NO: 721 - DNA, 2061 bp, Arabidopsis thaliana
attgtatattgtaaagtttgaggtcgaaaataaaacgaaagagagagatgccagtgggtgcaaaattcacaaaccctaaatttcaaaatcccaagtctccttcctgtccagcacgaatcaatgttccccaaatccttagccgtaagtagaaaaaactcgaatttaacaaaaggagtctctggtttaagaagactctgttcttcttcatctaccatcaccgggagcccttgcccacctagatatgacgtagctgtcatcgctgatctcatagagaagcagcactggtcaaagctcggagttcatgtgacagacataaaccctaacgagctgtttcgacagttgataagttctgagcttgacccagatttgtgtctcaggtactattcctggttagtgaagaacagtgacatctctgtttcacttgagctcacatttaagctcttgcattctcttgccaatgcgaaaaggtactcaaaaatccgatctttccttgatgggtttgtgagaaatggatctgatcatcaagttcactcgattttccatgcaatctctatgtgtgacaatgtttgtgtcaattcgattatagctgatatgttggtattagcttatgcgaataattcgagattcgagttaggatttgaggcgtttaagcgttcaggttattatgggtataagttgtcggctttgtcttgtaagcctttgatgattgcgttgttgaaggagaatcgttctgctgatgttgaatatgtgtataaggagatgattaggaggaagattcaaccaaatgtgttcactttcaatgttgtgatcaatgcgttgtgcaaaactgggaaaatgaataaagctagggatgttatggaggacatgaaagtttatgggtgttctccaaatgtagttagttacaacactctcattgatgggtattgtaagcttggtggaaatgggaaaatgtacaaagcagacgcggttttgaaggaaatggtggagaatgatgtgtctccgaacttgactacattcaatatattgattgatgggttctggaaagatgacaaccttccggggagtatgaaggtgtttaaagagatgctggatcaagacgtgaaaccgaatgtgatctcgtataattcattgataaatggtttgtgcaatggaggaaagatcagcgaggctattagtatgcgcgataagatggtaagtgcaggtgtgcagcctaacctaattacttacaatgctcttataaatgggttttgcaagaacgatatgctgaaggaagctcttgatatgtttggctcagtgaaaggccaaggagctgttcccactactagaatgtataacatgcttatcgatgcgtattgtaagttaggcaaaatcgatgatggctttgcactgaaagaagagatggagcgggaggggattgtaccagatgttggaacttataattgcttgattgctggtctatgtagaaacggtaacatagaagcagctaagaagctttttgatcagttgactagtaaaggacttcctgaccttgtgacgtttcacatactaatggagggatattgcagaaaaggtgaatcgagaaaagcagcaatgcttttgaaagaaatgtcaaagatggggctgaaaccgagacatctgacttataacattgtgatgaaaggctactgtaaggaaggaaatctgaaggcagcaacgaacatgaggacacagatggagaaagaaagacggttgcgaatgaatgtagcgtcatataatgtgcttctgcaaggatattctcaaaagggaaagttggaggatgcaaacatgcttttgaatgagatgttagagaaaggtctagtcccgaaccgaataacctatgagatagttaaagaagaaatggtagatcaaggtttcgtcccagacattgaagggcatctattcaacgtctctaccaaatcctaatctttcagtggccatcatgagaagcaatttcatgcatgatttgctttgctccacggtgcttcctgatttcaccataattcaatctctctctctcacagaaccggaccctgcagaatcttg

SEQ ID NO: 722 - DNA, 1185 bp, Zea mays
ttcttgtttgttgattaacccttaattaatccgggcgcgcctgatttatcacaagtttgtacaaaaaagcaggctcctgcaggaccatggccgcaaacgtggcgctggtgctgctatcctcctgctcgccctccacttccgccgccgccgcctcgctcctccctcgccgccgcttcctgccctcccgccgaagaagagcaagctcccgagccaccaccatcatgtcggcgttgggcgatgacccgatcagggaatggattcttacagaagggaaggccacgcagataaaagggatcaggtccattggtggtggctgcattaactccgctcagcgctatgataccgacgcgggccccttctttgtgaagaccaacagccgcattggtccagaaatgtttgaaggggaggctcttggtttgaaggcaatgtatgacacaaagtcgatccgtgttccgttgccatacaaggttggttctttacctacaggtggttcttttatcatcatggagtttattgaatttggtcgttcaaggggagaccagtcagatttgggaaggaagcttgctgaaatgcataaggctgctaaatctgataaaggatatggtttcccggttgacaatactattggaagcactccacaaattaacacttggactgatgactggattgagttttactccaagcatagattgggttaccagttggagttggcatcgagacgatatggagattcggccatactcgaaaaaggtcagcggttgatcaagaatatccgcccactttttgatggagcggttattgagccatgcttgcttcatggtgatctgtggagcggaaacataagctctgatagcaatggggatcctgtaatattggatcctgcttgctactatggacacaacgaggcagagtttgggatgtcctggtgtgctggatttggtggggacttctacaacgcctattttcaggtgatgccgaaacagccagggtttgagaagaggagggacctctatctcctctaccactacctgaatcactacaatctctttggctctggctaccgttcatcagctatgtccataatcgaagactacctatatgtgctggcgatttagctcgagacccagctttcttgtacaaagtggtgataaattggagctctgcagagctttcgttcgtatcatc

SEQ ID NO: 723 - DNA, 581 bp, Zea mays
acaagtttgtacaaaaaagcaggctcctgcaggaccatggctatggggttgattaatgctaatcctataatccatgagaaaaaagaaagacgcatccgacaggcaccagagaccacagatgaaaatgcggcagagtccatagaccagctggaaatatttgatcacattagagatataaaggatccagagcacccatactcactggaacagcttaatgtggtgactgaagactcaattgaactcaatgatgaaagcaatcatgtcagggttattttcaccccaacagtggagcactgcagtatggcaactattattggcctttgcatacgtgtgaaacttgtacggagtctccctccttattacaaggtggacataagggttgcccctggatcacacgcaactgaagctgctgtgaataagcaactgaatgacaaagaacgtgttgcggctgcattggaaaacccaaacctactggacatggttgaagagtgcttatcaccaacattcgattgaggtctcagttattgcacatctgggagccatggtgtttctcgagacccagctttcttgtacaaagtggt

SEQ ID NO: 724 - DNA, 1719 bp, Zea mays
ccttcacactgcgctccctccctccctccctgtctgcgacgactgggtggtctaccgccgccctcgctttcgcgggcgaagagcgctcaccagtttccttggatctttgagctttggaagatgccgaggtggacagagaattctgcttccaccaaatcagctgaattggtgaaacaacaagaccgtttggagtttgacgatcctgatgaggtagacgaagaggaagaagttgagtatgaggaagttgaggaggaggtcgagtatgaagagacagaggacgagtatggacagactgaagctgtacgccaagttgatgctaaacatgacagtaaaatggtggatgctgatacggatgagggtggaaaagggagtcatgatgaacttcttgctcttcctcctcatggatccgaagtttatgttgggggcatcgcctctgatgtctcttctgatgatctcaaaaaactctgcgagtctgttggggaagtagtcgaagtgcgaatgccaggaaagagtggtaggctgtatgcctttgtcaatttcagaactaaagagctggcttcaaaggccatccagaagttgaacaataaagatctaaagggaaagaagataagagtttcttcctcacaggctaaaaacaggctatttatcgggaacataccctataactggacagagaatgaatttaaaaaagcagcagaggaagttggccctggagttttaaaagttaatctcgtgaaggcaccacattcagatacaaacaagggttatggatttattgaatactacaaccaggcttgcgcagagtatgctaagaagatgatgtctaccccagaattcaaactagataaaaatgcccctaatgtcagttgggcagatactaagaatggtggtgaatctgcctctactgcacaggttaaatcactatatgtaaaaaacctgcccaaggctgttactcaagaacaactgaaaaaactatttgagcaccttggagaagttacaaaggttgttattcctcctgcaaaagctggtcatgaaaatcgatatggttttgttcacttcaaagaacgatccatggctatgaaggctctggaagacactgagagattcgaacttgacggtcagctgctggattgttcacttgcaaagcctcttgctgataagaaggacgatacatcagcacctaaaggaggtccattgctcccaagttataccccagttggatatggactgatgggagcctataacccactcggaaatggcctggcagtggcaggcgcttacaatccgtatggaaatggactggcaggtgcttatggcgtgcttggtgctcatgctgcacagccaatgttgtatgttccaggtgctcctccaggttcgacaatgatcccaatggttctaccagatggtcgtcttgtatacgtaccgcagcctgcggggcagcagcctgtgcccatgacttcgcctccgccgccacagaaaggtgatcgtcattatggtggcagcggtggatcgagctccggtggaaggcgacaacagaggagagatgacagtggtggtagtaacaccaacagccgcaggggtcggcgccgtccctattgatgcttgtcgctgttagcgcttagaagttagaacctagtaggcatattcagagtatctctgctgcagtacaaccatgatgcagacgccaactgatgctggaaaccgtactttctagtggtt

SEQ ID NO: 725 - DNA, 592 bp, Zea mays
acaagtttgtacaaaaaagcaggctcctgcaggaccatggacacgatgcggggcgcgctggagcgggccaagatgctggtgggcatggaggtcgacgaggagtccgcgttgccaccgcccgaggagcagtccttcttcgacgacatcaatcggcactgcaccctcaacaccactcagaggctctatggtttcgcgatatgcttggctgccggactgacgtgcacattcttgtcaatgcttgtcttcttcaatccagtgaaatttggggtagcattcacccttggcaatttgatggcccttggaagtacagcatttctcataggccccaaaagacagtttgatatgatgcttgattctgtgcgaatatatgccactgctatatatattgcaagcatcataattgctctattctgtgctatctacgttcgcagcaagctgctgactctagtggccatcattttggaatttggtgcccttatttggtacagccttagctacatacctttcgcaaggtcgattgtgtcgaaggtgatgacatcgtgcttcgacactgatttctagctcgagacccagctttcttgtacaaagtggt

SEQ ID NO: 726 - DNA, 1488 bp, Saccharomyces cerevisiae
aattttccatctcatttttaatagtaagtattcttgcatgaacactaatgatattaggagggctttttaagttgctaccactattgcagtcgttatcaaccttttgcactttatctagtaatgtccgtgaaaaggtctgtttctgaaatcgaaattgaaagtgttcaagatcaaccctctgttgccgtgggaagtttcttcaagggcttccgtgctcccagtgacactacgttcgacttatacaaaaaaaagaagtctgaaaaggacgaattcgtattacacggtgaaaacgagagactagaatacgaaggttatactgattcttcttcccaagcttcgaaccagtatgttgtgggcctatttaatccagaaaagaaaagtattcaactctacaaggctcccgtacttgtttccaaagttgtatccaagtcaagcaagaatctaaggggtccaaaaataaaaagtaagagtgatactcgtccatctgctttgagaaatgcgttgggtgaagcgtttggtactaaaaaggctaaaaaagctattgcagatctagaaagaaaccgtattgactctgataagttgactgattctgctattgacattgtggattccgtgagaactgcatctaaggatttaccaactcgggctcaattggatgaaattacttccaacgatagacctactccattagccaatatcgatgccactgatgtagaacaaatttacccaattgaaagtataataccaaagaaggaattacagtttattcgcgtttcatcaattctgaaagaagcggataaggaaaagaagttggaattgttcccataccaaaacaattccaagtatgtggcaaagaaattggactctttgacacaaccttcacaaatgaccaaattacagctactatactacttatcactattactgggcgtatacgaaaatagacgcgtgaataacaagacgaagttgttagaaaggttgaacagtcctcctgaaatcttggtagatggtatcttaagcagatttaccgtgataaagcctggacagtttggaagatcaaaggatcgctcctatttcattgacccacaaaatgaagataaaatcttatgctacatcttggcaatcataatgcatttggataacttcattgttgaaatcacacccttagcacacgaattgaacttgaaaccttccaaagttgtcagtttgttcagggtacttggtgctattgtcaaaggtgccacagtggctcaagctgaggcttttggcattccaaaaagtactgcagcttcttataaaattgccactatgaaagttccatttaagctacctgaaatgacaagaagaggaagaggtccaagacgttagagttacctagaggtatatactgagcatttggtttgctctggtttttttttttgctagatggttctataaagcagcaaaatataagacggtcctcctgatgagaggaagagaaaaacaaaa

SEQ ID NO: 727 - DNA, 1590 bp, Saccharomyces cerevisiae
tttaggtaggtttggttctcactacccaaagagcaatcgataggtataaaagtgagcaattgctatcacagcgagccttattgttacagcacaaatcacgcgtattttcaagcaaatatcatgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccccttgatctatcagaatctattggaaattggcaggaacctcatccaggcgagaacaaggtttaacgtcaacttggaaccggagtgtgaactgacgcaacaagacctgtcgagaaccatgtcctatgaaatgcccaataactacacgggccaattcccggaagatatcgcgggcgtaatatctacgttgtgggccttgccctcaacacaagatttagtcaatgggcctaacgcatcgaagttctatctaatggactcgactccttacttcatggaaaatttcaccaggatcacttcgcccaattacagacccacccagcaggacatattaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggaatcgctggtgcttttcgataatattgtcaacagtagatggttcgcgcgcacgtctgtcgtactctttctgaataaaatcgacctttttgctgaaaaactaagcaaagtgcctatggaaaattacttcccagactacaccggcgggtcagacatcaacaaggctgctaagtacatactctggaggtttgttcagttaaacagggcgaatctaagcatatatcctcacgtgacacaggccacagacacgtcgaatataagattagtatttgccgccatcaaagaaacaattttggaaaatacattgaaagactctggagtgttacaatgaatgcacagctaaaacagagacaaaactgcatgcctcttctcccctttattatcacctttaaaaaagataaaaaaagaaactggaaaaaaggtaaaaaaaaaaaaaaaattaaataaatac

SEQ ID NO: 728 - DNA, 2013 bp, Saccharomyces cerevisiae
aaaaatatacgtgaaaaaaatttgaagtcatcgcaaagtagctctttttacatagtaaaagtctgaccagccaagagttaatatcagtatagtgatatcctactacttcaaaaataacggatgaagacctgctactatgagcttttaggggtcgaaacgcatgcttctgatcttgagttaaaaaaagcttaccgtaaaaaggccctacaatatcacccagataaaaacccagataatgttgaagaagccacacaaaaatttgctgtgattcgagccgcttatgaagtactgtctgacccccaggaaagagcatggtatgactcacataaggaacaaattttaaatgatactccaccaagcactgatgattactatgattatgaggtagacgctacagtcacaggtgtcacaactgatgaattactcttattttttaactctgctctttatactaaaatagacaactcagctgctgggatatatcaaattgcaggaaaaatatttgccaagttagctaaagatgagattttaagtggtaagcgactggggaaattttccgagtatcaagatgatgtattcgaacaggatattaatagtattggctatttgaaagcctgcgataactttattaacaagacggataaacttttatatcctttatttggatattcgccaacggattatgaatatttgaaacatttctataagacttggtcagcgttcaataccttgaaaagttttagctggaaagacgagtacatgtactctaaaaactatgacagaagaaccaagagggaagttaatagaagaaatgagaaggctaggcaacaagctcgaaatgaatacaacaaaaccgtgaaaaggtttgtagttttcataaaaaagctcgataaaagaatgaaagaaggtgcaaaaattgcagaagaacagcgtaaactaaaagaacaacagaggaaaaatgagttaaataacagaagaaagtttgggaacgacaacaatgacgaagaaaaatttcatttacaaagctggcaaacggtaaaagaagaaaactgggatgaactggaaaaggtatatgataattttggagaattcgaaaattctaagaatgataaggaaggtgaagtattgatttacgagtgttttatctgcaacaagacatttaagtcggaaaagcaattgaaaaaccacataaacactaaactgcataagaaaaatatggaagagatacggaaagaaatggaagaggaaaacataacgcttgggttggataatctctccgatctcgagaaatttgattcagcagatgaaagtgttaaagaaaaagaagatattgatctgcaagcattgcaagctgaactcgctgaaattgaaagaaaactggcagaatcgtcttctgaagacgaaagtgaagatgacaatctcaacatagaaatggatatagaggtagaagacgtcagttcggatgaaaatgtacatgtgaatacgaagaataaaaagaaaagaaaaaagaaaaaaaaagcaaaggttgacacagaaacagaggaatctgaatcgttcgatgatactaaagacaaacggagtaatgagttggatgatcttttggcatcactaggagacaagggcttacaaacggatgacgatgaagattggtctactaaagcgaaaaagaaaaagggcaaacaacctaaaaagaattctaaatccacaaaaagcactccgtccttgtcgactctaccgtcctctatgtctccaacctccgcgatcgaggtgtgcactacatgcggagaatcatttgatagtcgaaataagctattcaaccacgtgaagatagcagggcatgcggcagtgaaaaacgtagtgaaaagaaagaaagtcaagaccaaaagaatatagtgacaccaaaccatagaacgccgaaacagaaattattagtagagctgtgtagagtttaatttaactgtagtcaatgtggaaaatgaataccgactgttgtctggaataacaacattaatc

SEQ ID NO: 729 - DNA, 955 bp, Saccharomyces cerevisiae
acaagtttgtacaaaaaagcaggctcctgcaggaccatgagtttgagaacgccgaagagaagcaggactagcgatgaacaagaacaagaacaagaacaagagcaggtacagaacccagatacacatgtaaacaacgagcatcagcagcgacctgggccaaccactctattgagcacgccagtacgtctcaaaaatggctttggaacaccatcgccgccgtcaccaccaggcataacgaaaagcatcactaaatcgagaagaaggccgtcgacaacgagtcttcagggtatattcatgtcgcccgtcaataagcgtcgtgtcggcataaccgcacatggacgtgtatatgaccataacgacgacggacacgaaagtgagagtgaggacgacgaaaatgaagaagaaaatgaaaatcaaaagaagtacgacggacacgttagtatgcctttgttgccaccgacaacgcccaagtcaagacggtcggaggtgtttctgtcgccgtcgccgcgtttgaggtcacctccgacggctgcgcgtcggtctacgggcgagcggcccatccgcgaaatatcacatactttgcgcaccaggctcaattacgcgttagtcaagctgcaaaatggatggacggacaagacacttcccgagctggagacggagcttgctccagcagtgcagacgccgccacgtcgctatcacaacagatttccagatagtgcagacgcgggtacttccgcgcatacagcgtttcttcaggcgctcggaggccacccaccacgggaggaggccacggctgtcgaaacactgatgctattgtcgtcgcctaccaagaagcaacaacaccgacccgtgccggcgacatctgctggagaacccacggacgaaacggagcccgagtcggataccgaagtggagacgtcttaactcgagacccagctttcttgtacaaagtggt

SEQ ID NO: 730 - DNA, 899 bp, Zea mays
ttcttgtttgttgattaacccttaattaatccgggcgcgcctgatttatcacaagtttgtacaaaaaagcaggctcctgcaggaccatggaggattgggattctgaagatttccagcccgttgctcctgttgtgaaagtcgagccacttaaaaatcagtgggctgatgaagatgtcgatgccgacgacgtaaaagattcatgggaggaagaagaggaagaggagaaacctaagccagcggctgtgcaaaagaacgcgacgaaacctagcgctaaggctcctgctaaaaagggaaaacagcaagcatcaacaagtgccgaggaaccagacgagcctttgagtcccacttcagagaaaattcgccaacagaggcttgtggaagaagctgacttcaagtcaactacagacctttttgcaaagaagagcggtgaacaaaagtcactagatacttttatcccaaagtccgagagcgactttgcggaatacgcggagcttattgcaaataaactgctcccctacgataaaagttttcactacatggctctcctcaagaatgtcatgagactttccatgacaccgttgaaaggctcggacgcgaaagacatatcttcctccgtgacggcgattgctaacgagaagatcaaggctgagaaagaggccgcagcaggcaaaaagaaacaaggagcgagaaagaagcagctccacatcgagaaaggagacgacgacttcatccccggacggggtggtggctacgatgacccggacgagtacgacttcatgtgatttggctggaaggaagagtaagtagggttaataggtttccgtcttgtctcgagacccagctttcttgtacaaagtggtgataaattggagctctgcagagctttcgttcgtatcatc

SEQ ID NO: 731 - DNA, 2073 bp, Zea mays
  misc_feature (1)..(111): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctcgggaatggcgcttaaggccacggcgcagggcgccgcggaggcggccgtagcggccatcggccggggctacgacgttgtttccgacgtccgcctcaagtactgcaagggcaagctcgcggacccggacgcgcgactcattgacgtttcccgcgatggggtccaggacgtcctgctccccggcgggatcaaggtcgctgccgtccccaagtccgtcacgtgtgacaagggcgagcgcacgcggttccgctccgacgtcctctcctttcagcagatgtcagagctgttcaaccgggagctatcgttgaccgggaaaattccctccggcatgttcaatagcatgtttgatttttccgggtgctggcagaaagatgcagctaacaccaagtcacttgcttttgatggttggtacatttcgctatatacgctcgcactgtcaaaatctcgtattctactccgggatcatgttactcaggcagttccttcaacctgggaccctgctgctttggcaaggtttattgataagtttggaacacacatagttgtcggtgtaaaaatgggagggaaagatgttatatatttgaaacaacaacattcgtcaagcttgcaaccagctgctgtgcagaaacgactcaaggacatgtcggacatgagatttctggatggaaatggacagtatgacatgaacaacaagcatgtgcacgggaaggacaagcatgatgcaagagatcaacggctaagatttgtggaatcaagtccgtcaagttcatactgttcaaaggaggacttggtgatggtggttaagcggagaggtggaaaggaatgggacaaagatatgcctcacagtgaatggataaacactgttcaatcagaacctgatgttatctcaatgtcctttttacctattacttcattgttgagcggagtacctggctgtgggtttctgaatcatgcaattaatctatacctgcgctataagcctccgattgaagaactacatcaatttttggagttccaactaccaagacaatgggcacctgtgtacagtgaccaccctcttggtcctcagaggaggaaacagagcagtgcatctttgcccttaagttttatgggaccaaggctctatgtctgcactaatatggttgatgtgggtgaaagacctgttactgggatccgattgtatcttgaggggaagaagagcaacatgctggcaatccaccttcagcatctatgctcgcttcctcagatcctgcagctccaggatgatccatacaaccaccggtatccagaaccagaaccagaaccatatgaccgcaagtatgtggaaccatttggatcctggaagcgtttctcacatgtttacacggcaccagtggagtcggatgacgacgactccatcgtgacaggggcgcagttacatgtgagcagccatgggttgacgaaggtcctcttcctccgcctccaattcgccagagtcagcaatgctgcgctcgtcaagaatcccgagtgggaagggtcaccgaatttggggcagaaatctggcctcatctcgacgcttatcagcacgcatttctccatggcggctcagaagcctgcccctcgccctgctgatgtgaacatcaactcggctgtgtaccctggcggtccgccaacgccagtgcaggcaccaaagctcctcaagtatgtggacacggcagagatggtgcgcggaccacaggacacgccgggatactgggtggtctctggtgccaagctgcagctggagaggggcaagatatcactgcgggtgaagtattcgctcttgacagccatggtacctgacgaggagtatgaagaatgaacaagggtgggaggaactcagtctcaaaagggggaagatgggggctagctaatgtgcatttgtgcattgcaagtaaagagtttcagcatgcttctttggaaacctgacttatgtgcatcg

SEQ ID NO: 732 - DNA, 2007 bp, Zea mays
  misc_feature (1)..(64): n is a, c, g, or t
nnnnnnnnnnnnnnnnnnnnnnnnnnnnnnnnnnnnnnnnnnnnnnnnnnnnnnnnnnnnnnnntgctggtagcctcacgggcggaggagcgctcacgctgaggcggcggccggggagcgatgcaggcgccggagcagcagccgcagcagcagcagcagcggaggaagggttcgtcagagatggacttcttcagtgaatacggcgatgcgaacagatacaaaatccaagaggtcattggcaaaggaagttatggcgttgtttgctcagctgttgaccaacatactggtgacaaggtggcaatcaagaaaatacacaatatctttgagcacttatctgatgctgcccggatcctacgtgagatcaaactgcttcggctattacgccatcctgatatagttgagatcaagcatataatgctgcctccatcaaggagggacttcaaagatatctatgttgtatttgagctgatggatacagacctccaccaagtcatcaaggcaaatgatgatttaacccgagagcatcatcaattctttctctatcagatgctccgtgcactgaaatacattcataccgctaatgtttatcatcgtgatttgaagccaaagaatatattggctaatgctaactgtaaacttaaaatatgtgattttggattggcaagagtggcattcaatgacactcctacaacagtattctggacggattatgttgctacaagatggtatagggcccctgaactgtgtgggtctttcttttccaagtattcgccagctattgacatatggagtatcggttgcatttttgcggagatcttaactgggaagcctttatttcctggaaaaaatgtggtccaccagttagatttgatgactgatctcttgggtactccatcacttgatacagtttccaggattcggaatgagaaggcaaggaggtacttgagtagcatgaggaaaaaacagccagtaccatttactgaaaagtttcctaaagcagatcctgctgcactcaaacttttgcagaggcttttggcatttgatcccaaggataggccaactgctgaagaggcattggctgatccgtattttaaaggcctcgcaaaagtagagagagaaccatcatgccagccaataacaaaaatggagttcgagtttgagcgaaaaaaggcgaccaaagaggatgtcaaggaacttatattcagggagatattggagtatcatcctcaacttctcaaggattacatgaatgggactgagaaaacaaactttctatatcctagtgctgttgaccatttcaggaggcaatttgcaaacttggaggaaaatggaggaaagagtggggcacacgccgcttcatcagacaggaagcatgtttcgctcccaaggacaaccacagttcattctaatccaatccctccaaatggaacctcccaggttcctcaaaagattcccacaggtagaccaggaagagtggttggtccagtaataccatttgagaacgcagctgcagttgatccatacagccaacgtagggtctcaaggaatccagtacttcctccaaccacgtcgaacatgtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttcctactacataccaaaaggtgtcccaaaggctgatcccgcagatagaaccgctctgcattctagcatgattcatgggatcgcccctttcagtggcattgcagctgttggaggtggctacaacaaggtcaatgcagttcagtatggagtttctaggatgtactagttctagttgcattggccatctccgaattcctcagctgatgagttgaagtaataacatggcgaagaccagatgtaggtaccgaagaactgccataccggctctgagccaaagatagaaaac

SEQ ID NO: 733 - DNA, 1638 bp, Zea mays
  misc_feature (1)..(64): n is a, c, g, or t
nnnnnnnnnnnnnnnnnnnnnnnnnnnnnnnnnnnnnnnnnnnnnnnnnnnnnnnnnnnnnnnntgggaaggagggactagggctcgattggagggaaaggcgcgatcttggaggttcccatgggcggatgcctctcgcaggaggagcaccggctccagagcaggccagctgaagctgctggagcagatggattgcggaagtctaaatctgattctaaagctgtagcaagtgttcttgctcctccaaaagatgtggtggacctgcaagtagaaggatatggaaatgtgaatattttcacatatgacgaattaagagcagccacaaaaaacttccggccagatcaaattcttggagagggtggatttggagttgtttacaaaggtgtaattgatgaaaatgttagagcaggtttcccatcgagacaggttgctgtgaaagaactaaacccagagggctttcaaggggacaaggagtggcttgcagaagtcaactatcttgggcaacttagtcatccaaatcttgttgaattgattggctattgctgtgagggttcacatagactgcttgtctatgagtacatggcttgtggaagcctcgaaaagcacctttttcgccgggtttgccttaatatgccatggtcaacacgcatgaagattgcattgggtgctgcaagggggctcgagtaccttcacggagctgagagatccatcatttatcgagatttcaagacatcaaacatcttgctagatgcggattacaatgctaagctttcagactttggtctcgcaagaacaggtcctagtggagaccaaacccatgtgtcaactcgggtcatgggaacttatggatacgcagctccagaatatgtcatgactggccatctgacggcacgaagtgatgtttatggcttcggagtggtgcttctagagatgattatcggaagaagggctgtggacaagagccggccaagccgtgagcataacctagttgactgggcacggcccctcctcgtccataacaggaagctgttccgaataatcgatccgagaatggaagggcaatactccaccaaggctgccactgaggtggcaagccttgcataccgctgcctgagccagaaccccaagggacgaccaaccatgagccaagtcgtcgagacctttgaggccgtgcagaacatgcctgaatgccaagacatactcctccagaacagcatcacaggtgccgtgacgctctatgaggtccccaaggagcctgcagacagagttgagctggagaaggccaagcaggaaccggcagtaaagagcgccgcgatgccgcccatgaacggaaagccagtcccccagagcaggcggacgcggcctgggaatggccggagcaagagcgagccatcgttggagtgcaagatgtacatcccgtcaccggactctgatggacaccagctcggcctggaggcagtcgcatccccagatggaagcataagggaccctcctgatgaggatttgtacaagatataacaccagggcagtttttcttcaacaacgaggggcagatctggcgcagtgttgagttgtgggttttcaaaccagcctcttcgcatttagggaggaagatttgcatctgtttatctctttctc

SEQ ID NO: 734 - DNA, 1749 bp, Zea mays
ggtgggtcgcgcacctccaccaacctaccttcccgccccgcccgtcgccgtcgacgactcgccgtccgtttccgccctccaaaaccctactacctcttaccttccagccccgcgtcctccatggccaccaacggcagctctccgagggttcgggacacggagagcagtctggagaaggtgaagcggcagctgtcatcggggtctgggaggtacctgctgcaagggcccctgctcaagcgatctgagacgttacggaaatggaatgagcgttgggtcatattggacccgacatcaggaaagatggaatacaaactccggagaaatgaaactgccattaaggggaccattctgtttgacgcctcgagcaccattactttatctcctgtgaactttcaagggatgccaaaatataatggctgctgcttctacatcggaactcctcaaaagaaggattactttctttgtgctgaaactcctggtgctgcgaaagcttgggtatctacattacatgcaactcagttagtcttacgagctcataaagaggcagtaaattctttggctgggaatggctctccagctacattaggcacagttgctactgcagttgctaatgctaatgcaacagccatggaggctaccaaggagatagaagctgcactaaaggtttcaatgagggcagctcttgggttggatacaaataactccaacgagggccaacttgatgacctaacaatcatgaaggagaccctacgagtgaaagatgaggaattgcaacatttggctaaggatattcgttcccgagatgctacaataaaggaaatagcggacaaactaacagaaactgctgaggctgcagaagctgctgcttctgcagctcatacaatggatgaacagaggcagcttttgtgttcggagattgagcgactaaaacaagccttggaaagacaaatagaacaatcagtggttaagcttagacaatccgaagagaaggttatcagcctgagcaaagagaaggagcagttgatgaaggaaagagatgctgcatttcaggaggctcatatgtggcgcattgaactagtaaaagccagggagcaagcagtgatacaggaagcaactattgcccgagcagaggagaaggctagagtttctgaagcagatgccgcagctcggatcaaggaagctgctgaaaagttgcatactgttgagaaagaaaaggaggagcttctagccctggttggtgttctccaatcacaagtcctgagagagcagagcagcacaaagcaagtatgcgaggagaggtctgaatcatgctcaggcgccgataattcacctctgttgacaaagcatgttgacgcatcagacgatgatgtggacaaagcctgcgtaagtgactctagatcggtcccggtttcgagcgatagcactgaggtccagctggctgtggatggggtggacatccgtcctgttggcgatgcagagtggagtagcttccagcagccagaagcgctgatcgctgatgtccgggaggtctccccagaggcggacggcggcagcttggatattcctgtggtcaatcccccaccagtcagtgatcatatccagggaggcggcggcgcaacccatccctgaaggcctgaggttgctgctaccttccgagattggtgtggttgctgagaacccaatagatagggatgtctaaatctggagagaagtgccgttgagagtgtatgcggattgtatgtccattgt

SEQ ID NO: 735 - DNA, 1790 bp, Arabidopsis thaliana
atgaagttgaagttgtcatcaatctccatgaatcataagaatgtgcttctcatcaagctcatctccgctattctgatatcttttttcgcgttccgtctcttcattctccactccagcgagttttctccaatctttgcgtcggtcaccggaaaattcgaagctcggtttctgccgccggagattatcgtaccggaaaatgaagatctgattcctcaaggtaagatcagttatttagaaagcaaaagtatttgacttctatgtgtattgtccactgtgtttgactgtttgtgactaaaccttgttttgtgagcacaattatgatttatgagatctaagggttttggatctacaagatttaaagctctgtttacgtttttttttagattgtggtttagagaatagaaaaaaggaaatgacaattcatggatcttgctcttctaatttaaagttattcttgtggtgacttgtatcatttgataagtgatgctaattagctgcaatgttcaaagactggtttctaataaattgatcttggactagtgttacaacattttgtatcaaagttgatctcacattgagacttaattttttttttgggtggttgttgtttcttgaatcagatattgaagtagagaagtgtgatcttttcgccggaaaatggatcccagattcagtaggaccaatctacacaaacaaatcatgcggatcactcattgacggtcaccaaaattgtatcaccaatggccggcctgacttagattttctctactggaaatggaaacctcatgactgtttgttaccacgttttgaccctagaagatttcttcaacttatgaggcataaatcttgggcatttattggtgactccatatctcgtaaccacgtcgaatcactgctttgtatgctctctacggtataacacttgcttgcttttaacatatctttgtttcgactttttttacttttcaagttcttgagaaactcatttttgtttggggtctctccagattgaagaaccggttgaagtataccatgacatggagtacaaatcaaaacgttggcatttccctttacataaccttactgtatccaacatatggtcgccatttcttgttcaagccgctattttcgaagattctaacggtgtctcgaccgcttctgttcagctacatcttgatagactcgatgagacatggaccagtctcatgcctagcttcgactatgcgatcatctcaaccggtaaatggtttcttaaatccgcaatttaccacgaaaatgcaaaactcgtcggttgccataactgtcaggaaaaacctcacatagaagagttaggattcgactatgcttataacgcatcgctgcataatgtcatggactttctagcagctgaagataacagtaaaggcacggttttctttcggacttcgactcccgatcatttccaaaacggggaatggcatagtggcgggacgtgtaagcaaacagagccggtgagcgatgaggagattgagattaaggatgtacataagatactaaaagatattgagattgatcagttcaagagggcggttagagagaagactaaccaggacggtgggaatctaaagcttttggatttcacccggatgttgctgacccgaccggacggtcatccgggtgagtaccgacagttcaggccgtttgataaagacaaaaatgcaaaggtacagaacgattgtttgcattggtgcttgcctggtccgtttgattacttgaatgatgttatattggagactatagtaaatggctga

SEQ ID NO: 736 - DNA, 1104 bp, Zea mays
ttcttgtttgttgattaacccttaattaatccgggcgcgcctgatttatcacaagtttgtacaaaaaagcaggctcctgcaggaccatggcggcggcatgggcagtgctggcggcggtcctcgtcgcggcgcaggtggcgtctgcggcgccggtcacggcgccagcgttcctctgggcgcctaagaactacggattccgctctgatgatgctaaggaggtagtccattatcaaacaatctcaccaaagaacttagctaaatctgttcttgaggaaggtggctggtcaacctttatgtgttcaagggaggatactgagaagcatgttgatgttgccattgtttttattggctcaaagctacaatcatcagacatatcgaaagataagcaagttgatccagctttagcagatacattgaagctctccttcacagaatcagagttttctatggcattcccctacgtttccacatcagacgatgagaaactggaggagtcattgctatcaggcttcactgagaactgtaaaagtggttttggaagaaaccgtatcacctacacagacacgtgcgccgtgagtggccaagatctgaagacgtatcacaacatggatgctatcaatgacttggtagtgtcaggaagaaccaacccgagtggacagactgatgtaatcgtcttctgcagcggcgggttcgagaagttaggcaccacggaatcggaaggggagctgctttcccagcttgtcgacttgctgaagctgtctggggctagacacacgattctctacgcttcccagccatctggttatctactggagaacccttccggctcgccagtggctaggcaccttgcggagaggactaacggtacaaaaactggcctactgagcaaatgtgacggagagtgcctagtcaaatcaactcttcttgaaggaacctttgtcggaatagtgctccttatcatcttgatatcagggctcatgtgtatgatgggaatcgatactccctccaagtttgaagctccccaggagtcttgactcgagacccagctttcttgtacaaagtggtgataaattggagctctgcagagctttcgttcgtatcatc

SEQ ID NO: 737 - DNA, 1452 bp, Zea mays
ttcttgtttgttgattaacccttaattaatccgggcgcgcctgatttatcacaagtttgtacaaaaaagcaggctcctgcaggaccatggcgatgcgggccgctgcgcgtcaagccatactctctccaccgcttgggccccgcagtcctcgccccttcctctgtggttgttccttgtctatcgctcctcggttggagccgtgccgagcggcgagctccaccaccgcgccggccgccggaaagcatctccctccattgttcagcgtcgcgccgatgatggactggacggacaaccactatcggacgctcgcgcggcttatctcgcggcatgcctggctttatactgagatggtcgtcgccgagaccatcgtgcatcagaaggataacctggataggtttctagcatttccggaggaacaacatcctattgtgctgcagattggtggaagtaaccttgaaaatttagcaaaagcaacagaactggcaaatgattattcatatgatgagatcaacctaaactgtggctgtccaagcggcaaagttgctggtcatggttgctttggtgctcgcttaatgtttgatccagagtttgtaggagatgccatgtcaactatcgcagctaattgtgatgtcccagttagtgttaaatgcagaattggtgttgacgatcgtgattcttatgaagaactatgtgaatttgtagataaagttatctcaaaatctccaaccaggcatttcattattcatgctcggaaggcattgcttagtggtctcagtcccgcagagaatcggaagattcctccattgaaatatgagtactattttgctttgttgcgggacttcccagaaataaaatttactctaaatggtggcataaccaatgttagtcaagttagtgcatccatgagacaaggtgcacacggagttatggttggccgggctgcttataacaaatttgctggactttccagtccatggaacatgctaggacatgtggatggggaaatctatggcaagcaaacaagatacatttctcgtcgccagatacttgagaactaccaagcttatggtgattcaataattgaccagtatggccccagcaggccaaatgtgagacaacttgtcaagccactgttaaacttattccactcagaacctggcaacagcctatggaaacgcaaagctgactctgcattgcgtcattgcaagacagtgaaaactttcttggaggagactcttgacgcaatatcggacagcgttcttgacaagccagtaaacagggaaccatccagtgacgaagaatattttgctagtgtcgattctctgttgccaccaaaatacacgacaccgatgcatgaaagacttgtagccgcatccacttgactcgagacccagctttcttgtacaaagtggtgataaattggagctctgcagagctttcgttcgtatcatc

SEQ ID NO: 738 - DNA, 2154 bp, Zea mays
ttcttgtttgttgattaacccttaattaatccgggcgcgcctgatttatcacaagtttgtacaaaaaagcaggctcctgcaggaccatggctgcggcgcggcacgggggttataggagcttcgacgtggccaggaggcgggagttcgacctggagcgttctaggaggagcaaggagtaccgctactcgagccgccaccgcgactcggatcgccaccgtgatggcagcaggggccgtgaagtgcccaacgggtacatccgccaccgctcgccgtatgcgccaccgaagagccgaccttcaaaaaggaaggacgataaggagcctggtgaggtctcaagcgatagcggctcggagtctggtgggcgcccaccagtgctgagggaggatgggggtcttggggtctgcagggatggaggtgcgttgccagcaagcaagaagaggaagcactcacctggattccacgatacgaatgtttcaaagctgcgggcaagagatgaggtgtggagcaggagaggacctgatgccatagctgtggagctccctcttccttcgccaccccctatgtctgcggttggtgggtgctcaccaatggatccagaagttttggtagttccaaatgatgctgaaaggatggacgcgattactgagggggaagaggattgtgcaacgagaaacatttttacttcaaggtgggcggatgctgctgaagaggaggaagtggtgattgtgcctaagaagaagaaaagtgtgccacctgctcatttgcctgaacagaaatccacaaagaaaatcatgggctcagagctgggagaagcgatgggcagtaaaacatcaagaagaagttcctcaagttcgtctaactcgatgggtagtgaaaactggaatatcgaggtagacgagggtgatggcattgattcttctgttggttgttcgctggatactcattccaggagcaatatgcgtaggtctggatcacctgaggttgtgcgaacaccacgtaggtgctttaacatgcttcagggctgtaggagtattgatgactttgagaggatcaacacaatcaatgagggtacatatggagtcgtatttagggtgagagacaagaaaactggtgagatagttgctttgaagaaggtcaaggtagataaggaaaatggacgggaagggtttccattgacttctctcagagaaatcaatatccttctatcctttgaccatccttcaattgtggatgtcaaggaagtagttgttggtggtcatgacgatgatacttttatggtgatggaatacatggagcatgaccttaagggtgtcatggaggcgatgaagcaaccatatagccaaagtgaggtcaaatgtttgatgcttcagctgctagagggcgtgaagtatcttcatgacaattgggtacttcacagggatctcaagacatcaaatctcctcttgaataaccgcggtgagttgaaaatatgtgactttggactctctcgtcaatatggcagcctgctaaagccttacacccaaccagttgtgactttgtggtacagggctccggaactactattaggagcaaaggagtattcgactgctatcgatatgtggtcattaggttgcataatggcagaactcttgtcaaaagagccactcttcactgggaagtctgagatagatcaacttgataagatatttagaatactcggcacacccaatgaggagcggtggcatggttgttccaaattgcctggcttcaaaggcaacttcgtaaagcgaccgtacaatagattaagggacaaatttccagctgtatccttcacgggaggcttgaccttgtcagaagctgggtttgacctgctaaataggttgttggcatatgaccctgagaagcgcatatctgctgctgatgccttgaaccatgagtggttccgtgaagttcctctgcccaagatgaaggaattcatgccaacttttcctgctctgaatgaacaggacaggaggatcaagagatacatgaagagccctgaccccttggtggagcaacagatgaaagaacaagggagcataggagatcatggcctttttgactgactcgagacccagctttcttgtacaaagtggtgataaattggagctctgcagagctttcgttcgtatcatc

SEQ ID NO: 739 - DNA, 1442 bp, Arabidopsis thaliana
ttaattaaaaaggtaaacgttataataaaagaaaaaaaaaatatgacaacggcgttgttttcaccgtctaaccgtagaaaacgccgtctcacacacttcttcttcaccgtactcgctttcatcttactcgccgccttcatctacggccacgatttcatctctttctctcgtcgatctcttcactctccgacgatcgtccaccaatccgcaatcgtcgttgtagttgacgaacctcctccgcctccaccaacatctcctcctccgccttctcctccaccaccgtctcctccaccaccatctcctccaccgccatctcctccgccacctgcttttgcagtaggtaaaacgccggaaggatgcgatgtcttcaaagggaattgggtcaaagactggtcaacgcgtccactttacagagaatccgagtgtccgtacattcagccgcagctcacttgccgcacgcatggccgtcccgatagtgattatcagtcatggagatggcgacctgattcctgctcacttccttcgtttaatgcgacggtgatgttggagagcttaagagggaagaagatgatgttcgttggagattcgttgaacagaggaatgtatgtttctctcatctgtcttcttcattcacaaatcccagagaactccaaatccatggatactttcggatcactcaccgtcttctctctcaaggattacaatgcaacgattgagttctattgggcaccgtttcttctagagtcgaattcagataacgcaacagttcatagagtatcagatcgaattgtgaggaaaggatcgatcaacaaacacggtaggcattggcgaggggctgatatagttgtgttcaacacatacttgtggtggaggactggcttcaaaatgaagatcttggaaggttctttcaaggatgagaagaagagaatcgttgagatggagagtgaagatgcttatagaatggcgttgaagactatggttaaatgggtgaagaagaatatggatccattgaagacgagggttttctttgctaccatgtctcctactcattacaagggcgaggattggggaggcgaacaaggaaaaaattgttacaatcaaacgacaccgatccaagacatgaaccattggccatcagactgcagcaaaaccttaatgaaagtgataggagaggaattagaccaaagagcagagtttccggtgacggtacttaacattacacaactctctggctatcggaaggacgcgcacacgtcaatctacaagaagcaatggagcccattgacgaaggagcagctagcaaatccggctagctactcagactgtatacattggtgcttgcctggtcttcaagatacttggaacgagcttttctttgccaagttattttatccatgattcttttctctaaattcaagatttttttagggcgcgccaaaaat

SEQ ID NO: 740 - DNA, 1176 bp, Zea mays
ttcttgtttgttgattaacccttaattaatccgggcgcgcctgatttatcacaagtttgtacaaaaaagcaggctcctgcaggaccatggccccgctcgtgccgatgtcgcagccatgggtggagaaataccggccgaggcaggtcaaggatgtggctcaccaggaggaggtgattcgggtgctcaacaacaccctccagaccgccgacctgccgcacatgctgttctacggcccgccggggacgggaaagaccaccaccgcactagccatcgcctaccagctctacggtccagagctgtataagtcaagggttttggagctcaatgctagtgatgatcgtggaattaatgtggtgaggacgaaaatcaagaactttgctgctgttgctgttggtactgcacggaaagctggttatccctgcccaccttacaagattattatacttgacgaagcagattcaatgacagaagatgcccagaatgctttgaggcgtaccacagagacttactccaaagtgaccagattcttttttatatgcaactatatcagcaggataatagaaccacttgcatcaagatgtgcaaagtttaggttcaagcctctttcagaagaagtgatgagtagtcgcattatgcatatatgcaatgaagaaggcctcaatcttaatgctcaggcgatgtccacactgagtgtcatttctcaaggtgatcttcgtcgtgctataacctaccttcagagtgcagctcgcttatttggatcttctatctcttccagtgacctgatcagtgtttctggggttatccctgaagatgttgtcaagtcactgcttgcagcctgcagatctggtgaatttgacgtggcaaacaaggaagttagcagcattatagcagatgggtatccggtctcacagctgatggcacagtttctagatgttattgttagcgcggatgatattccagatgatcaaaaggcaaggatatgtaaaaagcttggggaaaccgataagtgcttggttgatggggcagatgagtatctacagctgctggatgtcgccagcgagactatccgctctcttttcaacatgccgcggacgctggtcttctaactcgagacccagctttcttgtacaaagtggtgataaattggagctctgcagagctttcgttcgtatcatc

SEQ ID NO: 741 - DNA, 963 bp, Zea mays
caaaaaagcaggctcctgcaggaccatgctacggcggaacatacgtcagcgtcgggagtacctgtactccaagagcctcgagggcccccagcgggcgctgttcgagaagaagcgccggatccgggcggcgctcgaggagggcaagcccatccccaccgagctccgcaacgaggagcacgacctgcggaggcagatcgacctcgaggaccaggagcgtcaagttcccaagagcatcgttgacaacgagtacgctactgccaccattcgggagcccaagatactattgaccacttctcgcaatcctagcgcgcccctaactcagtttgttaaggagctcaaggttgtcttcccaaactcacaaagaatgaaccgtggtggacaggtcatatcagaaattgtggaggcctgccgctcacatgatataacagatcttattctggtccatgaacaccgtggtcaacctgatggtttgattgtctcccatctaccacatggtccaactgcatactttgggttgctcaatgtggtgacacgtcatgatatcaaggacaggaagacgatgggcaaaatgtcagaagcttacccccatttaatactggacaacttctcaacccagattggcgaaaggactgcaactattctgaagcacctctttcctgtcccaaagccagattcaaagcgaataattacatttgctaacagagacgattacatctctttcaggcatcatgtatatgaaaaaccaggtggccccaaatcgattgacctgaaggaggtcggcccccggttcgagttgcggctgtaccagatcaaactaggaaccgtggaacaaaaggaagcgcagagcgagtttgtgctgcggccctacatcaatactgccaagaagcaaaagacgcttggagcgtgactcgagacccagctttcttgtacaaagtggtgataaattggagctctgcagagctt

SEQ ID NO: 742 - DNA, 1158 bp, Zea mays
ttcttgtttgttgattaacccttaattaatccgggcgcgcctgatttatcacaagtttgtacaaaaaagcaggctcctgcaggaccatgggatctgttgcctccgcagcagcgccaccttctcctcactcagcgctaccccaggagggcgcgccgccctatggccccgggctcgccgggatcctcccgcagacgtcagtgggagaggagaagaaggaggagaaggtggactacctcaacctcctctgccccgtgcccttcgaggagatccagcgcgaggctctcatgtctttgaagcctgaactttttgaaggattgaggtttgacttcacaaaagggttgaatcaaaagttttctcttagccacagcgtttttatgggctccttagaagttccagcccaggggtctgaaactattaaagttccaactgctcattatgaatttggtgccaattttttagatccaaagttaatgctcattggaagggtgatgacagatggaaggcttaatgctcgcgtgaaatgtgatttgacagacaatctgatgctgaaagtaaatgcacagcttacccaagaggcacattactcacaaggaatgtttaactttgactacaagggaagtgactatcgagcacaattccaaatagggaacaatgcattctatggtgcaaattatattcagagtgttactccgaacctatcaatgggaactgaaatgttctggcttggtcaccaaaggaagtctggaattggttttgcctgtcgctataacacggacaaaatggtgggcactctacaggtcgcaagcactggaatagttgccttaagttatgtccagaagatttctgagaaggtttcccttgcgtctgatttcatgtataaccatatgtcaagagacgtaacttccagctttggttacgattacttgcttaggcagtgccgtctaagaggcaaaattgactcgaatggtgttgttgcggcatatctggaggagaggttgaacatgggtgtcaactttcttctatctgctgagattgaccattgtaagaagaactacaagtttggtttcggaatgaccgtaggagagtaactcgagacccagctttcttgtacaaagtggtgataaattggagctctgcagagctttcgttcgtatcatc

SEQ ID NO: 743 - DNA, 1702 bp, Arabidopsis thaliana
atcaaatctcaaacttgcaaagaaacttgaaatattttataacaatgggtgattctactggtgagccggggagctccatgcatggagtcaccggtagagaacaaagctttgctttctcggtgcaatcaccaattgtgcataccgacaagacggccaagttcgaccttccggtggacacagagcataaggcaacggttttcaagctcttctccttcgccaaacctcacatgagaacgttccatctctcgtggatctctttctccacatgttttgtctcgactttcgcagctgcaccacttgtccctatcatccgggagaatctcaacctcaccaaacaagacattggaaacgccggagttgcctctgtctctgggagtatcttctctaggctcgtgatgggagccgtgtgtgatcttttgggtccccgttacggttgtgccttccttgtgatgttgtctgccccaacggtgttctccatgagcttcgtgagtgacgcagcaggcttcataacggtgaggttcatgattggtttttgcctggcgacgtttgtgtcttgtcaatactggatgagcactatgttcaacagtcagatcattggtctggtgaatgggacagcagccggatggggaaacatgggtggcggcataacgcagttgctcatgcccattgtgtatgaaatcattaggcgctgcggttccacagccttcacggcctggaggatcgccttctttgtacccggttggttgcacatcatcatgggaatcttggtgctcaatctaggtcaagatctgccagatggaaatcgagctaccttggagaaagcgggagaagttgccaaagacaaattcggaaagattctgtggtatgccgttacaaactacaggacttggatcttcgttcttctctacggatactccatgggagttgagttgagcactgataatgttatcgccgagtacttctttgacaggtttcacttgaagctccacacagcagggctcatagcagcatgtttcggaatggccaatttctttgctcgtccagcaggaggctacgcatctgactttgcagccaagtacttcgggatgagagggaggttgtggacgttgtggatcatacagacggctggtggcctcttctgtgtgtggctcggccgcgccaacacccttgtaactgccgttgtggctatggtgctcttctctatgggggcacaagctgcttgcggagccacctttgcaattgtgccctttgtctcccggcgagctctaggcatcatctcgggtttaaccggggctggagggaactttggatcagggctcacacaactcctcttcttctcgacctcacacttcacaactgaacaagggctaacgtggatgggagtgatgatagtcgcttgcacgttacctgtgaccttagttcactttcctcaatggggaagcatgttcttgcctccttccacagatccagtgaaaggtacagaggctcattattatggttctgagtggaatgagcaggagaagcagaagaacatgcatcaaggaagcctccggtttgccgagaacgccaagtcagagggtggacgccgcgtccgctctgctgctacgccgcctgagaacacacccaacaatgtttgatcatacattccacccacggtggaatggtgaaggatgatcgcatataagaatatgtcacacagtga

SEQ ID NO: 744 - DNA, 1340 bp, Arabidopsis thaliana
gttgattaacccttaattaagtcaaatcatgcaaccttcaagaacaagagtttcattttttgaaacaggagagaccatgaagcaaagaaagaagagttatctctcaatcttcgtgatcttcttctctcttttcttcttcgggatcttcatgtacaatgacaacctcaaatcctccattgctgacttcacatcttcgaacccattctctagttcatttgtggagttgccgccggatgagtgtgatctgttcaccggtcaatgggttttcgacaacaagacatatccattgtataaagaagaagagtgtgagttcttgacggagcaagtgacttgtttaagaaacggaaggaaagattctttgtttcagaattggagatggcaacctagagactgttctttaccaaaattcaatgcaagagtgttgttagagaagctgaggaacaagagattgatgtttgtcggtgactcgttaaaccggaaccaatgggaatcaatggtttgtttggttcaatcagtgattcctcccggtagaaaaagcttaaaccagaccggttcactcactgttttcaaaatccaggactataacgcgacggtggagttttattgggcgccatttttggtggaatcaaattcagacgatccggaaaagcacagtataatcgaccgtataataatgccagagtccatcgagaagcatggagtcaactggataggcgttgactttcttgtcttcaatagttacatctggtggatgaatactgtctccatcaaagtcctacgtggatcgttcgatgatggggacacagagtatgatgagatcaaacggccaatagcgtacgagagggtgttgaggacattgggagattgggtggaccataacattgatcctctaagtacaactgttttcttcatgagcatgtctcctcttcacatcaagagctcagattgggctaatcctgagggtataaggtgtgctttagagacaacaccgatcttgaacatgtctttcaacgtggcttacgggcagttttccgcggtggggacggattacaggctgtttccggtggcggaaaacgttacacagtctctaaaagttcctattcatttcctcaacattactgcattgtctgagtatcgtaaagatgcacatacttcggtttacacgatcaagcaaggcaagttgctgacgcgggagcagcaaaacgatccagccaattttgctgattgcatacactggtgcttaccaggccttcctgatacatggaatgagtttctctatacacatattatttctcgaagatgagattctttcaatttaaatacccagcaaattggagctc

SEQ ID NO: 745 - DNA, 1434 bp, Zea mays
ttcttgtttgttgattaacccttaattaatccgggcgcgcctgatttatcacaagtttgtacaaaaaagcaggctcctgcaggaccatgcaaagggacactagctctagcgatgtttctgcttctcatgtagggcgtgtaagacgtcgcaaacatccatctgaggcttccacagatgggaatagagctaatggacaaccgttgcttgtcaatgatcagaacaagtataaatcaatgcttatccgtacatattctacagtatggatgattggaggctttgcctttattatttatgtgggtcatctatatatctgggctatggtggttgtgattcaaatatacatggcaagagaacttttcaacctactcagaaaatccagtgaagagaaacaacttcctgggttcaggctactgaattggcacttctttttcacggcaatgctgtacacttatgggcgctttcttagtcggcagcttgtgaatacagtaacttcagatcacttgctttataaggtcgttagtggcctaataaagtatcagatgtttatctgttattttctttatattgcaggttttgtatggtttattttgactctcaagaaaaagacatacaagtaccagttcaaacagtatgcctggacgcacatgatacttctaacggtttttgcacagtctgctttcactgtggcaaacatatttgaagggatattctggtttcttttgcctgcttcacttattgtgatcaacgatatatttgcttatttatttgggttctttcttgggagaacaccattaatcaagttgtccccaaagaaaacatgggaaggttttattggtgcatccgtgacaactatcatctctgcatttctgttagcaaatgtaatgggccgtttccaatggttgacatgcccaagaaaggatctgtcaactgggtggctttattgtgatcctggtccaatgtttaagccagagcattactcattgggagagtcggtgccacattggttcccatggaaagatctagccattatgcctgtgcagtggcatgctttagccctaggtttatttgcgtcaataatagcaccatttggaggattttttgcgagtggcttcaagagggctttcaaaataaaggattttggtgacagcatacctgggcatggtggaattactgatagaatggattgccaaatggttatggcagtgtttgcatacatataccaccagtcattcattgcacctcagaacttctctgttgagataatcttggatcagattctaagaaacctgacctatgaggagcaaaaatacctatatgaacaacttggggaaatgtttcatgagaggcaattagggcaaagctgactcgagacccagctttcttgtacaaagtggtgataaattggagctctgcagagctttcgttcgtatcatc

SEQ ID NO: 746 - DNA, 1716 bp, Zea mays
ttcttgtttgttgattaacccttaattaatccgggcgcgcctgatttatcacaagtttgtacaaaaaagcaggctcctgcaggaccatggcctacaccacctcgccgtcgacatcgacgtcgacggcagcggcggtggcctgggccttcgctgccgccacctgcgtgaaactcctcctcgtccccacctaccgttccaccgacttcgacgttcaccggtactggctcgccctcacgcacgcgctccccgtgcggcagtggtacaccgacacctcctctcagtggacgctcgattacccgcccttcttcgcttacttctcccgcctcctctccctccctgcgccgctcgtcgacgccaccctcgtttcaatccccgtgcgtgacgcgacgcccttcgcgcatctcatctacctccgcctcactgttgctttctccgacctcctcctcctcggatccgtcctcttactggcgagggacgcgcagcggaaacagcggccgttcctcgctctcgctcttgtcgtatggtcgccggcgctgttagctgtcgaccacgtccactttcagtacaatggattcctcattgggttgctgctgctttcgctgcacttcctcgagcaggggtgggatcttattgggggagtcgtgttcgcatgcttgctgtgctcgaagcacctgttcctcgtggcagcgccggtgtactttatgtatttgttccggcattattgctgtggccggggtgtcgtgaaggggctgggaaggctcgtgctcatgggttctggagtggctgctgtttttgccgcagcatttgtgcccttcgtgtactatggtcagatgcaacaactaattagccgattgtttccctttgggcgaggcctatgccatgcttactgggcgccaaacttttgggtattctatattatacttgacaagattcttgcatttcttcttagaagactaggctttaatattgccatacctgaagcttcgtttactgggggacttgttggtgattcgtctccttttgctgttcttccaaaggtcaccccaattgctacattcttattggtcattcttgccatggctccttgccttatcaaagcattctctaatcctcaaccaaagcatattattagatgggtctcgtatgcatgcacatgtgggtttatgtttggatggcatgtacatgagaaggcatcacttcatttcactatcccacttgccctaatcgccatggatagcttgaacgatgccaggcattactttttgttgtccatagtttcatgctactctctattcccgttgctgtttgagaaccaagagtacctgataaaggtgctgctgctgctgacctacgctgccctcatgtgggtaggctttacggtccattttgctgcaaagtctgacctggaaggaaagaaaataagtcggtcaggcagcacagtgaagaagaatggcatcattggatggattggtttaagctatcttttgggaattgcaggcatagaattatggtctcaagtatttcaccatcatgtattcggcgataggctccccttcctacctcttataatggtgtcattctattgtggccttggaatgatgtactcctgggtgtggcagcttgtacatatagtccgacacacatgactcgagacccagctttcttgtacaaagtggtgataaattggagctctgcagagctttcgttcgtatcatc

SEQ ID NO: 747 - DNA, 1275 bp, Zea mays
ttcttgtttgttgattaacccttaattaatccgggcgcgcctgatttatcacaagtttgtacaaaaaagcaggctcctgcaggaccatgacgccggcggcggcgatctccggctccagcagccacgtcgtcgtctcctccgcccgcctcaggcagccgttcacgctccctccgcgcaccgcttgcccaatcgccgccgccgcctcgcccgtgacccgccgcggggtcgcggtcgccgccgtgtcgagccccgttgtgtccgccgccgcggggaaggatgccaaacaggctcctaaggatttccttcaaatcattgattttgacaaggatacaataatgaagattcttaatcgagccatcgaggttaaggcattgataaagtctggagacaagagcttccaaccgttcaaagggaaaacaatggccatgatttttgccaagccatcaatgaggacccgtgtttcatttgagacgggattctttttacttggtgggcatgctatttatttgggtccagatgatatccagatgggcaaacgtgaggagactcgtgatgttgctagagtactttctggctataatgacatcattatggctagggtctttgctcaccaagatattctggacttggcaaaatatgcatctgtacctgtcataaatggtctcactgactataaccatccatgccagataatggctgatgcacttactatgcttgagcagattggtcgtattgaaaacactaaggttgtctatgttggagatgggaacaacattgtgcactcatggctgctattggctgctgtgcttccttttcactttgtatgtgcttgtcccaagggatttgagcctgacgcaaacacagtggagatcgccaggagtgctggaatcagtaagattgaaataacaaacagtcccagggaagcagttaagggagcagacattgtgtacacagatgtttgggccagtatgggacaaaaggaagaagctgattatagaaaacagaagttccagggattcacggtggatgaggccctgatggagattgctggcccacaggcctaccttatgcactgtttgcctgcagagagaggagtggaggtgactgacggcgccattgaggctcccaactcaatcgtgttcccccaggctgagaacagaatgcacgctcagaacgccatcatgcttcacgtgctcggtgcttaactcgagacccagctttcttgtacaaagtggtgataaattggagctctgcagagctttcgttcgtatcatc

SEQ ID NO: 748 - DNA, 561 bp, Zea mays
ttcttgtttgttgattaacccttaattaatccgggcgcgcctgatttatcacaagtttgtacaaaaaagcaggctcctgcaggaccatggcggagaaggaggcggcggctatgtggggcggcggcgacaagctcattctgcgcggccttcagttccatggcttccacggtgtccttcaggaggagaagacgttgggacagatgttcgtggttgacatcgacgtctggatggacctcgccgctgccggcgagtccgactgcatcgctgacactgtcagctacaccgatatctacagcattgcaaaggatgttgtcgagggcacgccacgcaacctcttggagtcggtagctcactcgatcgcagaggccacactgctcaagttccctcagatctccgcagtccgagtgaaggttggcaagcctcacgtcgcggtgcgaggcgttctggactacctgggcgtggagataacgaggcacagaaagaaagaatgactcgagacccagctttcttgtacaaagtggtgataaattggagctctgcagagctttcgttcgtatcatc

SEQ ID NO: 749 - DNA, 840 bp, Zea mays
ttcttgtttgttgattaacccttaattaatccgggcgcgcctgatttatcacaagtttgtacaaaaaagcaggctcctgcaggaccatggcaactgctcctgtgacatcctccatggctacgaactccacctgtgtgcggctgcctagcatgcccctgaggcgtgcacccgccatcgtctcctttgcctctcgtccatggtcaaccgcaatgacctcatgtactggattgtcgcggcactctgatgtggttgccgccgcggggcaccagaagttgatggggtctttgaacaacaacgagggactcatgtttggggtggttgtggcacggttcaacgaggtcgtgacaaatttgttactacagggtgccctggaaactttcgagcgatactctgttaaagcagaaaatataacagttgttagtgttcctggaagctttgaagttcctataacggcacaaaagcttgggaaatctggaaaatttgatgcaattctgtgcattggagctgtgattagaggtgacacaacccactatgatgccgttgcaaactcagctgcatcaggtgtactcaatgctggattatctgctggtgttccttgtgtatttggtgttctaacctgtgaagacatggatcaggcactgaaccgtgctggtggcaaggctggaaacaaaggagctgaagctgctcttactgccattgagatggcctcgctgttccggcatcacttaggctgacaccttgtgtattctgattttctatacacgaggcggctcgagacccagctttcttgtacaaagtggtgataaattggagctctgcagagctttcgttcgtatcatc

SEQ ID NO: 750 - DNA, 1539 bp, Zea mays
ttcttgtttgttgattaacccttaattaatccgggcgcgcctgatttatcacaagtttgtacaaaaaagcaggctcctgcaggaccatgccacctagggctgctccggcgctgcgggtgctcccgctcgcgctcgcagcggccatcttctcggggctcaccgccatcctcttctacctctccggcgtctcctcctcacatagcggctctcggctctcggaggcggacctggcggcgctcgccgcgctgcggggtggcttcagcaagtgcgtggatgcaaatgggctaggactgaaagccgtgaccggggaggactactgtcgtgttgtgatacaatacccaagtgacacagtttctaagtggagagatccaatcacccataaggctgaaagtctgtcgtttgagttcaatctgtgtgaagctgtggcctcatgggagcacgtccggaacagtacaacagtactcacaaaggagtacattgatgctttgccaaatggctgggaggaatatgcatggagaagaatcaacaaaggaatccttctgaataagtgccagaacagaagcctctgcatggaaaagctctcactagttctacctgagacatcaccatacgttcctcgccactttggtcgatgtgctgttgttgggaactcaggtgatcttctcaaaactaaatttggggatgaaattgattcttatgatgctgtcttcagagaaaatggtgcacccacccagaattacactgaatatgttggtagaaagagtacatttcgccttctgaatagaggatccgcaaaggcactagataaagttgttgagttagatgaaacaaaaaaagaggcactgatcgttaagacgacaatacatgatatcatgaaccaaatgattcgggaacttccaataaccaatccagtatacctcatgctaggcacatcatttggttcctcagctaaaggaaccgggcttaaagctcttgaatttgccctctccatctgtgacagtgttgatatgtatggcttcaccgtagacccaggttacaaggaatggacaaggtacttctcagaggtaagaaagggacacactccactacatggtagagcatattatcagatgatggaatgtcttggtctggtgaaaatccattcaccgatgcgaggagatcctggcaggacagtgaggtggctgcctaccaaggctaccatcgaggctgctagagttgcttccgagaagttgttgaagagacctggtgctggaagtgatgatcctctggggacttgcaccatgataaagaagcgcaggaaagggaaggcgccaaacagatctggtctacgagatgctgccatgaagcacctcgaggacatgaaaggtgccgctaggtatcccttggagcggaatgcagggggtggttacctctgcatgatcaatgatagataggaccgcggctgattatggcatcagttgccccctcccctcgagacccagctttcttgtacaaagtggtgataaattggagctctgcagagctttcgttcgtatcatc

SEQ ID NO: 751 - DNA, 1446 bp, Zea mays
ttcttgtttgttgattaacccttaattaatccgggcgcgcctgatttatcacaagtttgtacaaaaaagcaggctcctgcaggaccatggcgggcgccgtgtcggcgctcttcctgctggacattaagggccgcgtcctcgtctggcgcgactatcgtggtgatgtctccgcgctccaggccgagcgcttcttcaccaagctcctcgacaaggagggcgactcggaagtccactcgcctgtggtctacgacgacgccggcgtcacgtacatgttcatccagcacaacaatgtcttcctcctcaccgctgctcgccagaactgcaacgcggccagcatcctcctcttcctccaccgtgtcgtagatgtgtttaagcactacttcgaggaactggaagaggagtcgctcagagataacttcgtcgttgtgtatgagttgctggatgagatgatggatttcgggtacccacaatacacggaggcgaagatcctaagtgagttcatcaagacagatgcgtacaggatggaggtcacacagcgtccacccatggccgtgacaaatgctgtgtcatggaggagcgaggggatccgttacaagaagaatgaagtcttcttggatgtagtagagagtgttaacattctagttaacagcaatgggcagattgtgagatcagatgtggttggggcactgaagatgcgaacatatttgagtggaatgcctgagtgcaaactcggcttgaatgatagggttcttttggaggctcaaggcagagcaactaaaggaaaagcgatagaccttgatgatatcaaatttcatcagtgtgtacgtttagctagattcgagaatgatagaactatatcgttcatacctcctgatggatcttttgatctaatgacatacaggcttagcactcaggtaaaacctcttatctgggtcgaagcacagattgagaaacattctagaagccgtatagaactcatggtgaaggcaaggagtcagttcaaggaaagaagcacagcaacaaatgttgaaattgaagtgcctgttccttcagatgccacaaacccaaatataagaacttcaatgggttctgctgcatatgctcctgagagagatgcaatggtctggaaagtaaaatcattccctggtggcaaggaatacatgtgcagagcagaatttagtcttcctagcataacagcggaagaaggggccccagaaaagaaggcaccaatacgagtgaaatttgagataccatatttcaccgtatcaggtattcaggtccgttatctgaagataattgaaaagagtggttaccaggcactcccctgggttagatatatcacgatggctggcgaatatgagctgagacttatatgactcgagacccagctttcttgtacaaagtggtgataaattggagctctgcagagctttcgttcgtatcatc

SEQ ID NO: 752 - DNA, 1338 bp, Zea mays
ttcttgtttgttgattaacccttaattaatccgggcgcgcctgatttatcacaagtttgtacaaaaaagcaggctcctgcaggaccatggagcacctccggtggcgccccacagtgaacgagcgcgacttcattgagtgtgcgctccagtctgacctccgtgttgacggccgccactcctttgacttccgcaagctcaagatcaccttcggcagggaggatggctcgtcagaggtgcagctcggggagacacacgtgatgggctacgtgaccgtgcagctggtgcagccataccgtgacaggccgaatgaggggacgctggccatattcaccgagttctcacccatggccgacccctcctttgagcctgggcgtcctggggaattagcaattgagcttggccgagttattgaccgtggcctcagggagagtcgagctgttgacatggagtccttgtgtgttgttgctgggaagcatgtctggtctgtgcgtgtggaccttcacatcttggataacggagggaatctcattgatgcagctaatatcgctgcattggcagctttatctactttccggaggcctgaatgcacggttggtggggacgatggtcagcaagttacagtgcatgatcctgaggttagggatccacttcctcttacgatacaccatatgcccatagctgtaacatttgcatattttggtgaaggtaacatcgtggttcttgatcccacatacaaggaagaagcagtaatgggagggaggatgactgctatagttaactcaaatggggatgtttgtgccattcagaaagctggtggagagggtgtcatgtcaagtgttatcatgcagtgtttaagaattgcttcggtaaaggctgctgatataacaagcaaaataaagaaagcagtagactcatacaccaccgagaaagccctaaagaaagtaaaacgtttgccaacctcggttcctcagaaaattaatgtcactaatgtaactatggacggcaaaggtgatggtgaattggaaaagcaatctgtgcagatgcatagtgatgttcagcagataagcaaagatccaccaactatggtcaaggccagcagccgtgaggatgcccaaccaatgactgaatcatctaatgctgaggtgaacacatcaagtgctgtggctgctggagagtctgagtcccatgaaattggatcgccgaagagtctaaaagatgctatcaaaccaaaacataaaagaaagaagaagaaaagtgacaggagttagctcgagacccagctttcttgtacaaagtggtgataaattggagctctgcagagctttcgttcgtatcatc

SEQ ID NO: 753 - DNA, 1962 bp, Zea mays
ttcttgtttgttgattaacccttaattaatccgggcgcgcctgatttatcacaagtttgtacaaaaaagcaggctcctgcaggaccatggcgcagatccccaatcttgacaacgcgccgctcaaccttgcggccctcagggagcagtcgcagaaggacttgttcggcatcctaaaaaatataaggggaaagaagtgcttggttatagatcccaagctcgctgggactctctcattggtcgtgcagacatcgctgctaaaggagtatggcgcggaagtgcggattctctctcccgaacccctgcagacggaatgccccaaaattgtatatcttgtgcgctctcagctgaggttcatgaagttcatcgcaagtcaaatcaagaacgatgaacctaaagggctccagagggaatacttcctttactttgtacctcgccgcactgttgcttgtgagaagatcctggaggaagagaaagttcatcagaaactgacattcggagaatatcccttatatctagttccattggatgatgatgtcttgtctcttgaacttgaccattctttgcaggaatgccttattgaaggagatacaagttctatctggcatgttgctaaagcgatccataaattagagtttgcctttggagttatcccgaatgttagggccaagggtgtggcgtcaaccaaagctgcagagttgttgaatagtatgcaactagaggatccagtcaacatggatgatatggggattccagagataaacactgttattctgttagacagagaggtggacatggtaacaccaatgtgctctcagttgacgtatgaaggcttgttggatgagatgctacaaattaataatggttcagtggaagttgatgcaagcatcattggagctcaacaagatgggaaaaaggttaaggttccactgaattcaagcgataagttgtacaaggagattcgagacctcaattttgaagttgtagttcaggttttacgtcaaaaagcaacatctattcagcaagattatgcagaagtgaaatccaccaacactcagtctgtttcggagctcaaggattttgtgaggaggttgcactcgctaccggagatagctaggcatgttcatttggcacaacacttgcaatcgttcacggggaaaccctcctttcatgcccgactagacatagaacaaacaatactggaggttcagaactttgaaatatgctttgagtacattgaggagatgatacataagcaggaagttattgaaaacgtccttcgccttttggtgttactttctcttacaaatgccgggcttccaaagaagaattttgattacatgaggcgggagatacttcatagttatggctttgagcacatgcacttattatacaatctggagaaggctggccttcttaagaggcaggaatcaagaagcaattgggttggtattacaagagcactgcagcttatagttgacgtaaatgatacagcaaaccctactgatatatcctacatcttttctggatacgcacctcttagtattcgccttgttcagcatgcagtgagatctggatggcggtctattgaagaactgttgaaactattgccaggcccacatctggatttgaaaagaggtggtttgacaattaattcatcaccggaggtacatccaggtttaggggctcaacagagtattgacagggttggtcatcgctctctggttttggttgtattcattggtggtgtcacatttgctgagattgctgcccttcgcttccttagtgcacaggaaggaatgggctacgactttcttgttgcaacaacaaaggttgtcaatggaaacacaatactcagacccattatagcaaatagcaaagaggggatgatgtaactcgagacccagctttcttgtacaaagtggtgataaattggagctctgcagagctttcgttcgtatcatc

SEQ ID NO: 754 - DNA, 1188 bp, Zea mays
ttcttgtttgttgattaacccttaattaatccgggcgcgcctgatttatcacaagtttgtacaaaaaagcaggctcctgcaggaccatgatcccgacgcggcccgcgcaggcgtcgttccgcgaccgcaccaacgagttccgcgccgccgtcgagagcgcgcgccgccacgccgtaccttcctcgtcgtcagccgccgccgcgccgagtagcagctctaccaggcccctcgatgggttgatcgcagccacgtcggctcgctcggagttcaacaaccgcgcgtccaagatcgggctcgggatccaccagacctcacagaagctaacccgccttgcgaaattggcaaagagaacatctgtttttgatgaccctacagtggagattcaagagttgactgcagtcattaagaaggatatcacggctttgaataacgctgttgtagacctacaagctctctgcaattcacaaaatgagagtggcagtctctccaaggacacatcaaatcattccactacagtcgtggacaacctaaaaaatcgtctgatgagtgcaacaaaagaatttaaagaagttcttaccatgcgaacagagaatttgaaggttcatgaaaatagaaggcaaatgttctcttcgtcggctgcaaaggacgcgtcaaatccattcatccgtcaacgaccccttgttgctagggatccatcagagtcatctgtgcccccagcaccatgggccagcgactctgcatctaccccattattccagaggaagaagactaatggagaccatggggcatcatcatctcagcctttcgcacagcagcaacaattggcagtacagcaggacagttacatgcagagcagagctgaggcccttcaaaatgtggaatcaacaatccatgagctgagcaacatatttacacagttggcaaccatggtttctcaacagggagagctagcaatcagaattgacgagaacatggaggaaacagtggctaacgtggagggagcgcagggccagctcctgaagtatctcaacagcatttcgtccaacaggtggctgatgatgaagatattctttgtgctgatggtgttcctcatgatcttcatattcttcgtggcttgactcgagacccagctttcttgtacaaagtggtgataaattggagctctgcagagctttcgttcgtatcatc

SEQ ID NO: 755 - DNA, 879 bp, Zea mays subsp. mexicana
ttcttgtttgttgattaacccttaattaatccgggcgcgcctgatttatcacaagtttgtacaaaaaagcaggctcctgcaggaccatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagccgggaactcggaagggcgagaaccccgagaaggcctccatcgaggtcgtgtggaagcccaagaccggccagatcggaaggcaagaaagggaatatgagatgacactcaagaggacgttgcagagcatctgcttgctcacagttcatcctaacaccaccacctctgtcgtgcttcaggttgtgggtgatgatggttctcttatgtcatgtgcaattaatgcttcttgtgctgctcttgcatttgctggaatccctatgaaacatcttgctgtcgcgattagctgtggagtgatggacaatggtgtggttatcttagacactagcagagcagaagagcagcaagctaggtcgtttgctcacctggtgtttccgaactcgcgcaagtcagtcgaatcgaaggacccgacacagcgagatgaggagtccgagcgaggattgataacttgcatcacgcatggagcaatgtctgaggatgactatttcaactgcatagagaggggtgtcatggcgtcctcgaggatctcggatttcatgaggaagacactgcagaaggaggtgtccagggatgcctgactcgagacccagctttcttgtacaaagtggtgataaattggagctctgcagagctttcgttcgtatcatc

SEQ ID NO: 756 - DNA, 1563 bp, Zea mays
ttcttgtttgttgattaacccttaattaatccgggcgcgcctgatttatcacaagtttgtacaaaaaagcaggctcctgcaggaccatggcgacggagaggaggcgcgcgtcagtcgtggtactgggcgacatcggccgcagcccgcggatgcaataccactccctctcgctcgctaaccaggccagtatggaagtggacattgttgcaaatggaggaagtgatcctcacttgtcactgagagagaatccatcaattcacatccacgagatgaaaacagtgcagttaactggaatttcaaagatatctggtgctctgtcacttctacttaaagctgctgtccagttcattttgctggtttggtttctttgttttaagattcctcgccctgatgtcttttttgttcagaatccaccctctgttccaacactggctgctgtaaaactggcaagctggctgagaggtgctaaatttattgttgattggcataactttggatatacattgctggggttgtcgcatggcagaagtcacattattgtcaaaatctatttctggtttgagaagtactttgggcagatggctgatggtgccttttgtgttacaaaagcaatgcagcatgagcttgctcaaaattggggaatcagggcgacagttctttatgatcaatctcctgatttttttcaccctgcttcattgatggagaaacatgggttgtttagcaggctagggaattccatgtgtagtgctatgggcaatgctgattgcatatcagtggaggaagtaggggaagacatgaacactactgcctttaccagtaagattgatggccaagttttcttgaagcctaacaggccagcacttgttgtgagcagcacaagctggacgccagatgaagatttcagcatacttttggaagcagcactaatgtacgacagacgcgtcgctgcagctttaggtgaagatgattcaatggatgaggggcaactttggattgatatcaagaacgggaagcagtttgtctacccaagattactgttcattattacaggtaaaggacctgataggaagaaatatgaggatcaaataaaaaggttgaagttgagacgtgttgccttgcggacaatgtggcttgcatcagaggactaccctttattgctcgggtcagctgatctaggagtgtcgttgcatacatcttcgtcagggctggacctaccaatgaaggtggttgatatgtttggatgcggattgcctgtttgtgctgcttcattctcctgcattgaggagcttgtaaaagtaaacaaaaatggtcttcttttctcaacatcttcggagcttgctgatgaacttatgatgctctttaaggggtttccagaagaatgcaatgccttgaaatccctcaaagaaggtgccatgaagtcagcatcatcttcgaaatggtcaacagaatgggaaaccaatgcactacctttggtggaccaggtcattggatgactcgagacccagctttcttgtacaaagtggtgataaattggagctctgcagagctttcgttcgtatcatc

SEQ ID NO: 757 - DNA, 372 bp, Zea mays
ttcttgtttgttgattaacccttaattaatccgggcgcgcctgatttatcacaagtttgtacaaaaaagcaggctcctgcaggaccatgatcataccggtgcgctgctttacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagaccgagacaagttaactcgagacccagctttcttgtacaaagtggtgataaattggagctctgcagagctttcgttcgtatcatc

SEQ ID NO: 758 - DNA, 1501 bp, Arabidopsis thaliana
atgacaagtagcagtaacagcggcttgcgacggttcctgttcactccgcctcagcggctaagccaaggtatctgttactggggagcagagctaagcaacaatgtgtcatggacttacaaaacgaaaatggttgttcgatccaaggccggagcagtgcctctgatgaagcatggcgaccggtttctctcctctctctcgtctccagccttagctggtgatccgtcagcgataaaccgacacattaagaagtttgtggctgcttcacccaaatcagttgctctcaatgtcctctctcatctcctctctgatcaaacttcccatcctcatctctccttctttgctctgtctgtgagtctttgcttttttttcctgtttctctcaataaaatattgatgaaggtaaatgactttatattggttgttgttttcttctccagttgtattcggaaattactgaagcgtcgtggtttgattggaatcctaaactcattgctgaacttattgctttgctcaataaacaagaaagatttgatgaatcagaaacgctactttctactgcggtttcgagactgaagtcaaatgaaagagactttactctcttcctctgcaatttggttgaatcaaattctaaacaagggtctatacaaggtttcagtgaagcatcttttcgtttgagagagataatccaaagatcatcatcagtttatgtcaaaactcaagcttacaagtctatggtttctggattatgtaacatggaccagcctcatgatgcggaaagagttatcgaggagatgagaatggaaaaaataaagccgggattgtttgaatataagtctgttctatacggctatggaagattaggattgtttgacgatatgaacagagtagtacacagaatgggaacagaaggtcacaaaatcgacacagtttgttcaaatatggttctctcttcctatggagctcatgatgcattgccccaaatgggttcttggttacagaagttgaagggttttaatgttcctttctccataaggacgtataactcggtcttgaattcttgtcctaccatcatatcaatgttgaaagacttggatagctgtccggtttctctttctgaactgcgtacttttctgaatgaggacgaagcacttctggtccatgaattgactcagtcatcagttttagatgaagcaattgagtggaacgcggtagagggtaagttggatttacatggtatgcacttgagctcatcgtatttgatattgctgcaatggatggatgagaccagacttagatttagcgaagaaaagtgtgtaattcctgcagagattgtagttgtttctggatctggaaagcatagcaatgtaagaggagagtcaccggtgaaagcgctggttaaaaagataatggtgcgtactggaagcccgatgagaattgaccggaagaatgttggtagttttattgccaagggaaaaactgttaaagaatggctctgcaaatga

SEQ ID NO: 759 - DNA, 737 bp, Zea mays
ttcttgtttgttgattaacccttaattaatccgggcgcgcctgatttatcacaagtttgtacaaaaaagcaggctcctgcaggaccatgtcgtcggactcgtcgtcgtgggcgcgcgccctggtgcagatctcgccatataccttctccgcaatcggtatcgccgtctccatcggcgtctccgtcctcggcgcggcatggggtatcttcatcacggggagcagcctcatcggggccgccatcaaggcgcccaggatcacttctaagaacctcatcagtgtcatcttctgtgaggctgtcgcaatttatggcgtaattgtggcaatcatcctccagacaaagcttgaaagtgtgccaacatctcaaatgtatgatccggagtctcttcgagctggctatgcaatctttgcatctggccttatcgttggctttgctaatcttgtttgcggggtatgcgtggggataattggaagcagctgcgcactgtctgatgctcagaactcatcactcttcgtaaagattttggtgattgagatcttcggcagcgctctgggactgttcggtgtcattgtgggcatcattatgtcatctcaagcgacatggccagcaaaagcttgattttcaccattagtagctctgtaaattattcggatggaatgtatcgaaatctcgagacccagctttcttgtacaaagtggtgataaattggagctctgcagagctttcgttcgtatcatc

SEQ ID NO: 760 - DNA, 567 bp, Zea mays
ttcttgtttgttgattaacccttaattaatccgggcgcgcctgatttatcacaagtttgtacaaaaaagcaggctcctgcaggaccatgcagttcctccgaggcagcggcggcgggggcggtgggttcccggtggtggcgtgggaggtgttgcggcggcacttctctaagaagcggtccgtggacgtgaggcggatcaaccccaaggtgcccaaggaggaggccgtcgccatttccggccgactcctccagatcctctccgaccatgggcccctcaccgtcgccaacacctggaaccacgccaaggatgctggcatcgctggcctgaacagcaagacgcacatgaagatcctgctgaaatggatgacagggagaaatgtcgtgaagctgacctgcgtgcacgtgggcaacgcgaagaagttcctctactccccgtccactgaaagcagcagcagcagcgccggcgcatcaccgtcatccacatcggcctcgcagtgactcgagacccagctttcttgtacaaagtggtgataaattggagctctgcagagctttcgttcgtatcatc

SEQ ID NO: 761 - DNA, 1138 bp, Zea mays
ttcttgtttgttgattaacccttaattaatccgggcgcgcctgatttatcacaagtttgtacaaaaaagcaggctcctgcaggaccatggcagcgagcaacatcgggatgatggacggagcctacttcgtcgggcgcaacgagatcctcgcgtggatcaacactacgctgcagctcggcctctccaaggtggaggaggcggcgtcaggcgcggttgcgtgccaactgatggacgcggcgcatcccggcgccgtgccgatgcacaaggtcaacttcgacgccaagacggagtacgacatgatccagaactacaaggtcctgcaggatgtgttcaacaagctcaagatcactaagcatatagaggtgaacaagctaatcaaaggaagaccccttgacaatctggagttcatgcagtggatgaaacgatattgtgattctgtcaatggtggcttcatgagcagctacaatgcttctgagagaagggaaagcagcaaagggggaaaggagacgaacagaagggcatcggtgccctctcacacaccggccaagtctgcatccacaggtcacaaggctcaagcatcacatggcgctaagcgggcaagcgggcagacggcgggtgcaccacagcgcagtgctaagccatcacctgtagccaactctagtggaccagcttatgacgaacaaataactgagctgaagctccttgtggatagcctggagagggagagagatttctacttttccaagctgcgggacattgagatcttgtgccaaaaccctgaggttgagcacgtgccggtccatgctatccagaacatactctacacatcagaggaggaccctcagcagcaggctccagccctgagccccatcatggaggcgtccgaggagaggccgaagcaagaggcggcgcacaagagaaagagcatctcggacctggacgagtttggtatgtcgtccagctcaaggcagaggctctccgacatctcggacgtgcagctgtgtggatccccgctgacgagtttcagctaaagaaactgtcatctctacaaaatgggtgtctcgtcttctcgagacccagctttcttgtacaaagtggtgataaattggagctctgcagagctttcgttcgtatcatc

SEQ ID NO: 762 - DNA, 1287 bp, Zea mays
ttcttgtttgttgattaacccttaattaatccgggcgcgcctgatttatcacaagtttgtacaaaaaagcaggctcctgcaggaccatgtcgaagaaagtaggacgagcgaagaaagcagcgggcggcggcgagctgtcccgcttcctggagtcgcatctccagaccattagcgacaccttccagatgatggcggagtcggctccgggggccttggagcggacggagtggtctgaggtcgttaagctcggcgaccaggtctccaggcaggccaccgtcgctggaatgctctggagcggtgacttgcctgatgtagagaccctcaaagagaacatcgttgcttatttcaacatcctacagggatttcttttggtttgccacggaagcatggtcggtgctgggcctactctacacaagtccatctttgggtctgcaaaagacgtggttgactctagcttctcattgttcaagcatgctgtctctgcttatgaatctcgcagctctgaccgcaacacaactataccccaggtcacaggaactgtatgggaagcttgtgctgctctcaagaaggtgcctgcatcaaactgcattgccataggacgagccatgaccaggataggtgtgtgtctgaaagatgttctccgagaaatgaatgagctccctattggtggttctggtgatagtactgctgagaagtcttccaatggtgttgtcgacacaacgagttgttctgatagagatgagaggtctgatcttgatttagatgatgacgacgacgatgagttcactgaagaagaggttgctgttgccaagttggttattaacgtggtatctgattccttggttgtagtgaaagaggcaattcgtttcattactggtttgctcaggagctctggtaacaaagacaaagatggtgctaatgaggacagagttgagccaatggagaaattgctgagccactgcaaggagatcgcagaccaggtcaacgatcttggggcttctgtatacccaccacaagactcgtctgagatggagctcgctataaaaagactgtacaatggcatcaacgggatgcgcaaggaaatagggaacctcggtggcgcacctgagagcacctttgcagcccttgaaggattcgaaaattgccttggatctctgcgggccaggttagctgatgatgtggtgaacgagatggaaggtcttaatattagccattagctcgagacccagctttcttgtacaaagtggtgataaattggagctctgcagagctttcgttcgtatcatc

SEQ ID NO: 763 - DNA, 1328 bp, Zea mays
ttcttgtttgttgattaacccttaattaatccgggcgcgcctgatttatcacaagtttgtacaaaaaagcaggctcctgcaggaccatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccagggtctcaacccctacgtctacatcacctaccgccatctgctcgtcgccgtcctcatctggcccttcgcatactacctggagaaggggctgaggcctaaaatgacgctcatgctgttcgtggagatattcgtgctctcccttctcggggtgagcttaactctgaacatgtacttcacgagcctgaagtacacgtccccaacgttcgtcacttccgtggtgaacaccatcgcctcgatgacgttcgtcatcgccatcatcctcaggatggagatcgtggacgtgaagagcctacgcggggtcgccaaggtcgcagggaccgtggtgtcgttcgccggggtgaccaccatgactctgtacaaaggagcggccatcacgagcctctggaagtcgcctgttcagatcgccggcagcggcagcggcggcggaggcgtcgcccacgacagctgggtgaaagggtcagtcctcgcagtggccagctgcgtgtgctggtccatctggtacatcatgcaggcgtcgtctctgaagaggtaccccgcccagctctcgctgacggcgtggatgtgcacggtcgggggcatccagtcgaccgtgttcacgctgttcatgcagcacgagccggaggaatggcgcatcggcttcggcgtcaagttctggagcatcgtctactctggcctcgcctgcaacggcttcacggtgttcgtgcagctctggtgcaccgagaagaaaggccccgtcttcgtcaccatgttcaaccccctctccaccatcatggtcgccatcctggcctacttcatcttcggcgaaaacctatacgtcgggagcatcgtcggaggcggggttgtgattctgggcctctacatgctgctgtgggggaaggagaaagaccaggagcggggcacgggcaaagagcgggaacagctcgagacggactgcgagaagcaggcgaagaaggtcagcgactgtgtctacgaagcgcccaagacgacgaagtgactgccgccggccatgagcggcagacggctcaatcaagcctcgagacccagctttcttgtacaaagtggtgataaattggagctctgcagagctttcgttcgtatcatc

SEQ ID NO: 764 - DNA, 623 bp, Zea mays
ttcttgtttgttgattaacccttaattaatccgggcgcgcctgatttatcacaagtttgtacaaaaaagcaggctcctgcaggaccatggggatcggtgagcacttcgagggcgtcaagcagcactgggcgagcaacttcgccttcctcgactacttcaagaaggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgcccacctcggcggcgtcgcgctcaagtactccaaggcgccgcacggcgtcctgctggcgaccggcttcggcgcgatcaccggcgccgtgctgggatccgaggtggcggaccactggtaccagctctacgagatggacaagcagggggccaacctcaggttcatctactggtgggaggacaaggtctcaggccagaagagctgaaccacatcgagtgatgcctattctactgagcacaccagcgtctcgagacccagctttcttgtacaaagtggtgataaattggagctctgcagagctttcgttcgtatcatc

SEQ ID NO: 765 - DNA, 513 bp, Zea mays
ttcttgtttgttgattaacccttaattaatccgggcgcgcctgatttatcacaagtttgtacaaaaaagcaggctcctgcaggaccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagtcggatgaggagggccttgacctggctggatcccaccgccgcgcgctctacggcggcgggtacatcagctacggcgcgctgcggcgggacaacgtgccctgctcccgccgcggcgccagctactacaactgccgcccgggcggccaggccaacccctaccaccgcggctgctcccgcatcacccgctgccgcggctgactcgagacccagctttcttgtacaaagtggtgataaattggagctctgcagagctttcgttcgtatcatc

SEQ ID NO: 766 - DNA, 1881 bp, Zea mays
ttcttgtttgttgattaacccttaattaatccgggcgcgcctgatttatcacaagtttgtacaaaaaagcaggctcctgcaggaccatggaggcagctgcagatgaggagaggccactgattcagtacctggctccagaggatgatgaagcttcctcacgatacactagcgacggaacgctcgatatcaacaagcagcgtgctctgaagaagagcaccgggaactggagagcatgcttcatgattctgggtaccgagttcgccgaatgcctggcattttacgcgaccgcaaagaacctggtcacctacctcacggctgagcttggtgagaccaacatcgatgccgcgacgaacgtgtccacctggattggcagctgctacctcacgccgctcatcggcgccttcttggccgacacgtactggggaagatacaagacgatgatagtcttcctcttgctctacatcgttgggatgcttactctgacagcgtcggcgtggctccccttggccatggaggacgactcacctgacaacagcggacttcggcgtgccacagcgtacctggggctctacctcgtttccctaggcacaggaggcatcaagccctgcacggcggccctcggggccgaccagttcgacggcggcgacgcggcggagcgggtcaccaaggcctccttcttcaactggtactacttctgcaccaacatcggctccctgctgtcggggaccgtgctcgtctgggtgcaggaaaatattggatggggagtcgggtttacggtgcagacggtgttcatgctgttcggcctcgccgtgttcgtcgccggtcgcaaggtgtataggtacaagaagctgggcgggagccctctcacaagggtagcccaggtggttgtcgcagctgtgaggaactgccatctcgtgctgcctgatgatacgtcagccctgtaccacgataagcttctaccaactgaaccaaatttcaggattgagtctgccagacaattcagattctttgacaaggctgccataatcaccggcgagaagggtgcagcagcgccgacgagcccgtggagactgtgcacggtgtcccaggtggaggagctgaagatgctgctccggttgctgccggtctgggcatccatggtgctcttcttcgccgtcagtgcgcagacggtaaccacgttcattgagcaggctagggtgatggacaaccgcatcggcccgttcaccattcctccggcgtcgatagcgaccttcgacgtgatcagcgtcatggtctgcgtccccgtctacgacgccgtgctggtgcctctggcccggcgtgccactggcaacgaccgcggcctgtcgcagctgcaccggctctccatcgggatcgcgctgtccgtggtcgtcatggtgtacgcggcgctgctcgagggcaggcgcctggccctcgcgcgggccaacatgcccgccatgaacatcgcgtggcaggcacccatgttcgccgtgcacggcgcggcggcggtcttcgccaccgtcggcgtgctcgagttcttctacgaccagtcgccggacgggatgaagagcctcggcaacgcgctcgcgctgctctccatggcggccgggagctatttcaactcgcttgcgctcagcgctgtcgggtcgatcacggcgcgcggcggggaacgcgggtggctcccggacgacctgaacaagggtcatatggactatttcttctggatgatggccgctcttggaacgctcaacctgctgcacttcttgcactactgcaacagacgatacagaggcaacaacaacaacacttcttgactcgagacccagctttcttgtacaaagtggtgataaattggagctctgcagagctttcgttcgtatcatc

SEQ ID NO: 767 - DNA, 1542 bp, Zea mays
ttcttgtttgttgattaacccttaattaatccgggcgcgcctgatttatcacaagtttgtacaaaaaagcaggctcctgcaggaccatgggggagcgggcgaaggaatggctcctcgcagcaggcgccggcgccgccgtcggcgcgctctctgccgccgctgtcatggatcttctctcgagatccaagcgcagagagaggtacgcgcgggacctgctggagtccaatgcaatgacgactggtacgcgtgcagggaacactcggtccagcaagcacctgggctctgttgctagctcggctcttctctctgatgaagtggtctctgaacagcttacaaggaatatacaattttttggcatggactctcagaagaaagtgactgaatcctatgttgtggttattggtcttggaggggttggcagtcatgcagcatcaatgctcctgagatctggtgttggcaggttgcttcttgtggattttgatcaggtatcactctcatcactaaatcggcatgctgtggcaaccagagatgacgttggaacttcaaaagcgttgtgcctcaagaagcatttttcaatgatatacccagagtgccaaatagatgcaaaagtgcaattgtatgatgcatcgtctgaggaggaaattctttctggacagcctgactttgttcttgattgcatagataacattgataccaaggtgtcactccttgcagcttgcgtgcgcagaggtttgaaggtactttctgcaatgggggctggagctcgagctgatcccaccagaattcgtgtcgcatatttgagagaatcaagcaatgaccccctctctcgatcggtgaggtacaggctcaagaaagaacatggaattgagggtggaataccagtagtcttttcattggaaaagccaaaggcaaagcttcttccttttcaagcttcaaaagaagaggaaactccatcagattaccagattgtgccaggattcagggttcgcattataccagtattgggaaccatccctgcaatatttggtcaagttatggcctcctatgtggtcactcagcttgctggattagattttcaaactgaaccggttgttaacctggatttggatcattaccgtatacttcatcagcgtcttattgagcatgaggaactgatgtatggcacagccgagcaagttctggtagatgctgaagaggtaatgtacattgtcaaagaattgtggcgtggtcgaagtgctagagaccaaagccaggacactggccggaagatgtggagatctgtgaacgaactaatgcttgttcggtgggacaaatcaaaggctgctggcatctcaaacttaatacttgtcaagttcagtgaggctgacgcccatgaatccaccacactcgaccgaataaaagaacaagaacctgagttctactctatggtttcacgtgtcctgaaacgagctgagatggagtttgccttatgactcgagacccagctttcttgtacaaagtggtgataaattggagctctgcagagctttcgttcgtatcatc

SEQ ID NO: 768 - DNA, 1788 bp, Arabidopsis thaliana
atgtctccattctcagaaacctctgttctgctacttcccatggtcgagaaatgcataaacctcttgcaaacctacggcgtttcatcgataacgaaactcagacaaatccacgctttttcaatccgccatggagtctcaatctcagacgccgagcttgggaaacacctcatcttctaccttgtttctcttccttctccacctcccatgtcttacgctcacaaagtcttctccaagattgagaaacccatcaatgtctttatttggaacacattgatcagaggctacgccgagattggtaattccatctctgctttttctctataccgtgagatgagagtctctggtttggtcgagccagatactcatacttatccgtttcttattaaggctgtgacgacaatggcggatgttagattaggagagacgattcattcggttgttataagaagtggctttggttcgttgatctatgttcagaactctctgcttcatttatacgcaaattgtggagatgtagctagtgcgtacaaggtgtttgataaaatgcctgagaaagatttagtggcttggaactctgtgattaatgggtttgcggaaaacggtaaaccagaagaagctttagcgctttatactgagatgaattccaagggtatcaagcctgatgggttcacaattgttagcttgttgtctgcttgtgcaaagattggtgctttgacattgggtaagagagttcatgtctatatgatcaaagtaggtttgacacgaaacttgcattccagcaatgtgctcttggacttgtatgcgagatgtggaagagtggaagaagccaaaacacttttcgatgaaatggtggacaagaacagtgtctcgtggacttcgttgatagtcggtttagctgttaatggttttgggaaagaagccattgagcttttcaagtatatggaatcaacggagggattgttaccatgtgagatcacgtttgttgggatattatacgcttgtagccattgcgggatggtgaaggaaggttttgagtatttcaggagaatgagagaggagtataagattgaacctaggatcgagcattttggttgtatggtcgatttgttagctagagctggacaagtgaagaaagcatatgaatacatcaagagtatgccgatgcagcctaatgttgtaatctggagaacattgttaggagcttgtactgttcatggtgattcagatttagcagagtttgctagaatccagatcttacaactagaaccaaaccacagcggcgattatgttctcttgtcgaatatgtacgcatccgagcagcgttggtccgatgtgcaaaagatacggaaacaaatgttaagagacggtgtgaaaaaagtccccggtcacagcttagtagaagtaggaaacagagttcatgagtttcttatgggtgataagtctcacccacaaagcgatgctatttacgctaagctgaaagaaatgactggtagattgagatcagaaggttacgttccacaaatttctaatgtctatgtagatgttgaagaggaagagaaggagaatgctgtggtttatcacagtgagaagattgctattgcatttatgttaattagtacaccagaaagatcaccgattacagtcgtgaagaatcttagagtatgtgcagattgtcacttagcaatcaaacttgtgtcaaaggtttataaccgagagattgtagtcagagatcgtagcaggtttcaccattttaaaaatggttcttgttcttgccaagattactggtag

SEQ ID NO: 769 - DNA, 1419 bp, Zea mays
ttcttgtttgttgattaacccttaattaatccgggcgcgcctgatttatcacaagtttgtacaaaaaagcaggctcctgcaggaccatggcggcgcctctgctcccctcttccgtctccgtgctcctctcgctccacatcgcgctgctgctggtcctctgctccagccaggtaggagattcctgctcctcagtgcgggactgcggcacgggcctctactgcggcaactgccccgccgcaggcaggaccaagctctcctgcatcagggacctagccatccagcccacctccattgtgaaggggctacctttcaacaggtactcatggctcgtcacccacaattccttttccatcctcggggagccgtcgcgcactggggttgagagggtcacgttctacaaccaggaggactccgtcaccaaccaattgaggaatggtgtcaggggattgatgcttgatatgtatgacttcaacgatgatgtatggctctgccactccctgcaagggcaatgctataacttcactgctttcgtaccagcagttgacacactaaaagaggtggaagcatttctctccgagaatcccacagagatcataacaatatttattgaggattatgttcattcaccgatgggactgagcaaggtctttactgctgctgacttgatgaagtattggtatccaatctcggaaatgccaactagtggcaaggactggccaagtgtcacagatatggttgcaaaaaaccgcaggttgctggtgtttacttctgatgcttcaaaggaggctagtgaaggagtagcttaccaatggagctacttgctagagaatgaacctggagatccagggattgtgcctggttcttgtccaaacaggaaggaatcgcagccactgaactcaaggccggcatctctatttctgcaaaattacttccccacgatccccgtgcagaacgaagcatgtaaagagaattctgggctaccacaaatggcccaggcttgttatgccgcagctgggaataggatcccgaacttcatagctgtgaatttctacatgcgaagcgacggtggtggtgttttcgatgttcaagacagaatcaatggccgcaccttatgtgggtgtgacaccattgctgcttgccaggctggagcaccaatgggtgcatgcaaggacacgggggcaccaaatcagactacatcgccctctgtaaatggaaatgtctattcaggaactatagaattcaagacgcattccactagtgctgctagcaataacaacatccggagtagatctgtttttctgctaaggctgcagttgactttgctgctctttttctctttcaggctctagctcgagacccagctttcttgtacaaagtggtgataaattggagctctgcagagctttcgttcgtatcatc

SEQ ID NO: 770 - DNA, 1539 bp, Zea mays
ttcttgtttgttgattaacccttaattaatccgggcgcgcctgatttatcacaagtttgtacaaaaaagcaggctcctgcaggaccatgctgcgccttcgcgcttgcggcggcacggcaccggcatcggtgcccgcgctcgtcaggtcccgcctctccaggagatcctcctccacagcctacgccgccgctaccgtcgcttccgcttcctcctcttcgtccaccctggaagacctcgccgccgagcacagaggtttggcaaaggtcattttaaagaaggggaagacccaaatattccgagatgggagcccaatggtgtatagcggtgctgttgataggataattggtcgacctcctccgaaatctggcgatattgttctagtagctgatggaacagagaaacctattggatggggtctctataactctgtgtctatgttttgtgttcgtttgatgcaactagaagaagaggcaagaagagatcccacatgcacacttaatatggaaagactgcttgaagcaaggatttcatctgctgttggtttgcggcgcagtttgggtctcccttcaactgacacaaatgcttatcgcctcatcaacagtgaaggggacagattatctggtctaatagtggacatctttgctgatgttgctgttattgcttcatctgctgcttgggttgagaaatataggcaagaaatacaatttcttgttagcacagttaatggcgtcagccatataaagtggaggccatcgacagatattttgaaagaagaaggattggatatatcagagcataaggagcctgcttcaccatgctcaactgttaaggtcatggagaatggcattatctacttagtctcattagaaggtcagaagacagggttttatgcagatcaacgcgaaaaccgctatatcatatcattactttcaaaggatcaaagagtccttgacctttgctgctacagtggcggctttgctcttaatgcagctaagggtggcgctgataatgtcattggcattgattcatcaggatcagcactagaccttgccaatgagaatattgttctcaatgagctaaaccaaggaaaagtctcatttgtaaaaggagatgcaactacattcatgaaaggagctatctcagaaaatgagctatgggacttggtaatccttgaccctccaaagttggcgccacgaaagaaggtgctacaaagtgcatccggtatgtatagaagcttgaacgcacttgcaatgcaagtggtgaagccaggggggttactcatgacatgctcttgttctggagctatgacccaaagtggcatgttcctcaaaaccattcagggtgccgcatcaatggctggccgtaaggttacggtcttacgtcaagctggggcagcatgtgatcaccctatcgaccccgcataccctgagggccagtatctcagcaattacttgctgcgtgtggcatgactcgagacccagctttcttgtacaaagtggtgataaattggagctctgcagagctttcgttcgtatcatc

SEQ ID NO: 771 - DNA, 1826 bp, Synechocystis sp.
ttcttgtttgttgattaacccttaattaatccgggcgcgcctgatttatcacaagtttgtacaaaaaagcaggctcctgcaggaccatgtttgatgccattgatgcagccctagctgacattaaagcgggcaaggccgtggtggtggtggacgacgaaaatcgagaaaatgaaggggatttaatctgtgcggcccaatttgccacccctgctctagttaactttatggcagtggaagcccggggcttgatttgcctagccatgactggtgatcgcctggacgaattggatctgcccttgatggtcagtaaaaacaccgacagcaaccaaaccgctttcaccgtcagcattgatgcagccccccatttgggcgtaaccacagggatttccgccgaagaccgggcccggacgatccagattgccattaaccccgtcacccgcccggaggacctttcccgacctggccatattttccctctgcgggccaaaactgggggagtactgaaacgagccggccacaccgaggcggcagtcgatctttctcgcctagcaggactctatccagcgggggtaatttgcgaaattcaaaatgccgatggctccatggcccgcctaccggaattggtggagtatgcccgcaaatatgacctcaaactgatcagcattgccgatttaatcagttaccgactccaacatgaccgctttgtgcaacgggaaaccatctgtgaatttcccagccagtttggggagtttaaactctacgcctaccgcaatttattggatcaaacagagcacattgccattgtgaagggtgatcctagtgaatttggtcaacagccggtgatggtgcggatgcattcagaatgtttaacgggggatgccctgggttctctccgttgtgattgccgcatgcaactccaggcggccctcaaaatgctggaaaaccatggtttgggggtggtggtttatctccgccaggaaggccggggtattggtttggtcaataagctcaaggcctattccctacaggatttgggctatgacaccgtggaagcgaatgaaagattaggttttccggcggatctgcgggactacggcatgggggcgcaaatgctcaacgatttaggggtgaaacaaatccgtttgatcaccaacaatccccgtaaaattgccggactgaaaggctacggtctagaaattgtcgaacgggtgcccctgttaattgaggccaacgactataactcccattacctgaccaccaaggcagaaaaactagggcactggttagtcaaaaactatctgctggcgatcgccattaaatttactcccaacgttgcttcggcccaacaacggtacgaaaaattggaaaaaatccgggccctgttacagggaacccccctcatggtgcatgaagacaaccgccccgtggcgatcgccctatttggcaaaaatagcctaattttccacgtcggcctagaccaaaacttaccatcgggccagccttggcaaaagcacgaccattctccctaccccgctttggtaaaggattttctcgtacagctcaaacaatggccagacctacaggctctagcattcctcatcgcccaagggaaagaccccatggaaactctccaagtcagtctggaccgggaaaatgtatcctttgccgacctcaccgccgacgccctaaaccaatggcagccccaaacggtgtacacctacagcaagcaaggcagcggagaaatgactaacagatgaccgagacccagctttcttgtacaaagtggtgataaattggagctctgcagagctttcgttcgtatcatc

SEQ ID NO: 772 - DNA, 445 bp, Zea mays
ttcttgtttgttgattaacccttaattaatccgggcgcgcctgatttatcacaagtttgtacaaaaaagcaggctcctgcaggaccatggtggccaatggtgatgcacctgctagagggagcgcggcggcagccgcaagcctgcgtaggcgtaggaccacaagcggtgctgctgctggtggaggcggtgccagctcaatgctccaattctacactgatgaggctgccggccgcaaaatgtcaccaaacactgttctgatcatgagtattgggttcgtagccgtcgttgctgtgctccatgtattcgggaagctgtaccgcacctccaactaggttggcattgccatatccaagaaagctgagtccaccaagagagctcgagacccagctttcttgtacaaagtggtgataaattggagctctgcagagctttcgttcgtatcatc

SEQ ID NO: 773 - DNA, 588 bp, Zea mays
ttcttgtttgttgattaacccttaattaatccgggcgcgcctgatttatcacaagtttgtacaaaaaagcaggctcctgcaggaccatgctgaagttcctgtccaaggtggtggtggagtactgccctctggacccgcggaaggcggcggcagtggagctcctcgcgcagtgcaacggccgcaaggccaaggactccaacccggcctgctcggtcgagctccgccgcctcccctccccagctccgtccacggacctcaagtcgcagccgactctcccgcctccgagggtcctcgtgacctacttcaccggagctgaagaggccattgtctttgctgagggagctacagcgcagggcatccgggaccagatcgtcgcacggggccggctcatcgatacggagaagatgttccgcgacggcggggagaagtggcccgtcgtcatccccgaggaggagcttggcatgtcgttccctggcatcaagccaaagaaagccgaggataagccccaggccgagtgactcgagacccagctttcttgtacaaagtggtgataaattggagctctgcagagctttcgttcgtatcatc

SEQ ID NO: 774 - DNA, 504 bp, Zea mays
ttcttgtttgttgattaacccttaattaatccgggcgcgcctgatttatcacaagtttgtacaaaaaagcaggctcctgcaggaccatgttggcggcgacggatccgatgctgtggcacaaggtggccgccgtctccggggttgccgctttggggctcggcacctacggcgcgcacatgttccgccccaagaaccccgtgtacaaagaggtttggcacacggcgtccctgtaccatcttgtccacaccgcggcgctgctcggggcgcccatcaccaagcgccccaacgttttcggagggctcctcactgctggaatcgtgctcttctctggaacgtgctacaccgtggcttatcttgaagacaggaagttttcttcaccggcaccattggggggctttgcgtttattgctgcttgggccagcctcctcttctgactcgagacccagctttcttgtacaaagtggtgataaattggagctctgcagagctttcgttcgtatcatc

SEQ ID NO: 775 - DNA, 1058 bp, Zea mays
ttcttgtttgttgattaacccttaattaatccgggcgcgcctgatttatcacaagtttgtacaaaaaagcaggctcctgcaggaccatgtcgacgagtgaggtgtggagcttgtccgatttcgaaatcagcaagtacatcggtgagggcaggttcggcaaggtctacctcgcccgcgagaagcagagcgggtacgtggtggcgctcaaggtgatatttaaggcgaaactgcagaagtaccacttccacgcgcacctgcggcgggagatcgagatccagcagagtctcgaccaccctaacgtgctccgcctcttcacctggttccacgacgaagagcgagtcgtcctcgtcctcgagtacgcggcccgtggcgagctctacaaggtccttcgcgctgctggccgcttcaccgagcgcacgtccgccacatatgtagcgagtcttgctggtgcactggcatactgtcacaaaaagcaagtcattcatagggacatcaagcctgagaatttgctaatcgacatcgagggccggcttaaaattgcagattttggatgggcggctcgttcaaatgctaaacgccacacactctgtggcacaatcgattatctggcaccagagatggtagagaaaaaagctcatgaccatgctgtggacaactggacattaggaatcctgtgctatgagttcttatatggttcacctccttttgaagctgatgaacaggatgataccttgagaaggatagttagggtggatttggcattcccttcatctccttgtgtatcttcagaggctaaggatctcatttccaagcttctagttaaggattcaagcaagaggctttgccttgaagacatcatgaagcatccatggataaagaagaatgcagacccttcaggcagttgcattaagcaaaaagatgtcacaagatcaaagcttctgtaatatcagtacaacctgcttgccagtgggcaagaatcttctgatgtctcgagacccagctttcttgtacaaagtggtgataaattggagctctgcagagctttcgttcgtatcatc

SEQ ID NO: 776 - DNA, 828 bp, Zea mays
ttcttgtttgttgattaacccttaattaatccgggcgcgcctgatttatcacaagtttgtacaaaaaagcaggctcctgcaggaccatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgacggaggcggcaccggcgccggcagagacaccgtcggaggaggcggtggtagaggagaagaaggaagaagagaagaaggaagaggaggataagccggctgccgaagaggcggcgccgccagcagcagcagctgctgctgaggagaagtgatcctgttgacggatcgagcatgcaaagcgctccctcctcctcgagacccagctttcttgtacaaagtggtgataaattggagctctgcagagctttcgttcgtatcatc

SEQ ID NO: 777 - DNA, 1734 bp, Agrobacterium tumefaciens
ttcttgtttgttgattaacccttaattaatccgggcgcgcctgatttatcacaagtttgtacaaaaaagcaggctcctgcaggaccatgacccagatagcccatcccgacagcattctcatcatcgatttcggcagccaggtgacgcagctgattgcgcgccgcatccgcgaagccggggtctattgcgaaatccacccgttccagaatgccgcagaggctttcgagaagcttcagcccaagggcgtgatcttctccggcggccccgcatccgtaacggctgaaggcagcccgcgcgcgccgcaggcggtgttcgacagcaaggttccgatcctcggcatctgctacggccagcagacgctctgcacgcagctcggcggtgtggtcgaaggtggccacgcggcggaattcggccgtgcggatatcgatatcaagaaggctagcccgctgttcgaaggtttctgggaacagggcaagagctacccggtgtggatgagccatggcgaccgcgtaacaaagctgccggaaggtttcgaggtcatcgcgacctccgagaacgctcctttcgccatcgcggctgacgagaagcgtcactattacaccaccatgttccacccggaggtggtgcatacgcctgacggcggcaagctgctctccaatttcgtgcacaagatcgtcggcctcaaatccgactggacgatggctgcctaccgcgccgagatgatccgcaagatccgcgagcaggtcggcactggccgggtgctctgcgcactttccggcggcgtcgattcctcggttgcagccattctcattcatgaggcgatcggtgatcagctgacctgcgtttatgtcgaccacggcctgatgcggcttggcgaaagcgagcaggtcgtcggcatgttccgcgatcactacaatattccgcttgttcacgtcgacgccgccgatctgttcctcggcgaattgtctggcgtttccgatccggaagtgaagcgcaagaccatcggccgcctgttcatcgaggtgttcgaagctgaggcggccaagattgccgccgatggcaagggtgcgcccaagttcctcgctcagggcacgctttaccctgacgtcatcgaaagtgtatccttctccggtggcccttcggtcaccatcaagagtcaccacaatgtcggtggccttcccgagcgcatgaacatgcagctcgtcgagccgctgcgtgaactcttcaaggatgaagtgcgcgcacttggccgcgaactcggcctgccggaaagcttcatcggtcgtcatcccttccccggtccaggtctcgcgatccgctgcccgggcgcgatcactcgtgagaagctcgatatcctgcgcaaggcggatgcgatctatctcgacgaaatccgcaaggccggtctctacgataccatctggcaggcctttgccgtgctgctgccggtgcagaccgtgggcgtgatgggcgactaccgcacctacgacttcgtctgcgcgctgcgcgccgtgacgtcagtggatggcatgacggcggatttctatccctacgacatgaacttcctcggtcgtgcggcaacccgcatcatcaacgaagtgcgcggcattaaccgtgtggtctacgacgtgacgagcaagccgcccggcacgatcgagtgggagtaactcgagacccagctttcttgtacaaagtggtgataaattggagctctgcagagctttcgttcgtatcatc

SEQ ID NO: 778 - DNA, 741 bp, Zea mays
ttcttgtttgttgattaacccttaattaatccgggcgcgcctgatttatcacaagtttgtacaaaaaagcaggctcctgcaggaccatggcggcaacggctctgctactccccagcctcgcggcgctcacggacacgccgcgccgcgcccacaggttgctgcagccgcagctccagctccagcgcggctcccttgtctctcggtccctccggcctccgcggcgtcggcggctcgcggtctcggccgtgcaagagacgaaggagggggaggccaagacggccgacgagataaccgagaagtacgggctcgagttcggcctctggaaggtgttcagctccaaggaggaagagggaggcgaggggaagaagtcgcggacggaccaggccaaggaactcctggccaagtacggcggcgcgtacctggccacctccatctcgctctccatcgtctccttcactctatgctacctcctcgtcagcgccggcgtcgacgtgcaggacctgctcgcgaaggtcgggatcgtgacaggggaaaccggagggaaggtcgggaccttcgcgttggcctacgccgcgcacaaggccgcgtcgccgatcaggttcccgccgacggtggcactgacgccggtggtggccagctggattggcaagatcaggaagggcggcgactgactcgagacccagctttcttgtacaaagtggtgataaattggagctctgcagagctttcgttcgtatcatc

SEQ ID NO: 779 - DNA, 1629 bp, Bacillus halodurans
ttcttgtttgttgattaacccttaattaatccgggcgcgcctgatttatcacaagtttgtacaaaaaagcaggctcctgcaggaccatggactttcacacagatacgattatccttctggcagggctcttgttcattgtgggtgtcatcacagctaagttctccactcgattaggtgtgcccgctctcgtcttgtttattctcgtcggtatgcttgttggcagcgacgggctaggcctcattcattttgattttagtcaagcacattttgcccaactcatcgggatcttcgcccttgtcatcattttgtttgaaggagggttacagacgaaatggaaaacggtccaatcggtagcggtgccatcgctctcccttgccacgttcggtgttttgatcacttccacattggtggcggttgcggcgaagtacgtccttggcgtaagctggcttgaggcgtatttattcggggcgattgttgggtcaaccgatgctgcagcggtttttgctgtattaaaggaacaaaacattaaagaccgtctcgccaccacattagaggcagagtcagggacgaacgatccaatggccgtctttttaacgctctcccttattgaattgattacgatcggttccatgaacccgctccacttattcggctccttcctatggcaaatgggggcagggctcattcttggattcggacttggcaagctagggtcttactcgattaataaaattaaccttgattccagtggactttatcctgtgtttgctcttgcgtttgccttgctcacgtacagtgtgaccgcgatgattggagcgagtgggctgctcgcggtttacgtagcggctcttgtgatcggcaaccaagacttgacgtatcgacattcgattttccgctttaacgaagggtttgcgtggatgatgcaaatgctcatgttcatcattctcggactccttgtttttccgaatcaactgtttgaagcatccatctttattaaaggtatccttctttccctcattttaatgcttgtggctcggccggttgccgtgttcctcacaaccattaagatgaggttcgattggaaagaaaagctctttctgtcttgggctggcttgcgtggtgcggttccaattgtattagcgacctttccgatgacagcaggcctcgaaaacagtccgttgtttttcaatgtcgtgtttttcgtcgtcctcacctcagcccttatccaaggttctactatcgcccattttgccaataaactgcagctaacggggccacaaaaaacgacccctttgcattcccttgagcttgtgtcgatcgggaaggcgaacgcggaaattgtggagcttgagatgaaacaggatactcccgtaatcggaaaaacattggaggaaatcaacttgccgaaggatgtgctcgtcaatgcgattattcgagacgaacagctcattacgccatatggtaaaacgacgatccaagcggatgatattttatatgtcctcgtatcaaagaaaaagaaaaggcagctaaaggaattgttccaagcgaaggaaagctaactcgagacccagctttcttgtacaaagtggtgataaattggagctctgcagagctttcgttcgtatcatc

SEQ ID NO: 780 - DNA, 1707 bp, Chlorobaculum tepidum
ttcttgtttgttgattaacccttaattaatccgggcgcgcctgatttatcacaagtttgtacaaaaaagcaggctcctgcaggaccatggcaacatccctgcaatcggtcatcgtcctcgatttcggttcacagtacactcagctcatcgcacggcgcatccgcgagatcggcatctactccgagatttttccgtaccacacaaaggccgaaaccatccgggcgcatcagccgaaagcgatcatcctctccggcggcccgaacagcgtctatgacgaaaaagcattcatgcccgacccggaggtgttcagcctcggcgtgccggtgctcggcatctgctacggcctgcaggccatcgccaagcacttcggcggcaacgtcgaaagctcctcgaagcaggagttcggacgcgccaagatgctggtgaaccacgacgagagcgagagcctgctcttccgcgacatccccgattcggacgtctggatgagccatggcgacaaggtgacgcagctgccggagggcttccgcgtgacggcgagcaccgcgaatgccgaggtgtgcgccatcgagagcttcggcagcaaagccgcgctcaaggtctatggcttgcagtttcaccccgaagtgcaacactcgctctacggcaagcagctgctctcgaactttttgatcgacatcgcgggcatcacgccggactggtcgccgaagagcttcatccagcaccagatcgaggagatcaagcgggttgcgggcgactcgaccgtggtgtgcggcatcagcggcggcgtcgattccacggtggccgccgtgctcgtcagcaaggcgatcggcgacaagctgcactgcgtctttgttgacaacggcctgctccgcaaggatgaagcggtgaaggtgatggagttcctcaagccgctcggtctgaacatttcgctcgtcgacgccagcgatctctttttagggcgactcaaaggcgtagcctcgccagagaagaagcgcaagatcatcgggcgcaccttcattcaggtgttcgaaaagaacattcacgacgagaagttcctcgtgcagggcacgctctacccggacgtgatcgagagcgtcagcgtgaaaggaccgtccgagacgatcaagtcgcaccacaacgtcggcggcctgccgaagcgcatgaagctcaagctcatcgagccgctgcgcgagctgttcaaggatgaagtccgcgccgtcggacgcgagcttggcatcgccgaggacatcctgatgcgccaccccttccccggccccggcctcgccgtgcgcgtgctcggctcgctcacgcgggagcgcctcgacgtgctgcgcgacgccgaccagattttcatcgacgagctgaagtcgagcggcctctactcgaaggtgtggcaggccttctcggtgctcctgccggtgcagtcggtcggcgtgatgggcgacaaacgcacctacgaaaacgtgctcgccttgcgagccgtggaatccaccgacggcatgaccgccgactgggcgcacctcccccacgacttcctcgccaaagtctcgaaccgcatcatcaacgaagtgagaggcatcaaccgtgtggtatacgatatttcctcgaaaccgccagccacgatcgagtgggagtgactcgagacccagctttcttgtacaaagtggtgataaattggagctctgcagagctttcgttcgtatcatc

SEQ ID NO: 781 - DNA, 975 bp, Arabidopsis thaliana
atggatctagttatataagcttgaaagaagttagtttctttggtaggtcttagctttgcaatgaaattgtacgaacacgatggagttgatttagaagatgggaagacagtaaaatccggaggagataaaccaattccaagaaagatacataaccgggctttgttatccggtttagcttattgcatttcatcatgcagtatgatacttgtcaacaagtttgttctctccagctacaacttcaatgctgggatcttccttatgttataccagaactttgtctcggtgatcattgtggttggtttgagtttaatgggtctaataactactgaaccacttactttgaggttgatgaaggtctggtttccagtgaatgtcatctttgttggtatgcttatcacaagcatgtttagtttgaaatacatcaatgtagcaatggtcactgtcctgaagaatgtcactaatgtgataactgcagttggtgagatgtatctgttcaacaagcaacatgacaacagagtgtgggctgctctcttcttaatgataatttccgcagtttctggaggaataacagacctatcattcaatgctgttggctatgcttggcagattgctaattgcttcttaactgcatcgtactcgctgactttgagaaagaccatggatacggccaagcaggttactcaatctggaaacttgaacgagttctccatggtcttgcttaataacacactttcattaccacttgggcttcttctttcttatttcttcaacgagatggattatctctatcaaacgccacttctacgattaccaagtttctggatggtcatgacacttagtggacttctagggcttgccattagctttacttcaatgtggtttcttcatcaaactggagcaacaacatacaggtagcaaattagagagagatagagcaatttcaaaactttgcttaagagagtgttgctgtcccct

SEQ ID NO: 782 - DNA, 2019 bp, Escherichia coli K12
ttcttgtttgttgattaacccttaattaatccgggcgcgcctgatttatcacaagtttgtacaaaaaagcaggctcctgcaggaccatggatagccatacgctgattcaggcgctgatttatctcggttcggcagcgctgattgtacccattgcggtacgtcttggtctgggatcggtacttggctacctgatcgccggctgcattattggcccgtgggggctgcgactggtgaccgatgccgaatctattctgcactttgccgagattggggtggtgctgatgctgtttattatcggcctcgaactcgatccacaaaggctgtggaagctgcgtgcggcagtgttcggctgtggcgcattgcagatggtgatttgcggcggcctgctggggctgttctgcatgttacttgggctgcgctggcaggtcgcggaattgatcggcatgacgctggcgctctcctctacggcgattgccatgcaggcgatgaatgaacgcaatctgatggtgacgcaaatgggtcgcagtgcctttgcggtgctgctgttccaggatatcgcggcgatcccgctggtggcgatgattccgctactggcaacgagcagtgcctcgacgacgatgggcgcatttgctctctcggcgttaaaagtggcgggtgcgctggtgctggtggtattgctggggcgctatgtcacgcgtccggcgctgcgttttgtagcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggagagcgatatcgaaccatttaaaggtttgctgttggggctgtttttcatcggtgttggcatgtcgatagactttggcacgctgcttgaaaacccattgcgcattgtcattttgctgctcggtttcctcatcatcaaaatcgccatgctgtggctgattgcccgaccgttgcaagtgccaaataaacagcgtcgttggtttgcggtgttgttagggcagggcagtgagtttgcctttgtggtatttggcgcggcgcagatggcgaatgtgctggagccggagtgggcgaaatcgctgaccctggcggtggcgctgtcgatggcagcaacgccgattctgctggtgatcctcaatcgccttgagcaatcttctactgaggaagcgcgtgaagccgatgagatcgacgaagaacagccgcgcgtgattatcgccggattcggtcgttttgggcagattaccggacgtttactgctctccagcggggtgaaaatggtggtactcgatcacgatccggaccatatcgaaaccttgcgtaaatttggtatgaaagtgttttatggcgatgccacgcggatggatttactggaatctgccggagcggcgaaagcggaagtgctgattaacgccatcgacgatccgcaaaccaacctgcaactgacagagatggtgaaagaacatttcccgcatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgtgccgatgtgttccgccgctttaatattcagatggtggaagagatggcaatggttgagaacgacaccaaagcccgcgcggcggtctataaacgcaccagcgcgatgttaagtgagatcattaccgaggaccgcgaacatctgtcattaattcaacgacatggctggcagggaaccgaagaaggtaaacataccggcaacatggcggatgaaccggaaacgaaaccctcatcctaactcgagacccagctttcttgtacaaagtggtgataaattggagctctgcagagctttcgttcgtatcatc

SEQ ID NO: 783 - DNA, 1593 bp, Escherichia coli K12
ttcttgtttgttgattaacccttaattaatccgggcgcgcctgatttatcacaagtttgtacaaaaaagcaggctcctgcaggaccatggcgcagtcgaaactctatccagttgtgatggcaggtggctccggtagccgcttatggccgctttcccgcgtactttatcccaagcagtttttatgcctgaaaggcgatctcaccatgctgcaaaccaccatctgccgcctgaacggcgtggagtgcgaaagcccggtggtgatttgcaatgagcagcaccgctttattgtcgcggaacagctgcgtcaactgaacaaacttaccgagaacattattctcgaaccggcagggcgaaacacggcacctgccattgcgctggcggcgctggcggcaaaacgtcatagcccggagagcgacccgttaatgctggtattggcggcggatcatgtgattgccgatgaagacgcgttccgtgccgccgtgcgtaatgccatgccatatgccgaagcgggcaagctggtgaccttcggcattgtgccggatctaccagaaaccggttatggctatattcgtcgcggtgaagtgtctgcgggtgagcaggatatggtggcctttgaagtggcgcagtttgtcgaaaaaccgaatctggaaaccgctcaggcctatgtggcaagcggcgaatattactggaacagcggtatgttcctgttccgcgccggacgctatctcgaagaactgaaaaaatatcgcccggatatcctcgatgcctgtgaaaaagcgatgagcgccgtcgatccggatctcaattttattcgcgtggatgaagaagcgtttctcgcctgcccggaagagtcggtggattacgcggtcatggaacgtacggcagatgctgttgtggtgccgatggatgcgggctggagcgatgttggctcctggtcttcattatgggagatcagcgcccacaccgccgagggcaacgtttgccacggcgatgtgattaatcacaaaactgaaaacagctatgtgtatgctgaatctggcctggtcaccaccgtcggggtgaaagatctggtagtggtgcagaccaaagatgcggtgctgattgccgaccgtaacgcggtacaggatgtgaaaaaagtggtcgagcagatcaaagccgatggtcgccatgagcatcgggtgcatcgcgaagtgtatcgtccgtggggcaaatatgactctatcgacgcgggcgaccgctaccaggtgaaacgcatcaccgtgaaaccgggcgagggcttgtcggtacagatgcaccatcaccgcgcggaacactgggtggttgtcgcgggaacggcaaaagtcaccattgatggtgatatcaaactgcttggtgaaaacgagtccatttatattccgctgggggcgacgcattgcctggaaaacccggggaaaattccgctcgatttaattgaagtgcgctccggctcttatctcgaagaggatgatgtggtgcgtttcgcggatcgctacggacgggtgtaactcgagacccagctttcttgtacaaagtggtgataaattggagctctgcagagctttcgttcgtatcatc

SEQ ID NO: 784 - DNA, 1470 bp, Bacillus halodurans
ttcttgtttgttgattaacccttaattaatccgggcgcgcctgatttatcacaagtttgtacaaaaaagcaggctcctgcaggaccatggacgctagatcactcatttctctgattccatcgttatctgcttataaatggtatggaaaagtgactcgcgtgattggtttaacgatagaagcaaaaggaccacaagcttccatcggtgaattgtgttacatcctcgtaggaaaacaaggaacaaaagtgatggctgaggtagtcggctttaaggaagagcgagtgcttttaatgccgcttaacgggacggcagagattgctcctggtagcttagttgaaggaaccggtcgccctctccaagtgaaggtgggctatagcttaattggccatgtcattgatggctgtggtcggcctttaactggggaagcattacctaatgggttaacgccgtatccgacagataacccgccgccaaatcccatttctcgtccacggattaaggaagcgatgcacttaggggttcgcgcgatagacggactgcttacagtcggaaaaggacaacgtgtcggaatttttgccggaagtggcgtagggaaaagcacactccttgccatgttagcgaaaaacgctgccgctgatctgaacatcattgctcttatcggcgaacggggacgagaagtgaaagattttattgaaagggatttaggcgaagatggacttaggcggtcgattatcgtagtggccacctcagaccaaccagccctcatgcggattaaaggggcgatgacggcaactgctcttgctgaatattttagggaccagggcctacacgtcaatttaatgatggattcagtcacaaggtttgcgatggcacaacgggaaattggtctagcggtcggtgaacctccgacaacgaaaggctatactccatcagttttcgctttgctaccaaaattattggaacgtgcaggaaccaatgggaaagggagcatcactggcttctacacggttctcgtcgacggagatgatttgaatgaaccgatctcagatacggttcgtggaattcttgatgggcatttcgtccttgatcgcgagcttgccaataaggggcattatccggcgatcaacattttaaaaagtgtgagtagggtgatgaatgatattgttacagatgagcaaaagcgtgctgcagagcatgttcgctcactattatcggtatataaagaatcggaagacttaattaacattggcgcttacaagcgtggctcatcgaaacaaattgatgaagcgatcgagcgacagccggaagtgatttcctttttaagacaaaatacggatgaagtggcgattgctgaacattcgatccaacaattaattcaagcttttggaaagggtgattgactcgagacccagctttcttgtacaaagtggtgataaattggagctctgcagagctttcgttcgtatcatc

SEQ ID NO: 785 - DNA, 1440 bp, Chlorobaculum tepidum
ttcttgtttgttgattaacccttaattaatccgggcgcgcctgatttatcacaagtttgtacaaaaaagcaggctcctgcaggaccatgatgagcaacaatcagttcgattccatagaatcagccatcgaagacattaaaaacggcaagctgatcatcgtcgtcgatgacgaagatcgggaggatgaaggcgattttattgccgctgccgagcatgtgacccccgagatggtgaacttcatcaccaaagaggcgcgcggcctgctctgcgtggctattcccatggagcgcgcccgcgagttgcagcttgaaccgatggtgcagcgcaacacctcccagcacgaaacaaacttcaccgtttcaatcgacgcgatcgccgaaggggtgaccaccggcatttcggcctacgaccgatacatgacgctcaagatgcttgccgatccgtcctccacggcggacgacttctcacgccccggccacatcttcccgctccgggcgatggatggcggtgtgctacgcagggttggtcacaccgaggccgcggtcgatctctgtcgtcttgccggatgccagccagccggtttgctctgcgaaatcctgcacgacgacggcagcatggcgcgtgtgcccgaactgctgaagctcaaagagaagctcggcatgaagctcatcacgatcaaagatctcgtggcttaccggatgcagcggtcgaagctcgtgcaccgcgccgtcgagtcgaagctaccgaccgcgtatggcgagttcaagctcattgcctacgaaaccatcgtcgatcagcagaatcacatggccttcgtcaagggcgatgttggcaacggcgagccggtgcttgcccgggtgcactcgcagtgcgccacgggcgataccttcggttcgttgcgttgcgactgcggtcaccagctcgaaaccgctctgcgcatgattgaaaaggaggggcgtggcgtcctgatttacctcatgcaggaggggcgaggcatcggcctcatcaacaagctcaaggcctacaaccttcaggacgaagggttcgacacggtcgaggccaacgagaagctcggtttcaaacccgaccttcgcgactacggcatcggtgcgcagattcttcaggaccttggtgtcaggaagatgcggttgatgaccaacaacccgaaaaagattgtcggtctggaaggctatggtcttgaaatcgtcgaacgcgtaccgctcgaaatcgagccgaacgaggtgaaccgccactacctgcagaccaagcgcgacaagcttggtcacatgattcaaatggcttcgggcaatgaacggattctcttcgagcgccttgccgatgagcagttgaaacagcacaaaaaagattaactcgagacccagctttcttgtacaaagtggtgataaattggagctctgcagagctttcgttcgtatcatc

SEQ ID NO: 786 - DNA, 1788 bp, Corynebacterium glutamicum
ttcttgtttgttgattaacccttaattaatccgggcgcgcctgatttatcacaagtttgtacaaaaaagcaggctcctgcaggaccatgaccatttcctcacctttgattgacgtcgccaaccttccagacatcaacaccactgccggcaagatcgccgaccttaaggctcgccgcgcggaagcccatttccccatgggtgaaaaggcagtagagaaggtccacgctgctggacgcctcactgcccgtgagcgcttggattacttactcgatgagggctccttcatcgagaccgatcagctggctcgccaccgcaccaccgctttcggcctgggcgctaagcgtcctgcaaccgacggcatcgtgaccggctggggcaccattgatggacgcgaagtctgcatcttctcgcaggacggcaccgtattcggtggcgcgcttggtgaggtgtacggcgaaaagatgatcaagatcatggagctggcaatcgacaccggccgcccattgatcggtctttacgaaggcgctggcgctcgtattcaggacggcgctgtctccctggacttcatttcccagaccttctaccaaaacattcaggcttctggcgttatcccacagatctccgtcatcatgggcgcatgtgcaggtggcaacgcttacggcccagctctgaccgacttcgtggtcatggtggacaagacctccaagatgttcgttaccggcccagacgtgatcaagaccgtcaccggcgaggaaatcacccaggaagagcttggcggagcaaccacccacatggtgaccgctggtaactcccactacaccgctgcgaccgatgaggaagcactggattgggtacaggacctggtgtccttcctcccatccaacaatcgctcctacgcaccgatggaagacttcgacgaggaagaaggcggcgttgaagaaaacatcaccgctgacgatctgaagctcgacgagatcatcccagattccgcgaccgttccttacgacgtccgcgatgtcatcgaatgcctcaccgacgatggcgaatacctggaaatccaggcagaccgcgcagaaaacgttgttattgcattcggccgcatcgaaggccagtccgttggctttgttgccaaccagccaacccagttcgctggctgcctggacatcgactcctctgagaaggcagctcgcttcgtccgcacctgcgacgcgttcaacatcccaatcgtcatgcttgtcgacgtccccggcttcctcccaggcgcaggccaggagtacggtggcattctgcgtcgtggcgcaaagctgctctacgcatacggcgaagcaaccgttccaaagatcaccgtcaccatgcgtaaggcttacggcggagcgtactgcgtgatgggttccaagggcttgggctctgacatcaaccttgcatggccaaccgcacagatcgctgtcatgggcgctgctggcgcagttggattcatctaccgcaaggagctcatggcagctgatgccaagggcctcgataccgtagctctggctaagtccttcgagcgcgagtatgaagaccacatgctcaacccgtaccacgctgcagaacgtggcctgatcgacgccgtgatcctgccaagcgaaacccgcggacagatttcccgcaaccttcgcctgctcaagcacaagaacgtcactcgccctgctcgcaagcacggcaacatgccactgtaactcgagacccagctttcttgtacaaagtggtgataaattggagctctgcagagctttcgttcgtatcatc

SEQ ID NO: 787 - DNA, 2580 bp, Zea mays
ttcttgtttgttgattaacccttaattaatccgggcgcgcctgatttatcacaagtttgtacaaaaaagcaggctcctgcaggaccatggcgagccaaggcgagccgtcttcctccgatccgaaggggaagaaggattactcgacggcgatcctggagaggaagaagtcgccgaaccggctggtggtcgacgaggccaccaatgatgacaactccgtcgtcgctctgcacccggacaccatggagaggctccagctctttcgcggtgacacggtcctgctcaagggtaagaagagaaaggacactatctgcattgtgctcgcagacgagacgtgtgaggagccaaaggtccggatgaacaaggtcgtcaggaagaacttgagggttcggcttagtgatgtggtatctgtccatcaatgcccagatgtcaaatacgggaagcgtgtgcacatacttccaattgatgacaccattgaaggcatcactggcaacttatttgatgcctttctgaaaccatactttcttgaagcctatcgtcctttgaggaaaggagaccttttcctagtcaggggtggcatgagaagtgtagaattcaaagtcatagagactgatcctgcagagtattgtattgttgcaccagatacagaaatattctgtgagggtgagcctattaagagggaggatgaggaaagactcgatgaagttggctatgatgatgttggtggagttagaaagcagatggcccaaatcagagaactggttgaacttcccctgcgtcacccccagcttttcaagtctattggtgtgaagccaccaaagggcatattgctgtatgggcctcctggctctggcaagacccttattgctagagctgtagctaatgagacaggtgctttcttctttttgatcaatggaccagaaatcatgtcaaagctagcaggagaaagtgaaagcaacctcagaaaggcatttgaagaagctgagaaaaatgcaccttcaatcatttttattgatgagatagattccatagcacccaagagagaaaagacccatggagaagttgaaaggcgtattgtttcacagctcttgactcttatggatggcctcaagtctcgtgcacatgttattgttatgggtgccacaaaccgtccaaacagtatcgatcctgctcttagaaggtttggtcggtttgatcgtgagattgatatcggtgttccagatgaagttgggcgccttgaggttcttcggattcacacgaaaaacatgaagcttgctgaagatgttgacttggagatcattgcgaaggatactcatggttatgttggtgctgatcttgctgccctttgtactgaagctgctcttcaatgcattcgtgagaagatggatattatagatcttgaggatgagacaatagatgcggagatactgaactctatggctgtctcaaatgatcatttcaagactgcacttgggacaagcaacccatctgctctgcgtgaaactgttgttgaagtgccaaatgtctcttgggaagatattggtggcctggaaaatgttaagagggagctacaggagactgttcaatatccagtggagcatccagagaaatttgaaaagtttggcatgtctccttcaaagggtgttttgttttatggccctcctggctgtggcaagactttgttggccaaggcaattgccaatgaatgccaagctaacttcattagtgtgaagggtcctgaactgcttaccatgtggtttggtgagagtgaggccaatgtccgtgagatttttgacaaggctaggcagtctgctccatgtgtcctcttttttgatgagctcgactccattgctactcagagaggaagcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcagcaaagacaaccccgaggctatggaggaagacgaggtagacgacatcgctgagatcaaggctgctcacttcgaggagtccatgaagtacgcccgtcgcagcgtgagtgacgccgacatccgcaagtaccaggccttcgcccagacactccagcagtcccgcgggtttggcagcgagttccggttccccgaccaaccgacggcagctgctgctgcggccgatcccttcgcatccgctgcagcagcagctgacgatgatgacttatacagttaactcgagacccagctttcttgtacaaagtggtgataaattggagctctgcagagctttcgttcgtatcatc

SEQ ID NO: 788 - DNA, 669 bp, Zea mays
ttcttgtttgttgattaacccttaattaatccgggcgcgcctgatttatcacaagtttgtacaaaaaagcaggctcctgcaggaccatgccgccttccgcatcgatgccggcgacgcacacggccgtgtacgtggcggcggtgcccctgcgggcgcccaagggccccgcccagctgctgatgtcggcgggctactcgctgggcatgtgggacctgcagcacttcatggtgctcctccggcccgacccggcgctggcccaggcgctggtcttcgatttccagccgcgggacccagaggacgtcctcgccgcgctcgcggtgctgtcgcggagagagatccctggcgtggttcgcagaagaacgctgcggagggtcccggaccggcggtgctggctcgtggggcactgctgcgacgccgtcggtgccgccacaaggttcagcgagcggtggacgaccggcctggtggtcggggagcacgactgccgggactacaccgacgggctggtcgaggtcctgacaggtgaaaaacgtgtcctggagtcgctcagattgcgcggcaacggcagcagcaccagcaccagtggggcggcgccgccgtgactcgagacccagctttcttgtacaaagtggtgataaattggagctctgcagagctttcgttcgtatcatc

SEQ ID NO: 789 - DNA, 555 bp, Zea mays
ttcttgtttgttgattaacccttaattaatccgggcgcgcctgatttatcacaagtttgtacaaaaaagcaggctcctgcaggaccatgagccgcagcctcggtatcccggtgaagctgctgcatgaggcggcgggccacgtcgtcacggtcgagctcaagaccggcgaggtctaccgcggctccatggtcgagtgcgaggacaactggaactgccagctcgaaaacatcaccttcacggcaaaggacggcaaggtgtcgcagctggagcacgtcttcatcagggggagcagggtcaggttcatgattatacccgacatgctcaagaacgccccaatgttcaagcgccttgaggccaggattaggggtaaaggctcagctgttggtgtcggccgaggccgcgcggtcgccatgcgggctagggctgctgctggtcgtggcggtggtcctgttggacgaggtggtgcaccccctgtgaggaggtagctcgagacccagctttcttgtacaaagtggtgataaattggagctctgcagagctttcgttcgtatcatc

SEQ ID NO: 790 - DNA, 1719 bp, Zea mays
ttcttgtttgttgattaacccttaattaatccgggcgcgcctgatttatcacaagtttgtacaaaaaagcaggctcctgcaggaccatgggagaagcacaagactactacaacacctccacggctctggccggcgccgccgccgcgggcctcgcgctgctcgcggtctgctcgtactacctgctcgtcgggcggcgccgcggcaaggcgccgaagcggtacgcgccggtggtggggacggtgttccaccagctgtaccacgtccggcggctgcacgactaccacacggacctgttccggcagcgcaagaccttccagctgctggtgccggccggccggcggcagatatacacgtgcgaccccgccgtggtcgagcacatcctcaggaccaacttcgccaactacggcaagggcagcttcaactacgagaacatgactgacctgctcggcgacggcatcttcgccgtggacggcgacaagtggaggcagcagcggaagatcgccagctacgacttctccacgagggcgctgcgcgatttcagcggcgcggtcttcaagaggaacgccgcgaggctcgccggcatcgtctccggcaacgcggcgtccgggcagcccatggagttccagggcctcgcgctcagggcgaccatggactccatcttcaccatcgccttcggcctggacctagacacgctgggcggctcggcggaagggagccgcttcgccgcggcgttcgacgacgccagcgagttcacgctgctccgctacgtgaacgcgttctggaaggcgcagaggttcctcggcgtcggctccgaggcggcgctcaagaagcgggtcaaggtcgtcgacgagttcgtgtacaagcgcatccgcgagagagcacaggagctctccgacagcaagatggcgaccgaggacactgtccctgattcgaggcaagacatgctgtccagattcatccacacggccacgaacgagtccgggacggtggactacaagtacctgagggacatcatactgaacatagtcatcgccggcaaggacacgacggcgggggcgctcgcctggttcctctacatggcgtgcaagcacccggagatccaggagaagatctgccaggaggccgcaaaggcgaccagcgccagcgagacggcgggcgtggacgagttcgcgcagagcctgaccgacgaggccctgaacaagatgcactacctgcacgccgcactgaccgagacgctcaggctgtacccgtcggttcctctggataacaagcagtgcttcggagacgacgtcctgcctgacggttccagcgtcagcaagggagacatcgtgttctacgtcccctacgccatgggccggatggagtacctctggggcaaggacgccgaggtgttccggccggagcggtggctggatcaggacggagagttccagcaggagagcccgttcaaattcacagcgttccaggctggtccgaggatatgcctggggaaggagttcgcgtaccggcagatgaagatcttcgcggcggtgctcctccgattcttcgtgttccgcctgcgcgacggcgacaaagcgagcgtgaattaccggaccatgatcacgctccacatcgacgagggtctgcatctgacagcgacggcgagatgactcgagacccagctttcttgtacaaagtggtgataaattggagctctgcagagctttcgttcgtatcatc

SEQ ID NO: 791 - DNA, 1437 bp, Zea mays
ttcttgtttgttgattaacccttaattaatccgggcgcgcctgatttatcacaagtttgtacaaaaaagcaggctcctgcaggaccatggagatggagcagctctgctcgctgctccgcgacctcgacgcgctcaagcagcatcccgacgatctcacttccaccatcgatcggatgcgggagcggctagtggcgatgatgaatccggcagccggtgccgcttctcgatccaagattaaggacatgagtgcagaagtggtggacaacaatccctacagcagacttatggcgttgcaacggatgggcgtagtggagaattatgagcgcatcagggactactccgttgccatcgttggcataggtggcgttggtagtgttgccgcggagatgctcactagatgtggaattggacggctgttgttgtatgactacgacacggtcgagttggctaacatgaataggttgttctttcgcccagaacaggttggaatgaccaaaacagatgccgctgtacagacactttctggaataaatcctgatgttgtgttggagagctactcattgaatattactacagtcaaaggtttcgaaacatttttggcaagtttaaaagcacaaagttctcatgagcgtagcactggagttgatcttgtcttgagttgtgtcgataactatgaagctcgtatggttgtaaatcaggcatgcaatgagcttggtcaaacgtggatggagtctggtgtctcagaagatgctgtttctggtcatatacaactgctggttcctggtgaaactgcatgttttgcatgtgctcctccattggttgtagcatctggagtggatgagcgtacacttaagagagaaggtgtttgtgctgcctctttgccaactacaatgggtgttgttgcgggtctcctggtccagaatgctctgaaatatttgttgaactttggacaagtttccccttacttgggatataactcacttaaggattatttccctgctatggaaatgaggccaaatccacaatgcttgaatccagcatgtgttcacagacagaaagaatatatggaatccaaacctgctagagatgcagcagcgaagactaagatggaagctgaagcatccacagaaaatgaatgtcctgtccacctagacaatgagtggaatattagtgttcttgatgatgaagaaactgagacatcaagcattcgaaacactccagatatcctaccggaaggtcttgtccgtgagcttccagacgctgattcatacgcaggaccagctgctccagtgagttccagcgctattgatgatgatgatgatctcgaggagctccagcgtcaacttgatgccctaaacgcatcttagctcgagacccagctttcttgtacaaagtggtgataaattggagctctgcagagctttcgttcgtatcatc

SEQ ID NO: 792 - DNA, 1515 bp, Zea mays
ttcttgtttgttgattaacccttaattaatccgggcgcgcctgatttatcacaagtttgtacaaaaaagcaggctcctgcaagaccatggcgtcaggagccaccttaagctgggttaaaaccccatttgacacccgaagatttcatgacctatctaatctaagtttccgctgccgaaacccttttggatcaattcagccctggtggctgcaaactgatcaagactcatccctaatcaaggttcgcgtggctgctgattattcagactcaatgccagattcaaagtacacgagagatcggggttatcaccctcttgaagaagttaaagaacgtccaaagaagaaggacctgttgctgacagatattgaaacagctagaacagtagtagaggcaaatagcaaggggttgcttgtatttcctgctagggtacacaatgaacctcatggacatgtttcttggtcggagtttcaatatgttgttgatgaatatggagacattttctttgaagtacctgacagtgagaacatcctggaagatgatactgcaaacaatcctgtgacagttttgattggaatggatggacccattattggagaaagtagtgtggcgattagtgatttcagtgattacatggatggtgaaaattttatggacgttcctgatgagcaccacaccaagattgatacagaaataactgatattctcatagagtgggggatgcctgcaacaatgcgtgcaatacatccgatttactttgccaaatgtttgacaaaggccattcataataataatggggagaagatggatagtccatcaaacggtctctctattgtaggatatctgagacctgctttcatagaggaagagtcttacttgaggagcatgtttcatggtgacaatggtggttattcatctgactggaaagtaaatgaaaccgatgaatacaacagagaaactcggccagtttctggaaccaatcgcctcattgatgatgataaatcaagatttgacttcaatcatgctgaaactagaactgattcaatgatctacaagctggagataatgacaattgaactgttttccatgtatggaaagcagtttaagattgatccacaagattttcaagattcagaaccagatattcttgcaaattctgcttcatcgataatagaacggatcaaagaaaacagtgatcagtgtgccgcggctctcaggtcgctctgtcgccggaaaaagggcctcactgtcgaggaggcaagcttgattggtgttgacagccttggtattgatgtaagagccttttctggcttggaagttaagactgttcgattttcattcaatgcacaggcgctctctgaacgttcagctgaaaagaagatcaggcgaatgcttttcccccgttaccagcgtaaaaacgtgaaagcctctactgaagatgagtcttaactcgagacccagctttcttgtacaaagtggtgataaattggagctctgcagagctttcgttcgtatcatc

SEQ ID NO: 793 - DNA, 906 bp, Zea mays
ttcttgtttgttgattaacccttaattaatccgggcgcgcctgatttatcacaagtttgtacaaaaaagcaggctcctgcaggaccatgccaccgaaccgcaagaggcgagcagcagccatggatcccgcggcaggaggcgccggccagcagcgccagaacaaagcttcggcgggcaagaaggtaaagaagggcggtggcagcggcgggagatggccggcggtcaagcccaagaaggatctccagatcaatcgcctcaagggcacccacctcctcaccattccagacttcttcacttctgcggaggcaaaggctttcattgatatcgctgagtcgatgggcttcacgcaccagggcagtttggggccactaaagggggaggcttacagagacaacgatcggatatctgtgacggatccattgcttgctcaagccatttgggaatcaggaataaacaggatttttacagacatcagcgtctctggcaaagtagcaacaggattgaatccaaatatcaggttctacaggtacactgaaggtcagcgttttggtcggcatatcgatgagagtgtctccctcgctgatggttctaaaacgtattacacgcttttaatatacctttctggcaaaggaagtgcaaaggattcatctgggcaagctcttgtcggaggggagactgtcttttatgatcaaagaggtggagttgtcgctgaggttgctccagtgcaaggtatggcactcctccacctacatggcgccaaatgtatgctgcatgaagctcgggttgtgaaaaagaatgccaagtatgtactccgttcagatgttgtattttcttagctcgagacccagctttcttgtacaaagtggtgataaattggagctctgcagagctttcgttcgtatcatc

SEQ ID NO: 794 - DNA, 1488 bp, Zea mays
ttcttgtttgttgattaacccttaattaatccgggcgcgcctgatttatcacaagtttgtacaaaaaagcaggctcctgcaggaccatgttcaagcttgcgcggagcagccagttcgcttcggcgctcaagggcgcatacagcgctcctatcagacaatctgctttccagcagcgccgcaacctttccatccacgagtggcgctccgcgcagctcctcgactcgtacggaatcaaggtcgccaagggcaatgtcgctcacaacgcaaaggaggccgaggaggtagccaagaccattgagggcgacgacatggtcatcaaggcccaggttcttgctggtggcagaggaaagggtcacttcgacaacggcttcaagggtggtgtgaggatcgtctactctccccgcgaggctagcattctcgccgaccagatgattggccacaagctcatcaccaagcagaccggcgagcgtggtcgcatctgcaacagcgtctacattgtcgagcgcaagttcgcccgccgcgagttctacctcgccatcctcatggaccgtgctacccagtctcccatcattgtcgcctcctcccagggtggcatggacatcgaggccgtcgccaaggagagccccgagtccatcatcaccacccccgttgacatccacgttggtgttaccgacgagatggccaagaagatctccaccgagctcggcttcagccctcagtgcatcgacgccggtgccgacaccatccagaagctctacaagctcttcatggagaaggatgccactcagatcgagatcaaccctctgtccgagacctccgaccaccaggtcatgtgcatggacgccaagctcggattcgacgacaacgccgacttcaggcagaaggaggtcttcgagtggcgcgacgtcacccaggaggacgctgatgaggtcaaggctgccgagcagggcctgaacttcatcaagctcgatggtgacattggctgcctcgtcaacggtgccggtctcgccatggccaccatggacatcatcaagctcaacggtggtgcgcccgctaacttcctcgacgttggtggtggagctacccccaaggccatcaagagcgctttcgacctcatcaccgccgaccccaaggttactgccatcttcgtcaacatcttcggtggtatcgtccgttgcgacgacatcgccaagggtctgatctccgtcgccgagaccatgaacctccgcatccccatcattgcccgtctccaaggtaccaacatggaagccgcccagaagctcatcgacgagagcggtcttaagatcttcagcatcaacgacctccagagcgccgccgagaagagtgtgcagttctcgaagattgtcaagactgcccgcgacatcgatgttggcgtagagttcaacttgggcatttagctcgagacccagctttcttgtacaaagtggtgataaattggagctctgcagagctttcgttcgtatcatc

SEQ ID NO: 795 - DNA, 750 bp, Zea mays
ttcttgtttgttgattaacccttaattaatccgggcgcgcctgatttatcacaagtttgtacaaaaaagcaggctcctgcaggaccatggcagtcttgctgtggcggtgcatatgcgggccccaacaatccttcagtaagaatcgaggcgcatccaccccttctcctcctgcaggcaggagatccaaatactcgggacaatctgtgaaagcaatgcccatgcgtttgttaacggttggaaagaagaggtatcgggggacacaactccttgttgaagaatacaaggagaagctcggtcactattgcgagttcgaggacactcttatcaggtccaacccaaagcttacaagtgatgtaaaggtgcaagttgaagcagaagacacggctatgatgcagcaactcaagtctgacgattttgtagttgtgctggatgaaaacgggaaggatgtcatatccgagcagatagctgatctgattggggatgctggcaacacaggatcatcaaggctcacattctgtatcggtggaccatacggtctcgggttacaagtgcgagagcgtgcagatgcaacgattaggctgtcctcactagttttgaaccatcaagttgccttgatagtcctcatggagcagctctacagggcatggactataataaaaggacagaagtatcaccattagctcgagacccagctttcttgtacaaagtggtgataaattggagctctgcagagctttcgttcgtatcatc

SEQ ID NO: 796 - DNA, 1056 bp, Zea mays
ttcttgtttgttgattaacccttaattaatccgggcgcgcctgatttatcacaagtttgtacaaaaaagcaggctcctgcaggaccatgctccgtactctagcaagaatggcacccaagaactggacaaaggagagctttacgctcaacactggcgcaaagattcctgctgttggcctcggaacctggcagtcaaagcctggtgaggtccgtgaagctgtcaaggctgctctccagggcggctaccgtcacattgacactgcacttgcatatggcaacgagaaggaagtcggccagggtatcaaggactctggtgttccccgtgaggagatctgggtcaccaccaagctcgacaacccatggcacaagcgcgtcgaagaaggcatcaacagctcgctgagcagccttggcctcgactacgtcgatctctacctcatgcactggccctcgtcgaccgacccagatgacctgaagaagcactaccccgactgggacttcaaggacacctgggctgagatgcagaagctgcctgaatctggccgcgtgaagaacatcggtgtctccaacttcgctatcaagaatctcgagaagctcttcgccgactcccggttcaagatcacgcctgctgttaaccagatcgagctccaccccaacaacccctcgcccaagctcctcgactactgcaaggagaagggcatccactgcaccgcctactcatgcctcggctccaccgactctcctctgtacaagaacgagaagctcaagaagcttgccgagagcaaaggaaagtctgtccagcaggtcctgctgatgtggggtctccagcgcggcaccagcgtcatccccaagtctgtcacagcatctcgcatcatgggcaactttgagcttgatggctgggagttgaccgatgaggagatgaaggagattagctcgctgcctgagcgcttcaaggtttgcggagacgcctggctgcccgtcaaggtgttctttggcgacgacgagtaggtctgttgaattttgccagagctcgagacccagctttcttgtacaaagtggt

SEQ ID NO: 797 - DNA, 2385 bp, Saccharomyces cerevisiae
ttcttgtttgttgattaacccttaattaatccgggcgcgcctgatttatcacaagtttgtacaaaaaagcaggctcctgcaggaccatgggttcatcaattaactatcctgggtttgtgactaaaagcgctcatttggctgacactagtacggatgcgagcatttcatgtgaggaagcaacaagctcgcaggaagcgaagaagaatttctttcaaagggattataacatgatgaagaaggcgcctgctccaacgaagtctaaactgtctttggccttgcagacttccaagtcatcctctagtgccaacggtactgtacaagaggatacttcctcgaagacagaagatttttctacaaagagcattaagaaaaaaccagatagcggcgttgaatcgcatgtgtccatccaatcggattcggggccacaatcagactcagatttggattcagattcctctatctcatcatgtgacgaaaggaacgaagagtctttgaaagattacaggccgggtgggtaccaccctgcctttaagggcgagccctataaggatgcacgctacattttagtaagaaagctgggatggggccacttctccaccgtttggttggcaaaggatatggtaaacaacactcacgttgctatgaagattgttcggggcgacaaagtttacacagaagctgctgaagacgaaattaagcttttgcaaagagtgaatgacgccgataatacaaaggaggattccatgggggctaatcatattttgaaattgctagatcatttcaaccataagggccccaatggcgtccatgtggttatggtatttgaagtcctcggcgagaacttactggctttgataaagaagtatgaacataggggcattccattgatttatgtcaagcaaatatcgaagcagttactgcttggtcttgattacatgcataggcggtgtggtattatacacacagatattaaaccagaaaacgtgttgatggagattggagatgttgagggtatcgttcaaatggtcgaggcactggataaacagaagagagaggcaaaaaggttgcagaggcacgtttcgcggtcttctgatattaccgcgaacgatagcagtgatgagaaatgggcagaatgccaaacaagtatgccctgcggctcaagctcaaattccaaatctcgttctatagagaaggacttgtcaaaaagatgctttagaagacctagacgtcatacaattatcacagggtcgcaaccattaccttccccaattagttcatcaaatttctttgaaatgagggcgcacttttgtggtagtagtcacaatagcttttcctccgtatctgggaataggaacattccatcttccatcaataataacagtattaataatggcataggcattaagaatagcaacaatagtttcttaaattcagtaccacattctgtgaccaggatgttcataaatgaagacagtaatgataacaacaataatgataatagtaaaaataaaaataacaacaataacaacagtaacaacaataataacgaggacataatgaacacacctttgcatgaagagcagctggcagactctttatctacatttgatatttccaatatatcacaaagctccgatacaaatggtccatatatttctaatactatggattcaaattcaaacgtcagtaccgatatcaactccccagaaaatttgattcagatcaagattgctgatttaggtaatgcttgttggtatgacgaacattacacgaattctatacagacaagagaatacagatcaccagaggtgttactaggcgccccttggggttgtggtgcagatatatggtctactgcttgtctaatttttgaattgattaccggagattttcttttcgaaccggacgaaggtcattcctacactaaggatgatgaccatattgcacaaatcatcgagttattgggagaattaccatcataccttttgaggaacggcaaatatacaagaactttcttcaattcaagagggcttttaagaaatatctcgaaattgaaattttggcccttagaagatgttttaactgaaaaatataagttttctaaggacgaagccaaggaaatatctgattttttgtcgcctatgttacagctagacccaaggaaaagagctgatgcaggtggcttggttaaccatccatggctcaaggataccttgggtatggaagagattcgggtacctgatagagagttgtacgggagtggttccgatatccccggatggtttgaagaagtccgcgatcataaaagacattgactcgagacccagctttcttgtacaaagtggtgataaattggagctctgcagagctttcgttcgtatcatc

SEQ ID NO: 798 - DNA, 2493 bp, Arabidopsis thaliana
ttcttgtttgttgattaacccttaattaatccgggcgcgcctgatttatcacaagtttgtacaaaaaagcaggctcctgcaggaccgcggtgttgagaagatgacgattacatcaaatatctctgtacagaacgataacctcgttgttcaagggaagactatccttaccaaaatccctgacaacattatcctaactccggttaccggtaatggattcgtttccggttcatttataggcgcgacgtttgaacaaagcaagagtcttcatgtgttccccatcggtgtattggagggtcttcggttcatgtgctgtttccggtttaagctatggtggatgactcagagaatgggaagctgtggaaaagacattcctttggagacacagttcatgctactggaaagcaaggatgaggttgaagggaatggggatgatgctcctactgtttataccgtctttctccctctccttgaaggccagttcagagctgttctgcaaggaaatgagaagaatgagattgagatttgttttgagagtggagataaggcggtggaaactagccagggaactcaccttgtttatgttcatgctggaaccaatccctttgaagttatcagacaatccgtaaaggctgtggagagacacatgcagacatttcatcatcgtgagaagaagaagcttccttctttcctagactggtttggctggtgcacatgggacgctttctacacagatgtgactgccgagggtgttgatgaaggccttaaaagtctttctgaaggaggtacccctccgaagtttctgatcatagacgatggttggcaacaaatagaaaacaaagagaaagatgaaaactgcgttgttcaggaaggagcacagtttgctactaggcttgttggtatcaaggagaatgcaaaatttcagaagagtgatcagaaggatacgcaagtgtcaggactaaagagtgtagttgacaatgcgaagcagcgccataatgtgaagcaagtttatgcatggcatgctttagctggatactggggtggagtaaaacccgctgcttctggaatggaacactatgatagtgcattagcatacccagttcagtctccaggtgtcttagggaaccaaccagatatagtaatggacagccttgctgttcatggtctcggacttgtcaatccgaagaaagttttcaacttctacaacgaactgcattcatacttggcttcatgtggtatagatggagtcaaagttgacgtccagaacatcattgaaaccctaggtgctggtcttggcgggagagtctctctcactcgtagctaccagcaagctttagaagcttcaattgcccggaacttcacagataatggttgcatatcttgcatgtgtcacaacacagacggactttacagcgcaaaacaaaccgctattgttagagcttccgatgatttctacccaagagatcctgcttctcacaccatccacattgcatcggttgcatacaacagccttttccttggagagttcatgcaacctgactgggatatgttccatagtctacacccaactgcagagtaccatgctgcagcgcgtgcagtgggtggatgcgcaatctatgtcagtgataagccaggcaaccacaactttgatctattgaggaagctggttcttcctgatggttcagttcttcgggctaagctcccgggtaggcctacccgtgactgcttattcgctgatccagctagagatggaatcagcttgctcaagatctggaacatgaataagtttactggtattgttggtgtattcaattgtcaaggtgctggttggtgcaaggaaacgaagaagaaccagatccatgatacttctcctggcacactcacgggttcaatccgtgcggatgatgctgatctaatctctcaagtggctggtgaagattggagtggagattcaatagtctatgcatacagatcaggtgaggtggtaagactacctaaaggtgcttcaattcctctcaccctcaaagtccttgaatatgaactcttccacatctctcctttgaaggaaatcactgaaaacatttcgttcgcaccaataggacttgtagacatgttcaactcaagtggagcaatcgagtcgattgatatcaatcacgtgaccgacaagaatcctgaattcttcgatggagagatctcctcggcttctcccgcgctcagcgataaccgttctccaacagctctggtatctgtcagtgtcagaggctgtggtcgttttggagcttactcttctcagcgtcctctaaaatgcgccgttgaaagcacagagactgatttcacgtacgacgccgaggttgggcttgtgactttgaatctgccggtgacgagggaggaaatgttcagatggcatgttgagattctggtctagactcgagacccagctttcttgtacaaagtggtgataaattggagctctgcagagctttcgttcgtatcatc

SEQ ID NO: 799 - DNA, 777 bp, Arabidopsis thaliana
atgggaacaatgggtaaagcattctacagcgtaggattctggatccgtgaaactggtcaagcacttgatcggctcggttgtcgcctccaagggaaaaatcatttccgagaacagctatcaaggcaccgcacactcatgaatgtttttgacaaaacccctaatgtggataagggggcttttgtggctcctaacgcttctctctctggtgatgtccatgtgggaagaggttcttccatttggtatggatgtgtcttgagaggagatgctaacagcattagtgttggagctgggaccaatattcaggacaacgctcttgtccacgttgctaagaccaacttaagtgggaaggtcttacctactgtcattggagacaatgtcaccattggtcatagtgctgttttacatggctgcactgtcgaggatgaggcctatattggtacaagtgcaactgtcttggatggagctcatgttgaaaaacatgccatggttgcttcaggagctcttgttaggcagaacactagaattccctctggcgaggtttggggaggcaacccagctaaatttctgaggaaggtgacagaagaagaaagagtcttcttctccagttcggctgtggagtactccaacttagctcaagctcacgccacagagaacgcaaagaacttggacgaggctgagttcaagaagcttctaaacaagaagaacgctcgcgatacagaatatgattcagtactcgatgatctcacgctccctgagaatgtaccaaaagcagcttga

SEQ ID NO: 800 - DNA, 1665 bp, Arabidopsis thaliana
atgtctctttgctgtgatcttcaaatcaatctcaataaccaatttactttcttcgtcaatcaggatttgatctcagagtactcaggcttcttgaggaagatgataaaacagagcaataagaagaaaaagaatcacaagaacagtagaatcatcatcgaggttgaagattttccaggtgggtcagatgggttcgacttggttttaagattctgttatggtggaggaatctcgatagatgtctcaaatgtgtccattttgcattgctcttctgtcttccttgagatgacagagaaactctgttcctcgaatctcttgcttcgaacagagaagtttctagaaggaatgttctactggtcctggaacgacatcgtattgtgtctcaagagctgcgagcaagtgttcttacacgctgattcttacggtcttgttgataagcttgttttcggggttttagccaaaatccctcagaattcagacgtgagtcatgtcttttcatcatcctctccgtcttcctctgcctctgcctcagcctcctctcagtcgccggagacggcaatgattaggtcgtattcagacaaaaggtctacttcgaggtctttttcttgcaggacaagtaacgagtggtggttcgacgatatgtcaattctcgggccaaaaatcattgaaaagctgataaatacacttggtgcgcatgataagaacaatgacagcttggtcctcacaaaatttcttctccattacctcaagacaaaggtcccaaacaagtcaaccaacaagctcgagtattcaggtttagctgatacagcggttcaaggagtggttttcgcagcgaaaaccgcgttttcatgcagaaaaatgttctgggttctgcgagttttatcgggatttagcataagtaaagaatcaagaattggtttagagagggttataggagaaatgctggatcaagcaacacttgatgatcttctgataccagctggaggaaaaggagaaaaaggggtttacgatgtggatttggtgataagattactcaaagtgtttgtaagaattggaaacacagaagaaggagatcagaatttgagaatgagaagaattgggaagttgattgataagtatctcagagagatatctccagaccagaatcttaaagtgtcaaagtttcttgaagttgcagagagtttgccagattcagctagagattggtttgatggattatacagagccattaacatctatcttgagtctcatccgaaactatcatccgaggatagaacaaaactatgtcgatgtctaaactacaagaaattgacattggacacatgcaaacaacttgcaaaaaatcccaagatccctccaaatattgcagttcaagcactcaagtcacaacaattatcaaacgagactcgaccacactcaagagaggacaagaacaaagtaaacaagatctggaattcacgtaagtacttagaagagaaaccaatactggtgtgtttgaaaggttttgatatgtcggagaagtttgaagatgatctaatgatgaatttggagaggaagcaatggaataattctgaaaaagttagtaaggagaagaagagtgaagtaatgtcaagatctgtgagacatggacatacacattcaagttctagttttccaaggctttgttaa

SEQ ID NO: 801 - DNA, 1562 bp, Arabidopsis thaliana
ttcttgtttgttgattaacccttaattaagatgtcgatctctctctatttccttttgctcttgcctctctttttaatcttcttcaaaaagctctcaccttctaaaggaaagcttcctcctggacctctaggtcttccgattatcgggaacttgcaccaacttggaaaatctctccatagatcttttcataaactttctcaaaactatggacccgtgatgtttctacatttcggtgtggtccctgtggttgtggtctccacaagagaagcagctgaagaagttctcaagactcatgatctcgagacttgtacccgaccaaagctaacagcgaccaaattgttttcttacaactacaaagacattggcttcgctcaatacggtgatgactggagagagatgaggaagcttgcgatgctcgagctttttagctcgaaaaagctcaaggctttcaggtatattagagaagaagagagtgaagtcctagtcaataaactctcgaaatctgctgagacacgaactatggtagacttgagaaaagctcttttctcttataccgctagtatcgtatgtagactcgcttttggacagaacttccatgagtgcgattttgtcgatatggataaagttgaagatcttgtgctcgaatctgagaccaatcttggctcattcgcgttcactgacttcttccccgcaggtcttgggtgggttatagaccggatctctggccaacattcggagttgcacaaagcctttgctagacttagtaatttctttcaacatgtgatcgatgatcacttgaagcccgggcaatctcaagatcattcagacatcattggtgtcatgttagatatgatcaataaagagagtaaagtcggttccttccaagtcacctacgaccatcttaaaggagtcatgtcggatgtgtttttagcgggagtgaacgcaggagcgatcacaatgatatgggcgatgacagagctagccagacatccgagagtgatgaagaaacttcaacaagagattcgagaaatactcggagacaacaaagaaaaaatcacggaacaagatctcgaaaaggttcactacttgaaacttgtgatcgaagaaacattcagattacatcctccagctcctctcttgctacctagagagacaatgtctgacttaaagattcaaggctacaatattcccaagaacacgatgatagagatcaatacttattcaataggacgcgatcctaattgctgggaaaaccctaacgatttcaacccggagagatttatcgatagccctgtcgaatataagggtcaacattacgagttgttgccttttggtgctggtcgcaggatttgtccaggaatggctacggggataactatcgtcgagctcggtttacttaatgttctttacttctttgattggagtttgcctgatggaatgaaaattgaagacatagacatggaagaagctggagctttcgtcgtcgccaagaaagtccctcttgagctgattccaactccacatcagtggtgaatttaaatacccagcaaattggagctctg

SEQ ID NO: 802 - DNA, 1902 bp, Arabidopsis thaliana
ttcttgtttgttgattaacccttaattaaggagaaaaatggtggatctattgaactcggtgatgaacctggtggcgcctccagcgaccatggtggtgatggcctttgcatggccattactgtctttcattagcttctccgaacgggcttacaactcttatttcgccaccgaaaatatggaagataaagtagttgtcatcaccggagcttcatcggccattggagaggtactaaaattaagaataaaactacttactctcctgcaaaattattttctttaaaaccatattaattcctacaaaatggttattgtattttcaaaatatatggtgttgctttgttaaaattcttaattacaaacaaatcgatgaataacttggttagcaaatatgtttttggagagggaggtcataatacatatgttgtcaaaggccgatcataggttaagtgagattatgtttatcatgagtttctcaattttgcatggatgctgatgatcttggtaatgaaatggaacgcagcaaatagcatatgaatatgcaaaaagaggagcgaatttggtgttggtggcgaggagagagcagagactgagagttgtgagtaataaggctaaacagattggagccaaccatgtgatcatcatcgctgctgatgtcatcaaagaagatgactgccgccgttttatcacccaagccgtcaactattacggccgcggtacactactttctcgccattaccacataaaatgcgaaggataggttaacttgtaggtcaagcaatatttttggttttaacgaaaatgttgtttgtgcttgatgatgaattcgatgcagtggatcatctagtgaatacagcgagtcttggacacactttttactttgaggaagtgagtgacacgactgtgtttccacatttgctggtatgtgtatcttcggtgtttgtatcgtgatttgatcacatttcaatggcaacgatactaaagtttgagattcttgagtaggacataaacttctgggggaatgtttatccgacatacgtagcgttgccataccttcaccagacgaatggccgaatagtcgtgaatgcatcggttgaaaactggttgcctctaccacggatgagtctttattctgttagtacttcaaatgtttaccgctcctactttcttctatctcgtaagagcatacataacgttaattctctttgtgtaggctgcaaaagcagcattagtcaacttctatgagacgctgcgtttcgagctaaatggagacgttggtataactatcgcgactcacgggtggattggcagtgagatgagtggaggaaagttcatgctagaagaaggtgctgagatgcaatggaaggaagagagagaagtaaaacttttacaaccataaatatgattgcattaactaaaaaattcccaaagacttacttacattatctgtaggtacctgcaaatggtggaccgctagaggaatttgcaaagatgattgtggcaggagcttgtaggggagatgcatatgtgaagtttccaaactggtacgatgtctttctcctctatcgagtcttcacaccgaatgtactgagatggacattcaagttgttactgtctactgagggtacacgtagaagctcccttgttggggtcgggtcaggtatgcctgtggatgaatcctcttcacaaatgaaacttatgcttgaaggaggaccacctcgagttcctgcaagcccacctaggtataccgcaagcccacctcattataccgcaagcccaccacggtatcctgcaagcccacctcggtatcctgcgagcccacctcggttttcacagtttaatatccaagagttgtaataaaaactggatggaggaaatttaaatacccagcaaattggagctctg

SEQ ID NO: 803 - DNA, 504 bp, Arabidopsis thaliana
atggtgaactatgtgctcaaaatcaccgctgatctcgagaatctcactaatctccagccttccggtggctgcgacgattccaacttcccttacctcttcaagttgaaatgtgaaagatgtggagaggtgactccgaaagaaacatgtgtgactttgaatgagacttttactcctccgggaggtaggggtacttgtcatcttgttcagaagtgtaagttctgtggaagggaagggaatgtgactatgattccgggcaaaggtcgacctttaactctggaagattctgaggctggagaacatgcccctcttatggtgtttgactgtcgtggctatgaacccattgatttcggatttggtggatattggaaagctcaagctgaatctggaaccaaatttgatgagattgatttgtcgagcggggaggaattcacagagtacgatgagaagggagaatgcccagtaatgatatcgaatttccgtgcaagcttcagcgtcaccaagtga

SEQ ID NO: 804 - protein, 502 aa, Arabidopsis thaliana
MEDIIIGVVALAAVLLFFLYQKPKTKRYKLPPGPSPLPVIGNLLQLQKLNPQRFFAGWAKKYGPILSYRIGSRTMVVISSAELAKELLKTQDVNFADRPPHRGHEFISYGRRDMALNHYTPYYREIRKMGMNHLFSPTRVATFKHVREEEARRMMDKINKAADKSEVVDISELMLTFTNSVVCRQAFGKKYNEDGEEMKRFIKILYGTQSVLGKIFFSDFFPYCGFLDDLSGLTAYMKECFERQDTYIQEVVNETLDPKRVKPETESMIDLLMGIYKEQPFASEFTVDNVKAVILDIVVAGTDTAAAAVVWGMTYLMKYPQVLKKAQAEVREYMKEKGSTFVTEDDVKNLPYFRALVKETLRIEPVIPLLIPRACIQDTKIAGYDIPAGTTVNVNAWAVSRDEKEWGPNPDEFRPERFLEKEVDFKGTDYEFIPFGSGRRMCPGMRLGAAMLEVPYANLLLSFNFKLPNGMKPDDINMDVMTGLAMHKSQHLKLVPEKVNKY

SEQ ID NO: 805 - protein, 109 aa, Arabidopsis thaliana
MTTAMMIFAVLVTVVEVEAQTECVSKIVPCFRFLNTTTKPSTDCCNSIKEAMEKDFSCLCTIYNTPGLLAQFNITTDQALGLNLRCGVNTDLSACSGTLILQDLRPLQL

SEQ ID NO: 806 - protein, 459 aa, Arabidopsis thaliana
MGSIVEPWAAIAENGNANVTAKGSSRELRHGRTAHNMSSSSLRKKSDLRLVQKVPCKTLKNILSNLQEVILGTKLTLLFLAIPLAILANSYNYGRPLIFGLSLIGLTPLAERVSFLTEQLAFYTGPTVGGLLNATCGNATELIIAILALANNKVAVVKYSLLGSILSNLLLVLGTSLFFGGIANIRREQRFDRKQADVNFFLLLMGLLCHLLPLLLKYAATGEVSTSMINKMSLTLSRTSSIVMLIAYIAYLIFQLWTHRQLFEAQQDDDDAYDDEVSVEETPVIGFWSGFAWLVGMTIVIALLSEYVVDTIEDASDSWGLSVSFISIILLPIVGNAAEHAGAIIFAFKNKLDISLGVALGSATQISLFVVPLSVIVAWILGIKMDLNFNILETSSLALAIIITAFTLQDGTSHYMKGLVLLLCYVIIAACFFVDQIPQPNDLDVGLQPMNNLGEVFSA

SEQ ID NO: 807 - protein, 303 aa, Arabidopsis thaliana
  misc_feature (238)..(238): Xaa can be any naturally occurring amino acid
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNXQQSGWRYVRAHSFCGFAHNVKLCHFIFNILPQKFKTYFYLHFKFVCFIVFFCIYFLLCDDNYLCT

SEQ ID NO: 808 - protein, 124 aa, Arabidopsis thaliana
MQMLRNLSTRTRSRRGGYERVSDDSTFSLLGAKLRRSTSVPYYAPSIRLGGDFPVILEKLPRQKPTKTVVTSKLSHPIFSLFDGYRRHNKKKATAKPEFSRYHEYLKESGMWDLRSNSPVIYFK

SEQ ID NO: 809 - protein, 344 aa, Arabidopsis thaliana
MDNCTGENPMASQLNILRCPFLRNINEPTNLSFSSSLPFPIPARAGKGPIFEDGPNFDTAFRLFHGQDGVVPLSDTARTEAQKPVPVFHPLAAKAATISLSSFGSGGPFGFDAFSDMFKNQKKKSDSSKNKGGNHEAMGDEWLKTGNCPIAKSYRAVSGVAPLVAKILQPPPGMKFKCPQAIVTARAAISKTPFAKNLRPQPLPAKVLVIGMLGMALNVPLGVWREHTEKFSASWFIALHAAVPFIGILRKSVLMPKTAMVFTIAASVLGQVIGSRAERRRLKSVAEKKLTLEVPNPSSVEADQMQFAGVSSDGRCGDKVVMKWNPMMLDVASPVSSGAATVVC

SEQ ID NO: 810 - protein, 90 aa, Arabidopsis thaliana
MALRRVYSEIRGKKVTELPGYIKSTFSMETVKTSVKRGLDNYNEKYIQTSSVDPILHICFYGMAFSYLVALPNERRHLEHQQHAKEHGGH

SEQ ID NO: 811 - protein, 116 aa, Arabidopsis thaliana
MQDSKIPPFSEAKRMKIPTPKQPLTQLPPRIGKKVSNRSKSNQVHAISHQLEMSPNSDSSPGNEYRALRRKYLLLEEDSFALERELKEAEDEVKALEDEKLELLDKLVVMEGLVDP

SEQ ID NO: 812 - protein, 373 aa, Arabidopsis thaliana
MEFGLATSSFLGTQLIPATLFSKRARALSLTVTATGGSRNNKVYTRLDSCLVIPPPPKFKKPRAIVKFLGGAFVGAVPELTYSYLKELLAKEGYLIVSVPYNVTFDHEQAAKQVYERFNSCLDTIVSSGIPNSNLKPGDLADLPLFSVGHSNGALLQVLTGSYFAEKIPKVNAIISFNNKSATEAVPYFEQLGPLIQQMLPMVEASPVYEMARNASGDVLKLLLDTAGTTILNNDQEALKSFTKLVDQLPSVFGEVGQGVSEFRPSPLENRNCFKCSYSVPHTLLVQFNSDAIDETDLLEETLRPRIESIGGTLEKVRLNGNHLTPCIQDPKWQIGTVYTPADAVAQALKTIPLSETRVLSRTIVDWFRRFEN

SEQ ID NO: 813 - protein, 181 aa, Arabidopsis thaliana
MLMVKKEDNDSSHTKQKKTMASLFTPSPTTTSSSGDTIYVAAVPLKAAAGPPQLIMSMAYSLNISNLQHFMVLIKPSSPIRQEVLVFDFQPRNPESIEAAISLLSGNLIPGVVLQRRLKNVPRQRCWMVGPSKGNDAMEMAMEFNKSWETDLRVGFHDCRHYTNELVQHLTGEMQIVERLP

SEQ ID NO: 814 - protein, 257 aa, Arabidopsis thaliana
MRKRERENPCSICGHYHKYEEGEVCGVCGHCMPVSSDTVAPQQVHVSAFPSEILPEFLYLGSYDNASRSELLKTQGISRVLNTVPMCQNLYRNSFTYHGLDNEKVLQFDDAIKFLDQCEKDKARVLVHCMSGKSRSPAVVVAYLMKRKGWRLAESHQWVKQRRPSTDISPEFYQQLQEFEQGIFGSEMMSAMNINDAPTFGFGFPKIDNQAQAPVFNNAPTSSIFSSPASSIPPQEFTFGATPPKPTTGGDIAMDGS

SEQ ID NO: 815 - protein, 54 aa, Arabidopsis thaliana
MFPGMFMRKPDKAEALKQLRTHVALFGSWVVIIRAAPYVLSYFSDSKDELKIDF

SEQ ID NO: 816 - protein, 103 aa, Arabidopsis thaliana
MLYIINTCNLHIYRPMLRKSIHKKSASHDIVRDTVKTEGSSSGEEVKTMRGFYGAGETSSPASSWVPHEGTGIYYPKGQEKVMQDVPPPPAGSHADELVNWFS

SEQ ID NO: 817 - protein, 355 aa, Arabidopsis thaliana
MEMENHRPGSFTYMGRKFSDLSLNDDSSAFSDCNSDRSGEFPTASSESRRLLLSCASENSDDLINHLVSHLDSSYSIDEQKQAAMEIRLLSKNKPENRIKIAKAGAIKPLISLISSSDLQLQEYGVTAILNLSLCDENKESIASSGAIKPLVRALKMGTPTAKENAACALLRLSQIEENKVAIGRSGAIPLLVNLLETGGFRAKKDASTALYSLCSAKENKIRAVQSGIMKPLVELMADFGSNMVDKSAFVMSLLMSVPESKPAIVEEGGVPVLVEIVEVGTQRQKEMAVSILLQLCEESVVYRTMVAREGAIPPLVALSQAGTSRAKQKAEALIELLRQPRSISNGGARSSSQL

SEQ ID NO: 818 - protein, 106 aa, Arabidopsis thaliana
MMMLRQTSRKAYLGLQASPLGLGRRLYHENVIDHFENPRNVGSFNRNDPNVGTGLVGAPACGDLMSLQIKVDDSGQIIDTRFKTFGCGSAIASSSVGMPSNQGFQF

SEQ ID NO: 819 - protein, 165 aa, Arabidopsis thaliana
MTHVEDDKEFKEKPLVQVLSDDDSEVKEAKDGGGEEVTGGDGEGEANVEEEDDEAENEDDDDDDDDDDDDDEDEDDEEGEEDLGTEYLVRPVGEVEDEDDASDFDPEENGLDEEEGDEEIEEDDVDEDISLSAGKSEPLSKRKRVAKDHSEQGDVTGDNIRPSKR

SEQ ID NO: 820 - protein, 271 aa, Arabidopsis thaliana
  misc_feature (81)..(81): Xaa can be any naturally occurring amino acid
MGYAQLVIGPAGSGKSTYCSSLYEHCETIGRTMHVVNLDPAAEIFNYPVAMDIRELISLEDVMEDLKLGPNGALMYCMEYXEDSLHDWADEELENYRDDDYLIFDCPGQIELFTHVPVLKNFVEHLKQKNFNVCVVYLLDSQFITDVTKFISGCMSSLAAMIQLELPHVNILSKMDLLQDKSNIDDYLNPEPRTLLAELNKRMGPQYAKLNKALIEMVGEYGMVNFIPINLRKEKSIQYVLSQIDVCIQFGEDADVNIKDDDDFSDDGPDL

SEQ ID NO: 821 - protein, 318 aa, Arabidopsis thaliana
MAAGGGGGGGGSSSGRTPTWKERENNKKRERRRRAITAKIYSGLRAQGNYKLPKHCDNNEVLKALCLEAGWIVEDDGTTYRKGFKPPASDISGTPTNFSTNSSIQPSPQSSAFPSPAPSYHGSPVSSSFPSPSRYDGNPSSYLLLPFLHNIASSIPANLPPLRISNSAPVTPPLSSPTSRGSKRKLTSEQLPNGGSLHVLRHPLFAISAPSSPTRRAGHQTPPTIPECDESEEDSIEDSGRWINFQSTAPTSPTFNLVQQTSMAIDMKRSDWGMSGMNGRGAEFEFENGTVKPWEGEMIHEVGVEDLELTLGGTKARC

SEQ ID NO: 822 - protein, 300 aa, Arabidopsis thaliana
MVGGVEELSIEQLASSISTYKEQLEQVRQLLSEDPRNSEYADMEKELKEVIALTEEVLATAKQNEISLSDAGVSAEATPGSPDLEGAWEKTGLRNDPIHEGKFPVGTKVQAVFSDDGEWYDATIEAHTANGYFVAYDEWGNKEEVDPDNVRPIEQNAIVEAERLAQATKNALKRKIEKAASSDYQTKTLPAKLKIDPNDPEDVKIAKRKKIHAFKSKARFEQLEVVQNKKQNDWQQFQTTKAKTKKVGFFTGRKKESIFKSPEDPFGKVGVTGSGKGLTDFQKREKHLHLKSGNAEGTDE

SEQ ID NO: 823 - protein, 307 aa, Arabidopsis thaliana
MEDEEGIGLILARATELRLKISDCIDNSSTTVSDNGDGNEDLSPGEGRKSEIIGNQDKDFDSISSEDVDEAEAERLLRIRDALEALESQLASLQNLRQRQQYEKQLALSEIDYSRKMLLEKLKEYKGKDFEVLRETTTFAGERVDYENDLLLPPYPVHPPLSLGLDNNNGYLSHLPSKKKSDANGFGSGHVRNEAEAKSPNGGSGGSSHGVIRFLGSVAKIVLPIIGVISLLSASGYGPEMRKRGASLNLFGLLPHRATRGKRTPNQCPPGKVLVIEDGEARCLVKERVEIPFDSVVAKRDVTYGYG

SEQ ID NO: 824 - protein, 246 aa, Arabidopsis thaliana
MEWEKWYLDAVLVPSALLMMFGYHIYLWYKVRTDPFCTIVGTNSRARRSWVAAIMKDNEKKNILAVQTLRNTIMGGTLMATTCILLCAGLAAVLSSTYSIKKPLNDAVYGAHGDFTVALKYVTILTIFLFAFFSHSLSIRFINQVNILINAPQEPFSDDFGEIGSFVTPEYVSELLEKAFLLNTVGNRLFYMGLPLMLWIFGPVLVFLSSALIIPVLYNLDFVFLLSNKEKGKVDCNGGCDDNFSP

SEQ ID NO: 825 - protein, 592 aa, Arabidopsis thaliana
MEDPDIKRCKLSCVATVDDVIEQVMTYITDPKDRDSASLVCRRWFKIDSETREHVTMALCYTATPDRLSRRFPNLRSLKLKGKPRAAMFNLIPENWGGYVTPWVTEISNNLRQLKSVHFRRMIVSDLDLDRLAKARADDLETLKLDKCSGFTTDGLLSIVTHCRKIKTLLMEESSFSEKDGKWLHELAQHNTSLEVLNFYMTEFAKISPKDLETIARNCRSLVSVKVGDFEILELVGFFKAAANLEEFCGGSLNEDIGMPEKYMNLVFPRKLCRLGLSYMGPNEMPILFPFAAQIRKLDLLYALLETEDHCTLIQKCPNLEVLETRNVIGDRGLEVLAQYCKQLKRLRIERGADEQGMEDEEGLVSQRGLIALAQGCQELEYMAVYVSDITNESLESIGTYLKNLCDFRLVLLDREERITDLPLDNGVRSLLIGCKKLRRFAFYLRQGGLTDLGLSYIGQYSPNVRWMLLGYVGESDEGLMEFSRGCPNLQKLEMRGCCFSERAIAAAVTKLPSLRYLWVQGYRASMTGQDLMQMARPYWNIELIPSRRVPEVNQQGEIREMEHPAHILAYYSLAGQRTDCPTTVRVLKEPI

SEQ ID NO: 826 - protein, 732 aa, Arabidopsis thaliana
MSNQKKRNFQIEAFKHRVVVDPKYADKTWQILERAIHQIYNQDASGLSFEELYRNAYNMVLHKFGEKLYTGFIATMTSHLKEKSKLIEAAQGGSFLEELNKKWNEHNKALEMIRDILMYMDRTYIESTKKTHVHPMGLNLWRDNVVHFTKIHTRLLNTLLDLVQKERIGEVIDRGLMRNVIKMFMDLGESVYQEDFEKPFLDASSEFYKVESQEFIESCDCGDYLKKSEKRLTEEIERVAHYLDAKSEEKITSVVEKEMIANHMQRLVHMENSGLVNMLLNDKYEDLGRMYNLFRRVTNGLVTVRDVMTSHLREMGKQLVTDPEKSKDPVEFVQRLLDERDKYDKIINTAFGNDKTFQNALNSSFEYFINLNARSPEFISLFVDDKLRKGLKGITDVDVEVILDKVMMLFRYLQEKDVFEKYYKQHLAKRLLSGKTVSDDAERSLIVKLKTECGYQFTSKLEGMFTDMKTSEDTMRGFYGSHPELSEGPTLIVQVLTTGSWPTQPAVPCNLPAEVSVLCEKFRSYYLGTHTGRRLSWQTNMGTADIKAIFGKGQKHELNVSTFQMCVLMLFNNSDRLSYKEIEQATEIPAADLKRCLQSLACVKGKNVIKKEPMSKDIGEEDLFVVNDKFTSKFYKVKIGTVVAQKETEPEKQETRQRVEEDRKPQIEAAIVRIMKSRKILDHNNIIAEVTKQLQPRFLANPTEIKKRIESLIERDFLERDSTDRKLYRYLA

SEQ ID NO: 827 - protein, 428 aa, Arabidopsis thaliana
MMTSRSIVPQQSTDDVVVVDGKNVAKGRNRQVLGDIGNVVRGNYPKNNEPEKINHRPRTRSQNPTLLVEDNLKKPVVKRNAVPKPKKVAGNPKVVDVIEISSDSDEELGLVAAREKKATKKKATTYTSVLTARSKAACGLEKKQKEKIVDIDSADVENDLAAVEYVEDIYSFYKSVESEWRPRDYMASQPDINEKMRLILVEWLIDVHVRFELNPETFYLTVNILDRFLSVKPVPRKELQLVGLSALLMSAKYEEIWPPQVEDLVDIADHAYSHKQILVMEKTILSTLEWYLTVPTHYVFLARFIKASIADEKMENMVHYLAELGVMHYDTMIMFSPSMVAASAIYAARSSLRQVPIWTSTLKHHTGYSETQLMDCAKLLAYQQWKQQEEGSESSTKGALRKKYSKDERFAVALIPPAKALLTGTESA

SEQ ID NO: 828 - protein, 742 aa, Arabidopsis thaliana
MAKKDSVLEAGWSVMEAGVAKLQKILEEVPDEPPFDPVQRMQLYTTVHNLCTQKPPNDYSQQIYDRYGGVYVDYNKQTVLPAIREKHGEYMLRELVKRWANQKILVRWLSHFFEYLDRFYTRRGSHPTLSAVGFISFRDLVYQELQSKAKDAVLALIHKEREGEQIDRALLKNVIDVYCGNGMGELVKYEEDFESFLLEDSASYYSRNASRWNQENSCPDYMIKAEESLRLEKERVTNYLHSTTEPKLVAKVQNELLVVVAKQLIENEHSGCRALLRDDKMDDLARMYRLYHPIPQGLDPVADLFKQHITVEGSALIKQATEAATDKAASTSGLKVQDQVLIRQLIDLHDKFMVYVDECFQKHSLFHKALKEAFEVFCNKTVAGVSSAEILATYCDNILKTGGGIEKLENEDLELTLEKVVKLLVYISDKDLFAEFFRKKQARRLLFDRNGNDYHERSLLTKFKELLGAQFTSKMEGMLTDMTLAKEHQTNFVEFLSVNKTKKLGMDFTVTVLTTGFWPSYKTTDLNLPIEMVNCVEAFKAYYGTKTNSRRLSWIYSLGTCQLAGKFDKKTIEIVVTTYQAAVLLLFNNTERLSYTEILEQLNLGHEDLARLLHSLSCLKYKILIKEPMSRNISNTDTFEFNSKFTDKMRRIRVPLPPMDERKKIVEDVDKDRRYAIDAALVRIMKSRKVLGHQQLVSECVEHLSKMFKPDIKMIKKRIEDLISRDYLERDTDNPNTFKYLA

SEQ ID NO: 829 - protein, 607 aa, Arabidopsis thaliana
MEEVTRSVLAEEILKRLDLENLCSVACVSTTLRSAVVSGVLPSLTSLDLSVFSPDDETLNHVLRGCIGLSSLTLNCLRLNAASVRGVLGPHLRELHLLRCSLLSSTVLTYIGTLCPNLRVLTLEMADLDSPDVFQSNLTQMLNGCPYLESLQLNIRGILVDATAFQSVRFSLPETLKALRLQPLLESEAILLMNRFKVTGTYLSQPDYNSALLSPSPSFTLQSLSLVLDLISDRLIIAITGSLPQLVKLDLEDRPEKEPFPDNDLTYTGLQALGFCQQLTSLSLVRTCYNRKISFKRINDMGIFLLSEACKGLESVRLGGFPKVSDAGFASLLHSCRNLKKFEVRGAFLLSDLAFHDVTGSSCSLQEVRLSTCPLITSEAVKKLGLCGNLEVLDLGSCKSISDSCLNSVSALRKLTSLNLAGADVTDSGMLALGKSDVPITQLSLRGCRRVSDRGISYLLNNEGTISKTLSTLDLGHMPGISDRAIHTITHCCKALTELSIRSCFHVTDSSIESLATWERQAEGGSKQLRKLNVHNCVSLTTGALRWLSKPSFAGLHWLGMGQTRFAGRKETVTAMICGQRPWLTLCFDGCELGCSDGWEFHTPQRH

SEQ ID NO: 830 - protein, 656 aa, Arabidopsis thaliana
MSLLLKMLLFSLFFFYMASISQCSDPTGGQFSFNGYLYTDGVADLNPDGLFKLITSKTQGGAGQVLYQFPLQFKNSPNGTVSSFSTTFVFAIVAVRKTIAGCGLSFNISPTKGLNSVPNIDHSNHSVSVGFHTAKSDKPDGEDVNLVGINIDSSKMDRNCSAGYYKDDGRLVNLDIASGKPIQVWIEYNNSTKQLDVTMHSIKISKPKIPLLSMRKDLSPYLHEYMYIGFTSVGSPTSSHYILGWSFNNKGAVSDINLSRLPKVPDEDQERSLSSKILAISLSISGVTLVIVLILGVMLFLKRKKFLEVIEDWEVQFGPHKFTYKDLFIATKGFKNSEVLGKGGFGKVFKGILPLSSIPIAVKKISHDSRQGMREFLAEIATIGRLRHPDLVRLLGYCRRKGELYLVYDFMPKGSLDKFLYNQPNQILDWSQRFNIIKDVASGLCYLHQQWVQVIIHRDIKPANILLDENMNAKLGDFGLAKLCDHGIDSQTSNVAGTFGYISPELSRTGKSSTSSDVFAFGVFMLEITCGRRPIGPRGSPSEMVLTDWVLDCWDSGDILQVVDEKLGHRYLAEQVTLVLKLGLLCSHPVAATRPSMSSVIQFLDGVATLPHNLLDLVNSRIINEGFDTLGVTTESMEASSNVSLVMTESFLSSGR

SEQ ID NO: 831 - protein, 790 aa, Arabidopsis thaliana
MPCTTYLPLLLLLFLLPPPSVQSKVIIKGNQTILSFKAIFRLGFFSTTNGSSNWYLGISYASMPTPTHVWVANRIRPVSDPDSSTLELTSTGYLIVSNLRDGVVWQTDNKQPGTDFRFSETGNLILINDDGSPVWQSFDNPTDTWLPGMNVTGLTAMTSWRSLFDPSPGFYSLRLSPSFNEFQLVYKGTTPYWSTGNWTGEAFVGVPEMTIPYIYRFHFVNPYTPTASFWYIVPPLDSVSEPRLTRFMVGANGQLKQYTWDPQTQSWNMFWLQPEDPCRVYNLCGQLGFCSSELLKPCACIRGFRPRNDAAWRSDDYSDGCRRENGDSGEKSDTFEAVGDLRYDGDVKMSRLQVSKSSCAKTCLGNSSCVGFYHKEKSNLCKILLESPNNLKNSSSWTGVSEDVLYIREPKKGNSKGNISKSIIILCSVVGSISVLGFTLLVPLILLKRSRKRKKTRKQDEDGFAVLNLKVFSFKELQSATNGFSDKVGHGGFGAVFKGTLPGSSTFVAVKRLERPGSGESEFRAEVCTIGNIQHVNLVRLRGFCSENLHRLLVYDYMPQGSLSSYLSRTSPKLLSWETRFRIALGTAKGIAYLHEGCRDCIIHCDIKPENILLDSDYNAKVSDFGLAKLLGRDFSRVLATMRGTWGYVAPEWISGLPITTKADVYSFGMTLLELIGAREIIQGNVDSVVDSRLNGEYNTEEVTRMATVAIWCIQDNEEIRPAMGTVVKMLEGVVEVTVPPPPKLIQALVSGDSYRGVSGTSCSEGHGCSDLNTGLSSPGSRSSFGRPSP

SEQ ID NO: 832 - protein, 443 aa, Arabidopsis thaliana
MMVFVVFVMCRYKILEELGDGTCGSVYKAVNLETYEVVAVKKMKRKFYYWEECVNLREVKALRKLNHPHIIKLKEIVREHNELFFIFECMDHNLYHIMKERERPFSEGEIRSFMSQMLQGLAHMHKNGYFHRDLKPENLLVTNNILKIADFGLAREVASMPPYTEYVSTRWYRAPEVLLQSSLYTPAVDMWAVGAILAELYALTPLFPGESEIDQLYKICCVLGKPDWTTFPEAKSISRIMSISHTEFPQTRIADLLPNAAPEAIDLINRLCSWDPLKRPTADEALNHPFFSMATQASYPIHDLELRLDNMAALPNLELNLWDFNREPEECFLGLTLAVKPSAPKLEMLRNVSQDMSENFLFCPGVNNDREPSVFWSLLSPDENGLHAPVESSPLSLSFSPMQQHTVGPPQSSGFTMTSSMQPNMLDRPWMAVSAPFQQSHYL

SEQ ID NO: 833 - protein, 606 aa, Arabidopsis thaliana [sequence omitted]

SEQ ID NO: 834 - protein, 607 aa, Arabidopsis thaliana
MDTKIGSIDDCKPTNGDVCSPTNGTVATIHNSVPSSAITINYCDATLGRHLARRLVQAGVTDVFSVPGDFNLTLLDHLMAEPDLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLDDAHEQIDKAISTALKESKPVYISVSCNLAAIPHHTFSRDPVPFSLAPRLSNKMGLEAAVEATLEFLNKAVKPVMVGGPKLRVAKACDAFVELADASGYALAMMPSAKGFVPEHHPHFIGTYWGAVSTPFCSEIVESADAYIFAGPIFNDYSSVGYSLLLKKEKAIVVQPDRITVANGPTFGCILMSDFFRELSKRVKRNETAYENYHRIFVPEGKPLKCESREPLRVNTMFQHIQKMLSSETAVIAETGDSWFNCQKLKLPKGCGYEFQMQYGSIGWSVGATLGYAQASPEKRVLAFIGDGSFQVTVQDISTMLRNGQKTIIFLINNGGYTIEVEIHDGPYNVIKNWNYTGLVDAIHNGEGNCWTAKVRYEEELVEAITTATTEKKDCLCFIEVILHKDDTSKELLEWGSRVSAANSRPPNPQ

SEQ ID NO: 835 - protein, 483 aa, Arabidopsis thaliana
MIARRIWRSHRFLRPFSSSSVCSPPFRVPEYLSQSSSSPASRPFFVHPPTLMKWGGGSRSWFSNEAMATDSNSGLIDVPLAQTGEGIAECELLKWFVKEGDSVEEFQPLCEVQSDKATIEITSRFKGKVALISHSPGDIIKVGETLVRLAVEDSQDSLLTTDSSEIVTLGGSKQGTENLLGALSTPAVRNLAKDLGIDINVITGTGKDGRVLKEDVLRFSDQKGFVTDSVSSEHAVIGGDSVSTKASSNFEDKTVPLRGFSRAMVKTMTMATSVPHFHFVEEINCDSLVELKQFFKENNTDSTIKHTFLPTLIKSLSMALTKYPFVNSCFNAESLEIILKGSHNIGVAMATEHGLVVPNIKNVQSLSLLEITKELSRLQHLAANNKLNPEDVTGGTITLSNIGAIGGKFGSPLLNLPEVAIIALGRIEKVPKFSKEGTVYPASIMMVNIAADHRVLDGATVARFCCQWKEYVEKPELLMLQMR

SEQ ID NO: 836 - protein, 496 aa, Arabidopsis thaliana
MGLPGKNKGAVLSKIATNNQHGENSEYFDGWKAYDKDPFHLSRNPHGIIQMGLAENQLCLDLIKDWVKENPEASICTLEGIHQFSDIANFQDYHGLKKFRQAIAHFMGKARGGRVTFDPERVVMSGGATGANETIMFCLADPGDVFLIPSPYYAAFDRDLRWRTGVEIIPVPCSSSDNFKLTVDAAEWAYKKAQESNKKVKGLILTNPSNPLGTMLDKDTLTNLVRFVTRKNIHLVVDEIYAATVFAGGDFVSVAEVVNDVDISEVNVDLIHIVYSLSKDMGLPGFRVGIVYSFNDSVVSCARKMSSFGLVSSQTQLMLASMLSDDQFVDNFLMESSRRLGIRHKVFTTGIKKADIACLTSNAGLFAWMDLRHLLRDRNSFESEIELWHIIIDRVKLNVSPGSSFRCTEPGWFRICFANMDDDTLHVALGRIQDFVSKNKNKIVEKASENDQVIQNKSAKKLKWTQTNLRLSFRRLYEDGLSSPGIMSPHSPLLRA

SEQ ID NO: 837 - protein, 507 aa, Arabidopsis thaliana
MAMASLARRKAYFLTRNISNSPTDAFRFSFSLTRGFASSGSDDNDVVIIGGGPGGYVAAIKAAQLGLKTTCIEKRGALGGTCLNVGCIPSKALLHSSHMYHEAKHVFANHGVKVSSVEVDLPAMLAQKDTAVKNLTRGVEGLFKKNKVNYVKGYGKFLSPSEVSVDTIDGENVVVKGKHIIVATGSDVKSLPGITIDEKKIVSSTGALSLTEIPKKLIVIGAGYIGLEMGSVWGRLGSEVTVVEFAADIVPAMDGEIRKQFQRSLEKQKMKFMLKTKVVGVDSSGDGVKLIVEPAEGGEQTTLEADVVLVSAGRTPFTSGLDLEKIGVETDKGGRILVNERFSTNVSGVYAIGDVIPGPMLAHKAEEDGVACVEFIAGKHGHVDYDKVPGVVYTYPEVASVGKTEEQLKKEGVSYNVGKFPFMANSRAKAIDTAEGMVKILADKETDKILGVHIMSPNAGELIHEAVLAINYDASSEDIARVCHAHPTMSEAIKEAAMATYDKPIHM

SEQ ID NO: 838 - protein, 646 aa, Arabidopsis thaliana
  misc_feature (222)..(222): Xaa can be any naturally occurring amino acid
MISLTPSLFLNKTVVPGCSTRLSLRQPRTIITPPASLRVFSSLGSNQDPTGSVLIETTATSSSSLETSAADIVPKSTVSGGVQDVYGEDAATEDMPITPWSLSVASGYTLLRDPHHNKGLAFSHRERDAHYLRGLLPPTVISQDLQVKKIMHTLRQYQVPLQKYMAMMDLQETNERLFYKLLIDHVEELLPVIYTPTVGEACQKYGSIFLRPQGLFISLKEXGKIHEVLRNWPEKNIQVIVVTDGERILGLGDLGCQGMGIPVGKLSLYTALGGVRPSACLPVTIDVGTNNEKLLNDEFYIGLRQRRATGEEYSELMHEFMTAVKQNYGEKVVIQFEDFANHNAFDLLAKYGTTHLVFNDDIQGTASVVLAGLIAALRFVGGSLSDHRFLFLGAGEAGTGIAELIALEISKKSHIPLEEARKNIWLVDSKGLIVSSRKESIQHFKKPWAHDHEPIRELVDAVKAIKPTVLIGTSGVGQTFTQDVVETMAKLNEKPIILSLSNPTSQSECTAEEAYTWSQGRAIFASGSPFAPVEYEGKTFVPGQANNAYIFPGFGLGLIMSGTIRVHDDMLLAASEALAEELMEEHYEKGMIYPPFRNIRKISARIAAKVAAKAYELGLATRLPQPKELEQCAESSMYSPSYRSYR

SEQ ID NO: 839 - protein, 227 aa, Arabidopsis thaliana
MVGVSPKIAPSMLSSDFANLAAEAKRMIDLGANWLHMDIMDGHFVSNLTIGAPVIESLRKHTNAYLDCHLMVTNPMDYVDQMAKAGASGFTFHVEVAQENWQELVKKIKAAGMRPGVALKPGTPVEQVYPLVEGTNPVEMVLVMTVEPGFGGQKFMPSMMDKVRALRNKYPTLDIEVDGGLGPSTIDAAAAAGANCIVAGSSVFGAPKPGDVISLLRASVEKAQPST

SEQ ID NO: 840 - protein, 423 aa, Arabidopsis thaliana
MTSLHTLLFSSLLFFIVFPTFTFSSTLLFQSFNWESWKKEGGFYNSLHNSIDDIANAGITHLWLPPPSQSVAPEGYLPGKLYDLNSSKYGSEAELKSLIKALNQKGIKALADIVINHRTAERKDDKCGYCYFEGGTSDDRLDWDPSFVCRNDPKFPGTGNLDTGGDFDGAPDIDHLNPRVQKELSEWMNWLKTEIGFHGWRFDYVRGYASSITKLYVQNTSPDFAVGEKWDDMKYGGDGKLDYDQNEHRSGLKQWIEEAGGGVLTAFDFTTKGILQSAVKGELWRLKDSQGKPPGMIGIMPGNAVTFIDNHDTFRTWVFPSDKVLLGYVYILTHPGTPCIFYNHYIEWGLKESISKLVAIRNKNGIGSTSSVTIKAAEADLYLAMIDDKVIMKIGPKQDVGTLVPSNFALAYSGLDFAVWEKK

SEQ ID NO: 841 - protein, 358 aa, Arabidopsis thaliana
MSAFVSKYEDELIKTAKYIATPGRGILAADESTETIGKRFAGINVENTESNRQAYRELLFTSPGSYPCLSGVILFEETLYQKTSDGKPFVDLLMENGVIPGIKVDKGLVDLAGTNGETTTQGLDSLGARCQQYYEAGARFAKWRAFFKIGATEPSVLSIQEDARVLARYAIICQENGLVPIVEPEVLTGGSHDIKKCAAVTETVLAAVFKALNYHHVLLEGTLLKPNMVTPGSDSPKVAPELIAEYTVTALRRTVPPAIPGIVFLSGIQREEQATLNLNAMNKLDVLKPWTLTFSFGGALQQSAIKAWAGKPENVAKAQAKFLTRCKANKDATLGKYTGWASGDSAAFENLVVIGYRY

SEQ ID NO: 842 - protein, 198 aa, Arabidopsis thaliana
MATDDVNEPLPAAAELPATEAEKQPHKLERKWSFWFDNQSKKGAAWGASLRKAYTFDTVEDFWGLHETIFQTSKLTANAEIHLFKAGVEPKWEDPECANGGKWTWVVTANRKEALDKGWLETLMALIGEQFDEADEICGVVASVRPQSKQDKLSLWTRTKSNEAVLMGIGKKWKEILDVTDKITFNNHDDSRRSRFTV

SEQ ID NO: 843 - protein, 343 aa, Arabidopsis thaliana
MERYEIVKDIGSGNFGVAKLVRDKFSKELFAVKFIERGQKIDEHVQREIMNHRSLIHPNIIRFKEVLLTATHLALVMEYAAGGELFGRICSAGRFSEDEARFFFQQLISGVNYCHSLQICHRDLKLENTLLDGSEAPRVKICDFGYSKSGVLHSQPKTTVGTPAYIAPEVLSTKEYDGKIADVWSCGVTLYVMLVGAYPFEDPSDPKDFRKTIGRILKAQYAIPDYVRVSDECRHLLSRIFVANPEKRITIEEIKNHSWFLKNLPVEMYEGSLMMNGPSTQTVEEIVWIIEEARKPITVATGLAGAGGSGGSSNGAIGSSSMDLDDLDTDFDDIDTADLLSPL

SEQ ID NO: 844 - protein, 956 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKEKKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTTNEGEWISMNGSTGEVILGKQALAPPALSPDLETFMSWADAIRRLKVMANADTPEDAIAVRKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 845 - protein, 513 aa, Arabidopsis thaliana
MEALNSILTGYAVAALSVYALWFYFLSRRLTGPKVLPFVGSLPYLIANRSRIHDWIADNLRATGGTYQTCTMVIPFVAKAQGFYTVTCHPKNVEHILKTRFDNYPKGPMWRAAFHDLLGQGIFNSDGDTWLMQRKTAALEFTTRTLRQAMARWVNGTIKNRLWLILDRAVQNNKPVDLQDLFLRLTFDNICGLTFGKDPETLSLDLPDNPFSVAFDTATEATLKRLLYTGFLWRIQKAMGIGSEDKLKKSLEVVETYMNDAIDARKNSPSDDLLSRFLKKRDVNGNVLPTDVLQRIALNFVLAGRDTSSVALSWFFWLVMNNREVETKIVNELSMVLKETRGNDQEKWTEEPLEFDEADRLVYLKAALAETLRLYPSVPQDFKYVVDDDVLPDGTFVPRGSTVTYSIYSIGRMKTIWGEDCLEFRPERWLTADGERFETPKDGYKFVAFNAGPRTCLGKDLAYNQMKSVASAVLLRYRVFPVPGHRVEQKMSLTLFMKNGLRVYLQPRGEVLA

SEQ ID NO: 846 - protein, 614 aa, Arabidopsis thaliana
MSGPVDRFAIPCFEGILSSDEKKERKSDFENSEDERRTRIGSLKKKAINASTKFKHSLKKKRRKSDVRVSSVSIEDVRDVEELQAVDEFRQALVMEELLPHKHDDYHMMLRFLKARKFDIEKAKHMWADMIQWRKEFGTDTIIQDFQFEEIDEVLKYYPHGYHSVDKEGRPVYIERLGKVDPNKLMQVTTLDRYIRYHVKEFERSFMLKFPACTIAAKKYIDSSTTILDVQGVGLKNFTKSARELITRLQKIDGDNYPETLHQMFIINAGPGFRLLWSTVKSFLDPKTTSKIHVLGCKYQSKLLEIIDSSELPEFLGGACTCADQGGCMLSDKGPWKNPEIVKMVLHGGAHRAKQVVKVLNSDGKVIAYAKPSYPWIKGSDTSTAESGSEAEDIVVSPKAVKSYSHLRLTPVREEAKVGSGETSFAGSFAGYDEYVPMVDKAVDATWKVKPTAINRAPSKGAHMPPNVPKDHESFSARVLVTFMAFVMAILTFFRTVSNRVVTKQLPPPPSQPQIEGSAAAEEADLLNSVLKKLTELEEKIGALQSKPSEMPYEKEELLNAAVCRVDALEAELIATKKALYEALMRQEELLAYIDRQEAAQHQKKNKRKQMFCF

SEQ ID NO: 847 - protein, 107 aa, Arabidopsis thaliana
MSHSHGNASSVNDPRQPSAAKPYIPRPVAPEDLPVDYSGFIAVILGVSGVMFRYKICSWLAIIFCAQSLANMRNLENDLKQISMAMMFAIMGLVTNYLGPNRPATKK

SEQ ID NO: 848 - protein, 543 aa, Arabidopsis thaliana
MAVSSAFVGCPKLETLLNHHNLSPSSSSSSSVSQTPLGLNGVRVLPKNNRTRRGLIQKARCVLSASSDSASNAASISALEQLKNSAADRYTKERSSIVVIGLSIHTAPVEMREKLAIPEAEWPRAIAELCGLNHIEEAAVLSTCNRMEIYVLALSQHRGVKEVTEWMSNTSGIPVSEICQHRFLLYNKDATQHIFEVSAGLDSLVLGEGQILAQVKQVVKVGQGVNGFGRNISGLFKHAITVGKRVRTETNIASGAVSVSSAAVELALMKLPQSSNVSARMCVIGAGKMGLLVIKHLMAKGCTKVVVVNRSEERVSAIREEMPGIEIIYRPLDEMLACASEADVVFTSTASETPLFLKEHVENLPQASPEVGGLRHFVDISVPRNVGSCVGEVETARVYNVDDLKEVVAANKEDRMRKAMEAQTIITEESTQFEAWRDSLETVPTIKKLRAYAERIRVAELEKCMSKMGDDINKKTTRAVDDLSRGIVNRFLHGPMQHLRCDGSDSRTLSETLENMHALNRMYGLEKDILEEKLKAMAEQQHK

SEQ ID NO: 849 - protein, 224 aa, Arabidopsis thaliana
MGRPDQTPSPRMNNNFNPVFHAQSEQPVDEKRVLQAEQIYPNNGGVVNQPNQVPMRPGPPTYINQSATFNQPYGVSMAGPVHTQPSNWTSGLFDCMNDGENALITCCFPFVTFGQIAEVIDEGATSCGTAGMLYGLICCLFAIPCVYTCTFRTKLRSKYGLPDAPAPDWITHCFCEYCALCQEYRELKNRGLDPSIGWIGNVQKQRMGQQQEMMAPPMGQRMMG

SEQ ID NO: 850 - protein, 242 aa, Arabidopsis thaliana
MAGEDSREAQRGDEYEESSPLLKVNENDGKICSKRDAKAAPLVPPPAAEEYGWTADGLPVSHGSVIGEPIRRNQWNSGLFTCLGRNDEFCSSDLEVCLLGSVAPCVLYGTNAERLGSAPGTFSNHCLTYLGLYFVGNSLFGWNCLAPWFSYSSRSAIRRKFNLEGSFEAMNRSCGCCGGCIEDEMQREHLETTCDFVTHVLCHTCALCQEGRELRRKVLHPGFNAQSTVVVMPPIEQTMGRK

SEQ ID NO: 851 - protein, 253 aa, Arabidopsis thaliana
MPTRNIAIGGVQEEVYHPNALRAALAEFISTLIFVFAGSGSGIAFNKITDNGATTPSGLVAAALAHAFGLFVAVSVGANISGGHVNPAVTFGVLLGGNITLLRGILYWIAQLLGSVAACFLLSFATGGEPIPAFGLSAGVGSLNALVFEIVMTFGLVYTVYATAVDPKNGSLGTIAPIAIGFIVGANILAGGAFSGASMNPAVAFGPAVVSWTWTNHWVYWAGPLIGGGLAGIIYDFVFIDENAHEQLPTTDY

SEQ ID NO: 852 - protein, 421 aa, Arabidopsis thaliana
MARAACSSVVTAMALLPSKSLLCRNQLLFSGNSKFVGVLTLQKRCFSSKVSMSLKAGIVGLPNVGKSTLFNAVVENGKAQAANFPFCTIEPNVGIVAVPDSRLQVLSKLSGSQKTVPASIEFVDIAGLVKGASQGEGLGNKFLSHIREVDSILQVVRCFEDNDIIHVNGKVDPKSDIDVINLELIFCDLDQIGKRIERLKKGKAKDSQSKVKEEAEKSALERIQEALLEGKPARSVALSDLEMEVVKHLCLLTMKPMIYVANVAETDLAEPEKNAYVEEVKGLSSDLQSGHVVVSAQVESELTELPLEERTEYLNSLGVSESGLGNLIRATYSLLGLQTYFTSGEKETRAWTIHAGMTAPQAAGVIHSDFEKGFIRAETVAYEDFVTAGSIAAAREKGLLRSEGKEYIVKEGDVMLFRFNV

SEQ ID NO: 853 - protein, 487 aa, Arabidopsis thaliana [sequence omitted]

SEQ ID NO: 854 - protein, 320 aa, Arabidopsis thaliana
MGNPGSDTERNKGNVVSSVFDPALSRFVGFSQKLQTRLKSQLKNLTDDKHGIGSSWRQDKGNSSISMQIDLEKQLDCWRENPSWTDQIPVVKVGIPKGSLCNLKAEVNVGLPPDAVYNIVIDPDNRRVFKNIKEVMSRKVLVDDGLRQVVEVEQAALWRFLWWSGTISVHVLVDQDRADHSMKFKQVKSGFMKRFEGSWQVKPLFVDEHMCDRLKPKTLEEYNRCTGGKGRIGSKVTLDQLIQPAIVPPPPISWYLRGITAKTTEMLIHDLLAETARIRAAGVMEDGHSPDEQRIGTPGDIKERWSAHRRTSRRRRNDLC

SEQ ID NO: 855 - protein, 448 aa, Arabidopsis thaliana
MVRKKVPEWLNSTMWSTPPPPSSYDDGLLRHSPVTKMKEEAESISVAPRLNSAPPPSSNTSVPSPSHRPRNGNSISGGSGEYGHSVGPSAEDFSRQAHVSAELSKKVINMKELRSLALQSLPDSPGIRSTVWKLLLGYLPPERSLWSTELKQKRSQYKHYKDELLTSPSEITWKMVRSKGFDNYDLKSESRCMLARSRITDEDHPLSLGKASIWNTYFQDTETIEQIDRDVKRTHPDIPFFSGESSFARSNQESMKNILLVFAKLNQGIRYVQGMNEILAPIFYVFRNDPDEDSSSHAEADAFFCFVELLSGFRDFYCQQLDNSVVGIRSAITRLSQLVRKHDEELWRHLEITTKVNPQFYAFRWITLLLTQEFSFFDSLHIWDALLSDPEGPLESLLGICCAMLVLVRRRLIAGDFTSNMKLLQHYPTTNISHLLYVANKLRSKMLV

SEQ ID NO: 856 - protein, 546 aa, Arabidopsis thaliana
MGFQRSISSSSALKWLGFVTAVWVQSISGNNYTFSNYSGALKSLMNLNQLELNNLSVAKDVGKAFGILAGLASDRLPTPVILLIGCFEGLLGYGVQWLVVSRTIQPIPYWQMCIFLCMGGNSTTWMNTAVLVTCIRNFRRNRGPVSGILKGYVGLSTAIFTDLCTALFSNDPASFLVLLAVVPFAVCLTAVFFLREIPPASSAAEENEETRYFTIFNIVAVVVAVYLQSYDIIGIKTGVFSVAFASILLFLLASPIAIPFHSFIKSLNYGEQDDLEGRIQEPLLRSEIAAAEKEVIVVAAVAAEEEEKKRKKPVLGEDHTIMEAVLTVDFWVLFVSFLCGVGTGLAVMNNMGQIGLALGYTNVSIFVSMTSIWGFFGRILSGTLSEYFLKKAGTPRPLWNAASQILMAVGYILMALAVPNSLYIGSMVVGVCYGVRLAITVPTASELFGLKYYGLIYNILVLNLPLGSFLFSGLLAGFLYDAEATPTPGGGNTCVGAHCYRLIFIVMALASVIGVGLDLVLAYRTKEIYAKIHASKKSKKSGGSLS

SEQ ID NO: 857 - protein, 442 aa, Arabidopsis thaliana
MSSSSDTHAGESRHRRNPIRWLLGFGFFVQGFRGFPWLGANFFLTEQLRVNPSVLQLLQNSANLPMVAKPIYGVVSDSVYFFGQHRIPYIAVGALLQAISWLAIAFLSRSNVSILALSIYLLLSNLGASLVEVANDAIVAESGKQKTSETQSGELPSFVWMVSSLGGILGNLLGGIAIKTFSAQSTFLVFGILALLQFLVTINIREKSLNLPENPSPAGGIRKHLSDLSHVLRKPEISYSIAWIAVSTAVVPVLTGTMFFYQTKFLKIDASLLGISKVFGQIAMLLWGFAYNRWLKAMRPRKLLTAIQVTIAFFVISDLLFVKGVYRDLGVSDSVYVLFFSGFLETLFYFKILPFTVLMARLCPPGCEGSLMAFVMSAIALAFIVSGYLGIVLASFVGVTEDDFSGFTRGLAIEACCVGIPLILTSWIYDEAETKEKSKKIE

SEQ ID NO: 858 - protein, 714 aa, Arabidopsis thaliana
MRKGVLNPDRDRQIVEHELQETGFSPETEKVKNKNFEEDEEEEDESVEKIFESREVPSWKKQLTVRAFVVSFMLSILFSFIVMKLNLTTGIIPSLNVSAGLLGFFFVKTWTKMLHRSGLLKQPFTRQENTVIQTCVVASSGIAFSGGFGTYLFGMSERIATQSGDVSRGVKDPSLGWIIGFLFVVSFLGLFSVVPLRKIMVIDFKLTYPSGTATAHLINSFHTPQGAKLAKKQVRVLGKFFSLSFFWSFFQWFFTGGENCGFSNFPTFGLKAYQYKFYFDFSATYVGVGMICPYIINISVLLGGILSWGIMWPLIETKKGDWFPDNVPSSSMHGLQAYKVFIAVAIILGDGLYNFCKVLSRTLSGLFVQLRGPTTSISRTSFTLEEDPHASPLSPKQSYDDQRRTRFFLKDQIPTWFAVGGYITIAATSTAILPHMFHQLRWYYILVIYICAPVLAFCNAYGAGLTDWSLASTYGKLAIFTIGAWAGSEHGGMLAGLAACGVMMNIVSTASDLTQDFKTGYLTLSSPKSMFVSQVIGTAMGCVVSPCVFWLFYKAFDDLGLPNTEYPAPFATVYRSMAKLGVEGVASLPRECLVLCYAFFGVAILVNIVKDSLHSNWGRFIPLPMAMAIPFFLGPYFAIDMCVGSLILFIWERVDAAKAEAFGTAVASGLICGDGIWSLPSSVLAIAGVNPPVCMKFLSSATNSKVDNFLKGSI

SEQ ID NO: 859 - protein, 497 aa, Arabidopsis thaliana
MDLQRGFVFLSLVLSFMIIETTAYRERQLLLLQPPQETAIDTANAVVTVQDRGLKTRRPEHKNAYATMMYMGTPRDYEFYVATRVLIRSLRSLHVEADLVVIASLDVPLRWVQTLEEEDGAKVVRVENVDNPYRRQTNFNSRFKLTLNKLYAWALSDYDRVVMLDADNLFLKKADELFQCGRFCAVFINPCIFHTGLFVLQPSVEVFKDMLHELQVGRKNPDGADQGFLVSYFSDLLDQPLFSPPSNGSVLNGHLRLPLGYQMDASYFYLKLRWNIPCGPNSVITFPGAVWLKPWYWWSWPVLPLGFSWHEQRRATIGYSAEMPLVIIQAMFYLGIIVVTRLARPNITKLCYRRSDRNLTTIQAGFKLIALLSVVAAYIFPFFTIPHTIHPLIGWSLYLMASFALSSISINTLLLPTLPVLTPWLGILGTLLVMAFPWYPDGVVRALSVFAYAFCCAPFVWVSFRKITSHLQVLIEKEVLFPRLGDSGVTSGFSKLY

SEQ ID NO: 860 - protein, 362 aa, Arabidopsis thaliana
MPLTKLVPDAFGVVTICLVALLVLLGLLCIAYSFYFQSHVRKQGYIQLGYFSGPWIIRITFILFAIWWAVGEIFRLSLLRRHRRLLSGLDLRWQENVCKWYIVSNLGFAEPCLFLTLMFLLRAPLKMESGALSGKWNRDTAGYIILYCLPMLALQLAVVLSESRLNGGSGSYVKLPHDFTRTYSRVIIDHDEVALCTYPLLSTILLGVFAAVLTAYLFWLGRQILKLVINKRLQKRVYTLIFSVSSFLPLRIVMLCLSVLTAADKIIFEALSFLAFLSLFCFCVVSICLLVYFPVSDSMALRGLRDTDDEDTAVTEERSGALLLAPNSSQTDEGLSLRGRRDSGSSTQERYVELSLFLEAEN

SEQ ID NO: 861 - protein, 342 aa, Arabidopsis thaliana
MAVHYWTALFLLLPCLFCISNASAGDADPDYRTCVSECEISGCVGQLCFPQCNSSSDGGPWYIQEPLYLQWKKWGCQGDCRYQCMVNRETERETLGQAPVKYHGKWPFKRVLGIQEPASVAFSVLNLAMHFHGWLSFFIMIYYKLPLKQDRTAYYEYVGLWHIYGLLSMNSWFWSAVFHSRDVDLTERLDYSSAVAILGFSLILAILRTFDIRVEAARVMVSAPILAFVTTHILYINFYKLDYGWNMIVCVAMGVSQLFLWARWAAVSSHPSNWKLWVVVIAGGLAMLLEIYDFPPYEGYFDAHSIWHAATIPLTILWWSFIRDDAEFRTSSLLKKTKTKAK

SEQ ID NO: 862 - protein, 293 aa, Arabidopsis thaliana
MALRRAITKRLIDCYRSDVTQQHSFFRQLSPYNMKIHRQYMTSPNGPNLTDRIVGIRIESVSPPRREETPVMGLSVSETKKLLRLYQMEKVKERLREIPKSSVSYWEFIQICCESCGNDEQGSQMAKSLDHSGCVVVLGDIVFLHPHQIAKSMEAMIKQTSVLPNDPRKEELVQLATTKKSIDIEARRIVQAELYCGLGFLAVQTIGFMRLTFWELSWDVMEPICFFVTTIHFILGYIFFLRTSTEPSFEGLFRQRFKTKQKKLMERHGFDFLRYNELNSLFTTFPCKFHYPV

SEQ ID NO: 863 - protein, 154 aa, Arabidopsis thaliana
MKNVMLIIDESNASYDLLIWALENQKDTIESSKVYIFAKQPQNSFTPPTVLSSSVGFAQIFYPFSPNSELIRLAQEKNMKIALGILEKAKKICLNHGIKAETFTDDGDPKDLIRKIIQERNINLIVTSDQQSLKKCTQNTDCSLLVVKKRLRKD

SEQ ID NO: 864 - protein, 674 aa, Arabidopsis thaliana
MLLHCNVSYYTSTFSFISSSLRRQDNADDSQDTVIRRRHNARSISLYIRHNRDLKLNKNPNESQETFVPPPPPPRRDLDGENRSKLLELSLVTRRTPQFPGSIYAQSASDADIASSLPSLRNFLGSDGDDDGESEREMIVKALEIRRKVTKEIIKESLVRKGRFGITYATNVTDRLGDFVDHVMIQAAALKRLPEFSESRFNLRARTVIEDSNFVPLVRWLKHHELSYNRIAKIICMSKGNLDSIRIMIEWLKSIHVKGEFIAVAFLRSGDNILQRNREELNEIVEYLESNGVRRDWMGYVVGRCPELLSFSMEEVKSRVDFFLKMGMNQNDFGTMVYDYPKIIGFFSFQVMEKKVLKALFNTPALRLSFKFIIVLLVLNQINYLKEFGLSTEEVGRLLAYKPHLMGCSIEERWKPLVKYFYYLGIPKEGMKRILVVKPILYCIDLEKTIAPKVVELRYNVRFLQEMGIPNEAIGNMLVKFPSLLTNSLYKKIRPVVIFLLTRAGVTQKDIGKVIAMDPALLGCSIGTKLEPNMRYYISLGIRFYQLGEMIADFPMLLRYNVDNLRPKYRYLRRTMIRPLQDLIEFPRFFSYSLERRIIPRHTIMVENRVNFKLRYMLACTDEEFERRVRDKVERRERFEAGLDSEDSQPSDENISDQEIAFSDEAEEEEDLTE

SEQ ID NO: 865 - protein, 446 aa, Arabidopsis thaliana
MASIPPPELDNDSLASSPRSEYDSQPRVRFMCTFGGRILPRPPDNQLCYVGGDNRMVAVHRHTTFASLLSKLAKLSGKSNISVKYQLPNEDLDALISVSTDEDVENMMDEYDRVAQNQNPRASRLRLFLFTKNVAGEEDNDSRASSISSLLDSSVNREQWFLDALNLGSSAAATAVSNGGSGRVFERVRSEVSSIVSEVPDYLFGLDNFDETAPPHELRDRDPRAKIQREVSTLSDPGSPRRDVPSPYGSTSSAPVMRISTPELPPPVFIKPESPEPVSTPKSNPQPEQVMQQSNLPVNSQWQYAPGPGQQVHYQGHTIHQSPVYYVPGSVPGNHMVQQGNHMVQPGNHMVQPVQMPGQYLQQYHHVPMGYHQPQTHQMAGPGQVYGGTVRPVMMAVDGMNRTGYYGMKTPGPVQMYQHHTGMVVPGVEEQQQYRTETDSDTGRAS

SEQ ID NO: 866 - protein, 513 aa, Arabidopsis thaliana
MEKFSYNSYPDSTDSSPRSREIEFDNPPPPWDDQNQNQQQHSYKVKFMCSYGGKIQPRPHDNQLTYVNGETKILSVDRGIRFPVLASKLSTVCGGGDGGGGEVTFKYQLPGEDLDALISVTNDDDLEHMMHEYDRLLRLSSKPARMRLFLFPASSGFGSQSSTQSDRDRFVEALNTVPRLSESEKSVTAPPNNADFLFGSEKVAAPPPPPPAEVKLPVPVALEPPLFNDPRVIQPDHVVNPMEIQRQMQEFQRMHIRDQEQQQQQEAVYRRKSNEDGLIETGGGYFSPPYIQNPAPPPPQQTIPQTNPQAPPMTTFWQGNHNPGVVFPTTTHGLGLPEQPVYMIPSPSPSPVYHAPPPPQPQGVIRPILTGQVNQGGYYPQVQRVASDTYREPHQSPYNVAQPLQAPIGTKAAQQQQPPPPQPFTSGPPPPQYTAVPPPRQVVGLPDTSAYTQVTYTGGMGKQVYYTEAPPPQYHGVGLPVTGMSELRTGPDGKLVAMNMAPKVSSQSSDSAV

SEQ ID NO: 867 - protein, 779 aa, Arabidopsis thaliana
MAFHVACPITCRRICHCSLGFSRDLRGANAKHKFLKEVIRVEEFLKDPAVSSNVFIGGTVQVRVPKVVPAPQTVSILGVGDGAIGSGVDELAEEASAQKKRVALQRQAAVTVEAAEDYARRFESGVNDLTSNDHAGEELGHSGMNIMCRMCFLGEGEGSDRARRMLSCKDCGKKYHKNCLKSWAQHRDLFHWSSWSCPSCRVCEVCRRTGDPNKFMFCKRCDAAYHCYCQHPPHKNVSSGPYLCPKHTRCHSCDSTVPGNGLSVRWFLSYTCCDACGRLFVKGNYCPVCLKVYRDSESTPMVCCDICQRWVHCHCDGISDDKYMQFQVDGKLQYKCATCRGECYQVKDLQDAVQELWKKKDVVDKELIASLRAAAGLPTEEEIFSIFPFSDDEENGPVSGRSLKFSIKGLVEKSPKKSKEYGKHSSSKKHASKKGSHTKLEPEVHQEIGSERRRLGGVRIDNVGFQINEQSDVNSSVAGICSTHEPKIVKHKRVDDVMVTDEEKPSRIVRIKCSKPHDSDSEDTLRNAGEEKSVKAKKLVINLGARKINVSGSSKSNVVSHLSRDKDQSTLGGDKVDQTGEVRTLKISGRFGKTQSEGSKATFGSVTQFPAASTSEGNHVDDKTSISPALQKEARPLLKFKLRKPNSGDQTSSVTTQSEDEKLSSAKGQRSKRKRPSSLVDMASLKEDGEATTHSHQDNSRNDEMMDANWILKKLGKDSIGKRVEVHGSQNSWRKGTVTDVSGDTSTLSVSLDDGSIKTFELGKHSVRFIPQKQKRSRS

SEQ ID NO: 868 - protein, 126 aa, Arabidopsis thaliana
MSNTPAAAASSSSKSKAAGTSQPQEKRKTLFQKELQHMMYGFGDEQNPLPESVALVEDIVVEYVTDLTHKAQEIGSKRGRLLVDDFLYLIRKDLPKLNRCRELLAMQEELKQARKAFDVDEKELVD

SEQ ID NO: 869 - protein, 278 aa, Arabidopsis thaliana
MSGEVWRWNKQAEMNSIRDCLKHCNSIAIDTEFPGCLKETPMDASDEIRYRDMKFNVDNTHLIQLGLTLFGKGITKTWEINLSDFNESKSLKNDKSIAFLKNNGLDLDKIREEGIGIEEFFMEFSQILNEKHGKMRWVTFQGSYDKAYLLKGLTRKPLPETSKEFDETVQQLLGRFVYDVKKMAGLCSGLSSRFGLQRIADVLQMRRVGKAHHAGSDSELTARVFTKLIFDLVNSRKESTGRRADDQQYQLEQQQHQQQLMMTRCYIPIPVQGRNYVL

SEQ ID NO: 870 - protein, 572 aa, Arabidopsis thaliana
MAAGRNIRYPDHELRDQESNSRFSRRDSAYANEDYNHVRNGAIDNGKGRVSNLRHGDRDRIKSGARQEENKMVSSGFRLSKSNPGSREVFIDLGPKRCGFSARSVDREPGELSSESGSDDLIESESLAKVNGVVKEVENRAQSPVEKKRKFSPIVWDRDDHERSNLSRNEKPVEVTPLPPPPPLVKRSSQSPSVSCGGNSHYSPAKSDMHQDPVEVGVSAVSMPALSPSVEMSSLCVVEQSSNAEQDDKQEHATHLEEDENMPTRHISSSRWAAGNSSPTDEVEIVEEVGEKKRRKKPFPVQGRFRNTSQTPEVGELVREGYRSSDSDERGHHSLPGSRDDFEERDAVKSDKMEIDEEEHRRENSVDSLSETDSDDEYVRHETPEPASTPLRSINMLQGCRSVDEFERLNKIDEGTYGVVYRAKDKKTGEIVALKKVKMEKEREGFPLTSLREINILLSFHHPSIVDVKEVVVGSSLDSIFMVMEYMEHDLKALMETMKQRFSQSEVKCLMLQLLEGVKYLHDNWVLHRDLKTSNLLLNNRGELKICDFGLARQYGSPLKPYTHLVVTLWYR

SEQ ID NO: 871 - protein, 435 aa, Arabidopsis thaliana
MPEIEIAAGSGDNNDALFGKYELGKLLGCGAFAKVFHARDRRTGQSVAVKILNKKKLLTNPALANNIKREISIMRRLSHPNIVKLHEVMATKSKIFFAMEFVKGGELFNKISKHGRLSEDLSRRYFQQLISAVGYCHARGVYHRDLKPENLLIDENGNLKVSDFGLSALTDQIRPDGLLHTLCGTPAYVAPEILSKKGYEGAKVDVWSCGIVLFVLVAGYLPFNDPNVMNMYKKIYKGEYRFPRWMSPDLKRFVSRLLDINPETRITIDEILKDPWFVRGGFKQIKFHDDEIEDQKVESSLEAVKSLNAFDLISYSSGLDLSGLFAGCSNSSGESERFLSEKSPEMLAEEVEGFAREENLRMKKKKKEEYGFEMEGQNGKFGIGICISRLNDLLVVVEARRRGGDGDCYKEMWNGKLRVQLIRVCDQTSSTNAAI

SEQ ID NO: 872 - protein, 513 aa, Arabidopsis thaliana
MAAAAFGQLNLEEPPPIWGSRSVDCFEKLEQIGEGTYGQVYMAKEIKTGEIVALKKIRMDNEREGFPITAIREIKILKKLHHENVIHLKEIVTSPGRDRDDQGKPDNNKYKGGIYMVFEYMDHDLTGLADRPGLRFTVPQIKCYMKQLLTGLHYCHVNQVLHRDIKGSNLLIDNEGNLKLADFGLARSYSHDHTGNLTNRVITLWYRPPELLLGATKYGPAIDMWSVGCIFAELLNGKPILPGKTENEQLNKIYELCGSPDESNWPGVSKMPWYNQMKSSRPLKRRVREIYRHFDRHALELLEKMLVLDPSQRICAKDALDAEYFWTDPLPCDPKSLPTYESSHEFQTKKKRQQMRHNEEAAKKQKLQHPQQQHSRLPPQQHGVGQSHAAPLWPAGPNHPMNNNAPPPQIPAGGHYYGGKPRGGAPVPNRYPPSGNQTGGYNNQSRGGYSSGAYPPQGRGAPYGAGPRGPSGGYGVGPPNYSQGGGQYGGSGGSGRGQNPMGGARNQQYGWQP

SEQ ID NO: 873 - protein, 475 aa, Arabidopsis thaliana
MKLRLRHHETRETLKLELADADTLHDLRRRINPTVPSSVHLSLNRKDELITPSPEDTLRSLGLISGDLIYFSLEAGESSNWKLRDSETVASQSESNQTSVHDSIGFAEVDVVPDQAKSNPNTSVEDPEGDISGMEGPEPMDVEQLDMELAAAGSKRLSEPFFLKNILLEKSGDTSELTTLALSVHAVMLESGFVLLNHGSDKFNFSKELLTVSLRYTLPELIKSKDTNTIESVSVKFQNLGPVVVVYGTVGGSSGRVHMNLDKRRFVPVIDLVMDTSTSDEEGSSSIYREVFMFWRMVKDRLVIPLLIGICDKAGLEPPPCLMRLPTELKLKILELLPGVSIGNMACVCTEMRYLASDNDLWKQKCLEEVNNFVVTEAGDSVNWKARFATFWRQKQLAAASDTFWRQNQLGRRNISTGRSGIRFPRIIGDPPFTWFNGDRMHGSIGIHPGQSARGLGRRTWGQLFTPRCNLGGLN

SEQ ID NO: 874 - protein, 374 aa, Arabidopsis thaliana
MESSPVNCLPPDSLHQIFSSLPIRDIMICRSVCKFFNQLLTSQCFIEIISTRPPLNLLALRPPHHHHSHRHSGNGHATNIRPYIHVYDPEQNQWFRFNLDFLPFRSPQPVASSSGLIYLWGDSIDLAESSKSLVACNPLTRQFKVLPQLGSAWSRHGTVLVDSVNRVMVLTELAALYYSGTVVANQWLKFSSNLPSKPRSPVLMSSSVFALCDVGSPWRSQWKLFSCKLTNLTITHTNWVCLEKHEWGDIFDIIKRPRLLRGNGDSKLLMIGGLKSTFSLNPACSTILILRLDLESLEWEEAGRMPLEMYRGFQESSKFKVFGGGDRVYFSAKRMGKLAMWDCWQGWRWIEGVPGYADGLCRGFVFDAKLTLMP

SEQ ID NO: 875 - protein, 475 aa, Arabidopsis thaliana
MGSVMSLSCSKRKATSQDVECSSESRKRRKISSENDEEECCRLIPSLPDELSIQILARLPRICYSSVRLVSRRWRSAVSTSEVYSLRKELGRTEEWLYVLTKGHEDKLLWYALDPVSTKWQRLPPMPVVVYEEESRKSLSGLWNMITPSFNVGAIVRSFLGRRDSSEQMPFCGCAIGAVDGGLYVIGGLSRSKTVSCVWRFDPILNSWSEVSSMLASRAYSKTGVLNKKLYVVGGVDRGRGGLSPLQSAEVYDPSTDAWSEVPSMPFSKAQVLPNAFLADLLKPIATGMTCYNGRLCVPQSLYSWPFFVDVGGEVYDPETNLWVEMPSGMGEGWPARQAGTKLSVVVDGELYAFDPSSSMENGKIKVYDQKEDTWKVVIGEVPVYDLTDSESPYLLAGFHGKLHFITRDPNHNVTVLRADVPNIPVSSSSSSSSSVSIPHLKTNAPNKSDTVTWKLIATKDFGAAELVSCQVIDI

SEQ ID NO: 876 - protein, 648 aa, Arabidopsis thaliana
MEDELEGLRAHFPVSFGKTSKVSASTEAIHSATRRTDVANDAGVSSDITTKKPDSDKSGFPSLSSSSQTWLRSVRGPNRNPNSSGDVAMGPPPPPSSKRTQEEEEEDEEVMMGPPPPPKGLGNINDSDDEGDMIGPPPPPPAARDSDEDSDDDDDNDNEENRYQIPLSNEIQLKGHTKIVSSLAVDSAGARVLSGSYDYTVRMYDFQGMNSRLQSFRQIEPSEGHQVRSVSWSPTSGQFLCVTGSAQAKIFDRDGLTLGEFMKGDMYIRDLKNTKGHICGLTCGEWHPRTKETVLTSSEDGSLRIWDVNNFLSQTQVIKPKLARPGRVPVTTCAWDRDGKRIAGGVGDGSIQIWSLKPGWGSRPDIYVGKAHTDDITSVKFSSDGRILLSRSFDGSLKVWDLRQMKEALKVFEGLPNYYPQTNVAFSPDEQIILTGTSVEKDSTTGGLLCFYDRTKLEIVQKVGISPTSSVVQCAWHPRLNQIFATSGDKSQGGTHILYDPSQSERGACVCVARAPRKKSVDDYQPEPVIHNPHALPLFRDAPSRKREREKALKDPMKSHKPEIPMTGPGHGGRVGTTGSGLLTQYLLKQGGMIKETWMEEDPREAILKYAEVAVKDPKFIAPAYSQTQPKTIFAKSDDEEEEGDTKK

SEQ ID NO: 877 - protein, 539 aa, Arabidopsis thaliana
MEFECQERLEAANDQRSESGLLNTDLRIGNDGSVEIPNVKLCCQKKKGTLVPSGSKQLLSDKDLSTTIIDLPQALISEILNCLDPKELGLVSCVSTYLHRLASEHHAWKEFYRERWGLPVVFGAASSGLSDERSWKDLFVEREFRSRTFLGRYSIDTLYGHTEAVRTVFLLASAKLVFTSGYDSIVRMWDMEEGLSIAASKPLGCTIRALAADTKLLVAGGTDGFIHCWKSLDGLRNLFDLTGFQKEKTEFRLWGHEGPITSLALDMTSIFSGSWDMSVRIWDRSSMKCVKTLRHSDWVWGLAPHETTLASTSGSDVYIWDVSSETPLAIIPDAHEGTTYSLARSHTGDFLFTGGEDGGIKMFEIRRYGSETSVVLISQWMPHTSPVYSLSFEFPWLVSASGDGKLALIDVRKLLKTNRCAYSKRISSSTVEPPQRMLHGFGSNLFSVDVGYDRIVCGGEEGTVRIWNFTQALEIERRTRALKGMRHENRMRRRRMQMEMNAKNGRPDQCSIAAHKNPINGERNRAWHSKRRASGKAKA

SEQ ID NO: 878 - protein, 794 aa, Arabidopsis thaliana
MVHSESSILSSLRGGDGGGIPCSKDELAINGSYTDPMGRRKSKRFKVAAESEFSPDFGSITRQLRSRRMQKEFTVETYETRNVSDVCVLSSQADVELIPGEIVAERDSFKSVDCNDMSVGLTEGAESLGVNMQEPMKDRNMPENTSEQNMVEVHPPSISLPEEDMMGSVCRKSITGTKELHGRTISVGRDLSPNMGSKFSKNGKTAKRSISVEEENLVLEKSDSGDHLGPSPEVLELEKSEVWIITDKGVVMPSPVKPSEKRNGDYGEGSMRKNSERVALDKKRLASKFRLSNGGLPSCSSSGDSARYKVKETMRLFHETCKKIMQEEEARPRKRDGGNFKVVCEASKILKSKGKNLYSGTQIIGTVPGVEVGDEFQYRMELNLLGIHRPSQSGIDYMKDDGGELVATSIVSSGGYNDVLDNSDVLIYTGQGGNVGKKKNNEPPKDQQLVTGNLALKNSINKKNPVRVIRGIKNTTLQSSVVAKNYVYDGLYLVEEYWEETGSHGKLVFKFKLRRIPGQPELPWKEVAKSKKSEFRDGLCNVDITEGKETLPICAVNNLDDEKPPPFIYTAKMIYPDWCRPIPPKSCGCTNGCSKSKNCACIVKNGGKIPYYDGAIVEIKPLVYECGPHCKCPPSCNMRVSQHGIKIKLEIFKTESRGWGVRSLESIPIGSFICEYAGELLEDKQAESLTGKDEYLFDLGDEDDPFTINAAQKGNIGRFINHSCSPNLYAQDVLYDHEEIRIPHIMFFALDNIPPLQELSYDYNYKIDQVYDSNGNIKKKFCYCGSAECSGRLY

SEQ ID NO: 879 - protein, 349 aa, Arabidopsis thaliana
MVAVRRRRTQASNPRSEPPQHMSDHDSDSDWDTVCEECSSGKQPAKLLLCDKCDKGFHLFCLRPILVSVPKGSWFCPSCSKHQIPKSFPLIQTKIIDFFRIKRSPDSSQISSSSDSIGKKRKKTSLVMSKKKRRLLPYNPSNDPQRRLEQMASLATALRASNTKFSNELTYVSGKAPRSANQAAFEKGGMQVLSKEGVETLALCKKMMDLGECPPLMVVFDPYEGFTVEADRFIKDWTIITEYVGDVDYLSNREDDYDGDSMMTLLHASDPSQCLVICPDRRSNIARFISGINNHSPEGRKKQNLKCVRFNINGEARVLLVANRDISKGERLYYDYNGYEHEYPTEHFV

SEQ ID NO: 880 - protein, 488 aa, Arabidopsis thaliana
MELDSENKLLKTGLVIVATLVIAKLIFSFFTSDSKKKRLPPTLKAWPPLVGSLIKFLKGPIIMLREEYPKLGSVFTVNLVHKKITFLIGPEVSAHFFKASESDLSQQEVYQFNVPTFGPGVVFDVDYSVRQEQFRFFTEALRVNKLKGYVDMMVTEAEDYFSKWGESGEVDIKVELERLIILTASRCLLGREVRDQLFDDVSALFHDLDNGMLPISVLFPYLPIPAHRRRDRAREKLSEIFAKIIGSRKRSGKTENDMLQCFIESKYKDGRQTTESEVTGLLIAALFAGQHTSSITSTWTGAYLMRYKEYFSAALDEQKNLIAKHGDKIDHDILSEMDVLYRCIKEALRLHPPLIMLMRASHSDFSVTARDGKTYDIPKGHIVATSPAFANRLPHIFKDPDTYDPERFSPGREEDKAAGAFSYIAFGGGRHGCLGEPFAYLQIKAIWSHLLRNFELELVSPFPEIDWNAMVVGVKGNVMVRYKRRQLS

SEQ ID NO: 881 - protein, 198 aa, Arabidopsis thaliana
MNPEQKQRECIVCREKEPSFIHTVIKTGAFRRLCTDCLLKEYREHFCSVCFNLFDNAVPPQARIICVNCPSSTHLSCSTQPPSSSAASSSSSAPPPASSFTCQPCSNPNFTFFPKSRVNEDVPDETPLTPKSAMALVAAGNISVANMNKAVALLKEEALKKIIAAKTAKLRAKGALTNLQDIVIRQSKVTGKRKEDER

SEQ ID NO: 882 - protein, 685 aa, Arabidopsis thaliana
METESDDATITVVKDMRVRLENRIRTQHDAHLDLLSSLQSIVPDIVPSLDLSLKLISSFTNRPFVATPPLPEPKVEKKHHPIVKLGTQLQQLHGHDSKSMLVDSNQRDAEADGSSGSPMALVRAMVAECLLQRVPFSPTDSSTVLRKLENDQNARPAEKAALRDLGGECGPILAVETALKSMAEENGSVELEEFEVSGKPRIMVLAIDRTRLLKELPESFQGNNESNRVVETPNSIENATVSGGGFGVSGSGNFPRPEMWGGDPNMGFRPMMNAPRGMQMMGMHHPMGIMGRPPPFPLPLPLPVPSNQKLRSEEEDLKDVEALLSKKSFKEKQQSRTGEELLDLIHRPTAKEAATAAKFKSKGGSQVKYYCRYLTKEDCRLQSGSHIACNKRHFRRLIASHTDVSLGDCSFLDTCRHMKTCKYVHYELDMADAMMAGPDKALKPLRADYCSEAELGEAQWINCDIRSFRMDILGTFGVVMADPPWDIHMELPYGTMADDEMRTLNVPSLQTDGLIFLWVTGRAMELGRECLELWGYKRVEEIIWVKTNQLQRIIRTGRTGHWLNHSKEHCLVGIKGNPEVNRNIDTDVIVAEVRETSRKPDEMYAMLERIMPRARKLELFARMHNAHAGWLSLGNQLNGVRLINEGLRARFKASYPEIDVQPPSPPRASAMETDNEPMAIDSITA

SEQ ID NO: 883 - protein, 305 aa, Arabidopsis thaliana
MKGLTRLLNSLSRHTASVTCSPSSSSLLISRRSLFISAATHFPVNFSESITTNASRNCSRSSSFPFNWIAEQRRTMFIQTQSTPNPSSLMFSPGKPVMEIGSADFPNSRSAMSSPLAKAIFAIDGIPRLLLQHTIVSSSYNPCFVTKIVSVDAGVVRVFYGSDFVTVTKSDDVTWDILKPDIFAVVMDFYSSGQPLFLDSQATAAKDTAIHEDDSETVAMIKELLETRIRPSVQDDGGDIEYCGFDTETGIVKLRMQGACSGCPSSSVTLKSGIENMLMHYVSEVKGVEQEFDGEEEGTSSGPME

SEQ ID NO: 884 - protein, 543 aa, Arabidopsis thaliana
LINQTNNQNTVRYFSLKPKMETASSNFSLSQILNIEEPYSSVMLGVAALLAVVCYFWIQGKSKSKNGPPLPPGPWPLPIVGNLPFLNSDVLHTQFQALTLKHGPLMKIHLGSKLAIVVSSPDMAREVLKTHDITFANHDLPEVGKINTYGGEDILWSPYGTHWRRLRKLCVMKMFTTPTLEASYSTRREETRQTIVHMSEMAREGSPVNLGEQIFLSIFNVVTRMMWGATVEGDERTSLGNELKTLISDISDIEGIQNYSDFFPLFSRFDFQGLVKQMKGHVKKLDLLFDRVMESHVKMVGKKSEEEEDFLQYLLRVKDDDEKAPLSMTHVKSLLMDMVLGGVDTSVNASEFAMAEIVSRPEVLNKIRLELDQVVGKDNIVEESHLPKLPYLQAVMKETLRLHPTLPLLVPHRNSETSVVAGYTVPKDSKIFINVWAIHRDPKNWDEPNEFKPERFLENSLDFNGGDFKYLPFGSGRRICAAINMAERLVLFNIASLLHSFDWKAPQGQKFEVEEKFGLVLKLKSPLVAIPVPRLSDPKLYTA

SEQ ID NO: 885 - protein, 440 aa, Arabidopsis thaliana
MAEDMAADEVTAPPRKVLIISAGASHSVALLSGDIVCSWGRGEDGQLGHGDAEDRPSPTQLSALDGHQIVSVTCGADHTVAYSQSGMEVYSWGWGDFGRLGHGNSSDLFTPLPIKALHGIRIKQIACGDSHCLAVTMEGEVQSWGRNQNGQLGLGDTEDSLVPQKIQAFEGIRIKMVAAGAEHTAAVTEDGDLYGWGWGRYGNLGLGDRTDRLVPERVTSTGGEKMSMVACGWRHTISVSYSGALYTYGWSKYGQLGHGDLEDHLIPHKLEALSNSFISQISGGWRHTMALTSDGKLYGWGWNKFGQVGVGNNLDQCSPVQVRFPDDQKVVQVSCGWRHTLAVTERNNVFAWGRGTNGQLGIGESVDRNFPKIIEALSVDGASGQHIESSNIDPSSGKSWVSPAERYAVVPDETGLTDGSSKGNGGDISVPQTDVKRVRI

SEQ ID NO: 886 - protein, 463 aa, Arabidopsis thaliana
MEGVAMKLPSFPNAISIGHRSFSRVRCSSSLSVCSAAAASSATISTDSESVSLGHRVRKDFRILHQEVNGSKLVYLDSAATSQKPAAVLDALQNYYEFYNSNVHRGIHYLSAKATDEFELARKKVARFINASDSREIVFTRNATEAINLVAYSWGLSNLKPGDEVILTVAEHHSCIVPWQIVSQKTGAVLKFVTLNEDEVPDINKLRELISPKTKLVAVHHVSNVLASSLPIEEIVVWAHDVGAKVLVDACQSVPHMVVDVQKLNADFLVASSHKMCGPTGIGFLYGKSDLLHSMPPFLGGGEMISDVFLDHSTYAEPPSRFEAGTPAIGEAIALGAAVDYLSGIGMPKIHEYEVEIGKYLYEKLSSLPDVRIYGPRPSESVHRGALCSFNVEGLHPTDLATFLDQQHGVAIRSGHHCAQPLHRYLGVNASARASLYFYNTKDDVDAFIVALADTVSFFNSFK

SEQ ID NO: 887 - protein, 209 aa, Arabidopsis thaliana
LISALDVIAQGQGGQGDIPVVNPTAPGGSTTTPTITQPSPPSLTFPGPTTPTGGYPPLDGTTPTGGYPPLYGTTPPGGGDVGGGGGGYGGGTPGGGGGGGGDTGAGAGGGGYGGGGDTGAGGGVGSGQWCIAKANASPTSLQVALDYACGYGGADCGQIQQGAACYEPNTIRDHASFAFNSYYQKHPGSDSCNFGGAAQLTSTDPSKTS

SEQ ID NO: 888 - protein, 483 aa, Arabidopsis thaliana
MADLLRKVKSIKKKQDQSNHQALILGKYEMGRLLGHGTFAKVYLARNAQSGESVAIKVIDKEKVLKSGLIAHIKREISILRRVRHPNIVQLFEVMATKSKIYFVMEYVKGGELFNKVAKGRLKEEMARKYFQQLISAVSFCHFRGVYHRDLKPENLLLDENGNLKVSDFGLSAVSDQIRQDGLFHTFCGTPAYVAPEVLARKGYDGAKVDIWSCGVILFVLMAGFLPFHDRNVMAMYKKIYRGDFRCPRWFPVEINRLLIRMLETKPERRFTMPDIMETSWFKKGFKHIKFYVEDDHQLCNVADDDEIESIESVSGRSSTVSEPEDFESFDGRRRGGSMPRPASLNAFDLISFSPGFDLSGLFEDDGEGSRFVSGAPVGQIISKLEEIARIVSFTVRKKDCKVSLEGSREGSMKGPLSIAAEIFELTPALVVVEVKKKGGDKMEYDEFCNKELKPKLQNLSSENGQRVSGSRSLPSFLLSDTD

SEQ ID NO: 889 - protein, 355 aa, Arabidopsis thaliana
MSECGCFSATTMLRICVVLIICLHMCCASSDCTSHDDPVSQDEAEKATKLKLGSIALLLVAGGVGVSLPLIGKRIPALQPENDIFFMVKAFAAGVILCTGFVHILPDAFERLSSPCLEDTTAGKFPFAGFVAMLSAMGTLMIDTFATGYYKRQHFSNNHGSKQVNVVVDEEEHAGHVHIHTHASHGHTHGSTELIRRRIVSQVLEIGIVVHSVIIGISLGASQSIDTIKPLMAALSFHQFFEGLGLGGCISLADMKSKSTVLMATFFSVTAPLGIGIGLGMSSGLGYRKESKEAIMVEGMLNAASAGILIYMSLVDLLATDFMNPRLQSNLWLHLAAYLSLVLGAGSMSLLAIWA

SEQ ID NO: 890 - protein, 370 aa, Arabidopsis thaliana
MNTGGGQYTDFPAVETHGGQFISYDIFGSLFEITSKYRPPIIPIGRGAYGIVCSVLDTETNELVAMKKIANAFDNHMDAKRTLREIKLLRHLDHENIIAIRDVVPPPLRRQFSDVYISTELMDTDLHQIIRSNQSLSEEHCQYFLYQLLRGLKYIHSANIIHRDLKPSNLLLNANCDLKICDFGLARPTSENDFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNPMAIDLVDRMLTFDPNRRITVEQALNHQYLAKLHDPNDEPICQKPFSFEFEQQPLDEEQIKEMIYQEAIALNPTYG

SEQ ID NO: 891 - protein, 350 aa, Arabidopsis thaliana
MENGDIPEDANEHCPGPQSESAGKSDSCAGCPNQEACATAPKGPDPDLVAIAERMSTVKHKILVLSGKGGVGKSTFSAQLSFALAGMDHQVGLMDIDICGPSIPKMLGLEGQEIHQSNLGWSPVYVEDNLGVMSIGFMLPNSDEAVIWRGPRKNGLIKQFLKDVYWGEIDYLVVDAPPGTSDEHISIVQYLLPTGIDGAIIVTTPQEVSLIDVRKEVSFCKKVGVPVLGVVENMSGLSQPLKDVKFMKLATETGSSINVTEDVIACLRKNAPELLDIVACSEVFDSSGGGAERMCREMGVPFLGKVPMDPQLCKAAEQGKSCFEDNKCLISAPALKSIIQKVVPSTVMTE

SEQ ID NO: 892 - protein, 312 aa, Arabidopsis thaliana
MGEMIVSMDQDIRLDTTRARLSNLLKRHRELSDRLTRDSDKTMLDRLNKEFEAARRSQSQEVFLDGEEWNDGLLATLRERVHMEADRKADNGNAGFSLVCHPEERITYRVGNKVICCLDGSRIGIQFETSTAGETYEVYHCVLESKSFLEKMIVLEHTIPFFLPLSDLENDLLFSNAKKFIDNVGDLLQAYVDRKEQVRLIKELFGHQISEIYHSLPYHMIEFSMDDCDCKFVVSLRYGDLLCELPTKVRILVWPMHHLSKKQCTSPGSPAIPVRLPFAEDAFRIQSLPEAYAEIMPNMPNEIRQLFQTSPS

SEQ ID NO: 893 - protein, 93 aa, Arabidopsis thaliana
MAFLLNTSISSHLRSSSQKTDGALAQSRRGFHVELGAREKALLAEDASLRRFKSHKKGVHRLKRIGDVLTVVVVAGCCYEIYARVMRKEAQAA

SEQ ID NO: 894 - protein, 234 aa, Arabidopsis thaliana
MPGPVIEEVNEEALMDAIKEQMKLQQKENDVVVEDVKDGDEDDDDVDDDDDEIADGMFLESCCGFVIESICFESGLGAGENEASKQSRSEKKSRKAMLKLGMKPVTDVSRVTIKRSKNVLFVISKPDVFKSPNSETYVIFGEAKIDDMSSQLQAQAAQRFKMPDVASMIPNTDGSEAATVAQEEEDDEDVDETGVEAKDIDLVMTQAGVSRPKAVKALKESNGDIVSAIMELTT

SEQ ID NO: 895 - protein, 793 aa, Arabidopsis thaliana
MGRSRVQVNKAHKTRFSSKSSRNLHRTNLQDSGRIGKSDSNYVKGAKAARVQRGKMLREQKRAAVLKEKRASGGINSAPRVIVLFPLSASVELNSLGEDVLKLLSSDGSGIASSTVASSEYKLRATVLKAPHGDLLTCMEMAKVADLMAFVASASAPWEENSSNFIDSFGSQCLSVFRSIGLPSTTVLIRDLPSDVKKKNEMKKMCASQLASEFPEDCKFYPADTRDELHKFMWLFKAQRLTVPHWRSQRSYIVARKAGMLVDDESSGKCTLLLSGYLRARKLSVNQLVHVSGVGDFQFSKIEVLKDPFPLNERKNQNSMELDDSHDEEVLKSLVPDPMKQEPLVIENTPDPLAGEQTWPTEEEMAEADKNQKQGRLKKKTLPRGTSEYQAAWIVDETDEEDSDNGDSDDNGMVLDRGEDSNQEGMYDQEFEDDGKSLNLRDIDTETQNESEMVDDEDLTEEQIKDEIKKIKEAYADDEEFPDEVETPIDVPARRRFAKYRGLKSFRTSSWDPNESLPQDYARIFAFDNVARTQKLVLKQALKMEEEDRDDCVPIGSYVRLHIKEVPLGAASKLSSLVNTTKPIIGFGLLQHESKMSVLHFSVKKYDGYEAPIKTKEELMFHVGFRQFIARPVFATDNFSSDKHKMERFLHPGCFSLASIYGPISFPPLPLVVLKISEGSDPPAIAALGSLKSVEPNKIILKKIILTGYPQRVSKMKASVRYMFHNPEDVKWFKPVEVWSKCGRRGRVKEPVGTHGAMKCIFNGVVQQHDVVCMNLYKRAYPKWPERLYPQLL

SEQ ID NO: 896 - protein, 515 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGADMKSNGSGEAPSLISLLGRINMEEGEGGELNHKT

SEQ ID NO: 897 - protein, 484 aa, Arabidopsis thaliana
MCFNNIETGDEVETERQVFGSSEEDEFRVEDTARNTNNVQISQQQQQPLAHVVKWERYLPVRSLKVLLVENDDSTRHIVTALLKNCSYEVTAVPDVLEAWRILEDEKSCIDLVLTEVDMPVHSGTGLLSKIMSHKTLKNIPVIMMSSHDSMVLVFKCLSNGAVDFLVKPIRKNELKNLWQHVWRRCHSSSGSGSESGIHDKKSVKPESTQGSENDASISDEHRNESGSSGGLSNQDGGSDNGSGTQSSWTKRASDTKSTSPSNQFPDAPNKKGTYENGCAHVNRLKEAEDQKEQIGTGSQTGMSMSKKAEEPGDLEKNAKYSVQALERNNDDTLNRSSGNSQVESKAPSSNREDLQSLEQTLKKTREDRDYKVGDRSVLRHSNLSAFSKYNNGATSAKKAPEENVESCSPHDSPIAKLLGSSSSSDNPLKQQSSGSDRWAQREAALMKFRLKRKERCFEKKVRYHSRKKLAEQRPHVKGQFIRK

SEQ ID NO: 898 - protein, 326 aa, Arabidopsis thaliana
MLFSGSAIPLSSFCSLPEKPHTLPMKLSPAAIRSSSSSAPGSLNFDLRTYWTTLITEINQKLDEAIPVKHPAGIYEAMRYSVLAQGAKRAPPVMCVAACELFGGDRLAAFPTACALEMVHAASLIHDDLPCMDDDPVRRGKPSNHTVYGSGMAILAGDALFPLAFQHIVSHTPPDLVPRATILRLITEIARTVGSTGMAAGQYVDLEGGPFPLSFVQEKKFGAMGECSAVCGGLLGGATEDELQSLRRYGRAVGMLYQVVDDITEDKKKSYDGGAEKGMMEMAEELKEKAKKELQVFDNKYGGGDTLVPLYTFVDYAAHRHFLLPL

SEQ ID NO: 899 - protein, 254 aa, Arabidopsis thaliana
MARGESEGESSGSERESSSSSSGNESEPTKGTISKYEKQRLSRIAENKARLDALGISKAAKALLSPSPVSKKRRVKRNSGEEDDDYTPVIADGDGDEDDDEVEEIDEDEEFLCKRKNKSSASKRKVSSRKILNTSVSLGEDDDDLDKAIALSLQGSVAGSDKEAATMKKKRPELMSKTQMTQDELVMYFCQFDEGGKGFITLRDVAKMATVHDFTWTEEELQDMIRCFDMDKDGKLSLDEFRKIVSRCRMLKGS

SEQ ID NO: 900 - protein, 137 aa, Arabidopsis thaliana
MQGTISCARNYNMTTTVGESLRPLSLKTQGNGERVRMVVEENAVIVIGRRGCCMCHVVRRLLLGLGVNPAVLEIDEEREDEVLSELENIGVQGGGGTVKLPAVYVGGRLFGGLDRVMATHISGELVPILKEVGALWL

SEQ ID NO: 901 - protein, 110 aa, Arabidopsis thaliana
MASNLLKALIRSQILPSSRRNFSVATTQLGIPTDDLVGNHTAKWMQDRSKKSPMELISEVPPIKVDGRIVACEGDTNPALGHPIEFICLDLNEPAICKYCGLRYVQDHHH

SEQ ID NO: 902 - protein, 209 aa, Arabidopsis thaliana
MNEEEPDKEHVADSTMSAAAIDGVAALRSVFQRVNQAAEKAGRGSDQIRVVAVSKTKPVSLIRQVYDAGQRSFGENYVQEIIEKAPQLPEDIEWHFIGNLQSNKVKPLLSGVPNLVTVESVDDEKIANMLDRVVGNIGRKPLKVFVQVNTSGEDSKFGVEPSGCVGLAKHVKEACSNLEFSGLMTIGMADYTSTPENFKLLAKCRSEVC

SEQ ID NO: 903 - protein, 122 aa, Arabidopsis thaliana
MASKLIQVQSKACEASKFVAKHGTSYYRQLLEKNKQYIQEPATVEKCQELSKQLLYTRLASIPGRYETFWKEVDYAKNLWKNRSGLKVEDAGIAALFGLECFAWYCAGEIAGRGFTFTGYYP

SEQ ID NO: 904 - protein, 391 aa, Arabidopsis thaliana
MASSSTFLELTPFQWNQPLPYTQRPHHRTVLLYSKPQRRSNSIRLQISVKYKQSTSSSDPDLRSNFNPFEQIAIQVKKALDSLKKPAIAAVLLGLLLFYDPNSALAASGGRIGGNSFSSRSRSSSSSSSQSYSVPRTSNPSFSYSARTAPYYGPSPFGGGFVGPAVGFGFGGFSSFSLILVGFAAFVLVSGFLSDRSQDDSILTDTQKTSVIKLQVGLLGLGRTLQQDFNRLAESSDTSTPEGLSYVLTEATLALLRHPDYCISCYSSVDVKPSIEKGEKRFNQLSIEERGKFDEETLVNVNSIKRQSSKIRKASGFSNEYIVVTILMAAEGIHKLPPINGTTDLKEALLKLGSIPRNKIMAVEVLWTPQNEADALSERELLEDYPLLRPL

SEQ ID NO: 905 - protein, 286 aa, Arabidopsis thaliana
MAEKKRVKYFIVDAFAESAFKGNPAAVCFLEDDNERDDAWLQSLATEFNISETCFLTPIIGDLPRFRLRWFTPVAEVDLCGHATLASAHVLFSTGLVGSETVEFDTLSGILTAKHLKNDDDGEESSIELDFPVVPTYEVNYIDDDLSLFSKALNGATILDVKATKKDLLVVLSSWEAVIDLKPRLDEISKCPCEGMMVTAAASDGSTYDFCSRYFAPRFGINEDPVTGSAHCALAHYWSLRMNKCDFFAYQASSRGGTLKVHLDKEKQRVLLRGKAVTVMEGYVLV

SEQ ID NO: 906 - protein, 313 aa, Arabidopsis thaliana
MAKASSTLFAVSCSASARFSFLRRSESLKPSVSRARFAVPMAMAAASAATAKKLAPAVIVGGGRVGRALQEMGNGEDLLVKRGEAVPVDFEGPILVCTRNDDLDAVLEATPQSRWKDLVFFQNGMMEPWFESKGLGDTDQVLAYFAVSKLGEPPVDGKTDTNPEGLTAAYGKWASEIAARLQSGGLSCKVLDKEAFQKQMLEKLIWICAFMLVGARHPGASVGTVEKEYRDEVSRLIQELAAAAAAEKGLTFEENMVERLCAYSRAVSHFPTAVKEFKWRNGWFYSLSEKAIAEGQPDPCPLHTEWLKELKVI

SEQ ID NO: 907 - protein, 356 aa, Arabidopsis thaliana
MELDLTPKLPKKVYGGDGGSYSAWCPEELPMLKQGNIGAAKLALEKNGFAVPRYSDSSKVAYVLQGSGTAGIVLPEKEEKVIAIKQGDSIALPFGVVTWWFNNEDPELVILFLGETHKGHKAGQFTEFYLTGTNGIFTGFSTEFVGRAWDLDENTVKKLVGSQTGNGIVKLDAGFKMPQPKEENRAGFVLNCLEAPLDVDIKDGGRVVVLNTKNLPLVGEVGFGADLVRIDAHSMCSPGFSCDSALQVTYIVGGSGRVQVVGGDGKRVLETHIKAGSLFIVPRFFVVSKIADADGMSWFSIVTTPDPIFTHLAGNTSVWKSLSPEVLQAAFKVAPEVEKSFRSTRTSSAIFFPPSN

SEQ ID NO: 908 - protein, 159 aa, Arabidopsis thaliana
METAICGRLALAPSSLFNSKSGDKHLVSKGPCVNRSILMTLSTSAALGKGGGVLDKPIIEKTTPGRESEFDLRKSKKIAPPYRVILHNDNFNKREYVVQVLMKVIPGMTVDNAVNIMQEAHINGLAVVIVCAQADAEQHCMQLRGNGLLSSVEPDGGGC

SEQ ID NO: 909 - protein, 155 aa, Arabidopsis thaliana
MGVAVLHPHDSIINHFSTNTSPPLRHKKPITNRRRRSPSSHQSQISHPPPSPHNHTNHVRILKRGEDINVKIPIEKPDLKSNRQIGSDPMKISTPIRISNRKSMPALFYAGPVTSTSPPPSEVPLPAFFANKTVAGFKPTDATNDLIKILRLDIA

SEQ ID NO: 910 - protein, 678 aa, Arabidopsis thaliana
MESMTPISCPTTPRWNQDRPFLTGRFHQETRASSKFADSKRFTLDSSSSGVEQAIGCYDTPVQELIVIDDLLSALVGIEGRYISIKRFHGKEDSIAFQVDPSMDLALQELAKRIFPLCEYYLLIDQFVESSSQFKNGLVNHAFAAALRALLLDYQAMVAQLEHQFRLGRLSIQGLWFYCQPMMGSMRALAAVIQQASTKQFVGSGVLNLLQSQAKAMAGDNSVRSLLEKMTECASNAYLSILERWVYEGIIDDPYGEFFIAENRSLKKESLSQDSTAKYWSQRYSLKDTIPGFLANIAATILTTGKYLNVMRECGHNVQVPISERSKLTIFGSNHHYLECIKAAHEFASIELVNLIKDKYDLVGRLRSIKHYLLLDQGDFLVHFMDIAREELNKKVHEISVEKLQSLLDLALRTTAAAADPRHEDLTCCVDRASLLTTLGMHKDTDSNSIEDPMSITGLETFSLSYKVQWPLSIVISKKALSKYQLIFRFLFHCKHVERQLCGAWQIHQGIRSMNSKGTAILRSSLLCRSMLKFISSLLHYLTFEVLEPNWHVMHDRLQSTRSVDEVIQHHDFFLDKCLRGCLLLLPDVLKKMEKLKSVCLQYAAATQWLISSSIDINSQSHPQKTMIRDTTVTESIFNFEREFNSELQSLGPVLSKGSQAEPYLTHLSQWILGVSKE

SEQ ID NO: 911 - protein, 199 aa, Arabidopsis thaliana
MACTVDFRCLDEGFGGKTYKRKRESQEQAAAEAIADEASMDIDGAPPAAKRSAVASSENPDKPIALAVERPTYDGVIAGKVSGRNWKQPRTHRSSGRFVKNRKPDLEEMKRQREIKKAYKERVNELKEEIRSNKVEKRKKKEEREKRKKENVLRTGTKLQKITNPKTLKKISMSKKQRKQLKKIPDEMLSGGSKKSITN

SEQ ID NO: 912 - protein, 208 aa, Arabidopsis thaliana
MSLKGTIVLLGLLWSFQATLGIRFVIDREECFSHKAEYEGDTLHVSFVVIKSDSQWHFNEDGVDLVIHGPTGEQIHDFREQISAKHDFVVQKKGVYRFCFTNKSPYHETIDFDVQLGHFAYYDQHAKDEHFTPLMEQISKLEEALYNIQFEQHWLEAQTDRQAIVNENMSKRAVHKALFESFALIGASFLQVYLLRRLFERKLGMSRV

SEQ ID NO: 913 - protein, 757 aa, Arabidopsis thaliana
MSSSFLSSTAFFLLLCLGFCHVSSSSSDQGTYIVHMAKSQMPSSFDLHSNWYDSSLRSISDSAELLYTYENAIHGFSTRLTQEEADSLMTQPGVISVLPEHRYELHTTRTPLFLGLDEHTADLFPEAGSYSDVVVGVLDTGVWPESKSYSDEGFGPIPSSWKGGCEAGTNFTASLCNRKLIGARFFARGYESTMGPIDESKESRSPRDDDGHGTHTSSTAAGSVVEGASLLGYASGTARGMAPRARVAVYKVCWLGGCFSSDILAAIDKAIADNVNVLSMSLGGGMSDYYRDGVAIGAFAAMERGILVSCSAGNAGPSSSSLSNVAPWITTVGAGTLDRDFPALAILGNGKNFTGVSLFKGEALPDKLLPFIYAGNASNATNGNLCMTGTLIPEKVKGKIVMCDRGINARVQKGDVVKAAGGVGMILANTAANGEELVADAHLLPATTVGEKAGDIIRHYVTTDPNPTASISILGTVVGVKPSPVVAAFSSRGPNSITPNILKPDLIAPGVNILAAWTGAAGPTGLASDSRRVEFNIISGTSMSCPHVSGLAALLKSVHPEWSPAAIRSALMTTAYKTYKDGKPLLDIATGKPSTPFDHGAGHVSPTTATNPGLIYDLTTEDYLGFLCALNYTSPQIRSVSRRNYTCDPSKSYSVADLNYPSFAVNVDGVGAYKYTRTVTSVGGAGTYSVKVTSETTGVKISVEPAVLNFKEANEKKSYTVTFTVDSSKPSGSNSFGSIEWSDGKHVVGSPVAISWT

SEQ ID NO: 914 - protein, 473 aa, Arabidopsis thaliana
MIKLWMMTSLQLAELFVSSIVHLLYGFYIFSSAVAGDISQTLNDYLFKSNVAFGETGQNQTNVEGLPPIVLVHGIFGFGKGRLGGLSYFGGAEKKDERVLVPDLGSLTSIYDRARELFYYLKGGVVDFGEEHSEACGHSRFGRRYEQGQYPEWDEDHPIHFVGHSAGAQVVRVLQQMLADQAFEGFEETNENWVLSVTSLSGAFNGTTRTYLDGMRTDDGVSMKPICLLQLCRIGVIMYDWLDISWLKTYYNFGFDHFNISWKKTGVRGLVDCLMGNAGPFASGDWILPDLTIQGSTSINSNLQTFPNTYYFSYATKRTRRVMGMTIPSGVLGIHPMLFLRVFQMSQWKFPQDVSPPYKGYRDEDWQENDGALNTISMTHPRLPVEHPSRFIRSDSECQTLQPGIWYYKIVEADHIMFIVNRERAGVQFDLIYDSIFQRCRKHVFRKIPQTLPNQSPSSPRSSSSPRINNFVH

SEQ ID NO: 915 - protein, 128 aa, Arabidopsis thaliana
MTVEGVNPKAYPLADSQLSITILDLVQQATNYKQLKKGANEATKTLNRGISEFIVMAADTEPLEILLHLPLLAEDKNVPYVFVPSKQALGRACDVTRPVIACSVTSNEASQLKSQIQHLKDAIEKLLI

SEQ ID NO: 916 - protein, 206 aa, Arabidopsis thaliana
MQGVIRSFVSGGNVVKGSVLQHLRVINPAIQPSVFCSRSESTQPARMEESGFESTTISDVMKSKGKSADGSWLWCTTDDTVYDAVKSMTQHNVGALVVVKPGEQQALAGIITERDYLRKIIVQGRSSKSTKVGDIMTEENKLITVTPETKVLRAMQLMTDNRIRHIPVIKDKGMIGMVSIGDVVRAVVHEHREELQRLNAYIQGGY

SEQ ID NO: 917 - protein, 503 aa, Arabidopsis thaliana
MSLFSFPISTELLPWLLLLLIPPLLIFFLLRSPKNLPPGPPRLPILGNIHQLGSLPHRSLRDLSLKYGPVITVYLGSVRTVVVHSPETAEEVLKLHDSECCTRPKLSITKSFFYDGLGLGFTKWGDYYRDVRKLCVLELFSVKRANSFRNIREEELSRLVNSFSDSASSGSSVDLTANLAKFVASFTCRMAFGLSFQGSGMDNETFLELFTEANRVIGKFAAADIFPGFGWILDRISGLDSSRRKSFQDLDTFYQKAIVDHREKKKTEDREDLIDVLLKLQSQETKLGSSRITDTHIRAIIMDLFVAGVDTSVITLDWTMAELSRHPRVMKKVQAEIREHVGDKGIVTYDDLEALVYMKMVIKETWRLHAPSPILIPREAMTNFKIKGYDIYPGTRIHVNAWAIGRNPDVWKDPDEFIPERFVDSNVETKGTSFELLPFGSGRRGCPAMYVGLSTVEYTLANLLYHFDWKATEEVSVEEAPGLTSHRKHPLHLVPVNVINRKL

SEQ ID NO: 918 - protein, 600 aa, Arabidopsis thaliana
RQFRLSPSRSSSFRRMESSPASSSSPTPVTDSSADSLAKDLQNQSLGAVDEGVKIKKKLEDFNWDHSFVKELPGDPRTDVISREVLHACYSKVSPSVEVDDPQLVAWSVSVAELLDLDPKEFERPDFPLMLSGAKPLPGAMSYAQCYGGHQFGMWAGQLGDGRAITLGEVLNSKGERWELQLKGAGRTPYSRFADGLAVLRSSIREFLCSETMHCLGIPTTRALCLLTTGQNVTRDMFYDGNPKEEPGAIVCRVSQSFLRFGSYQIHASRGKEDLDIVRKLADYAIKHHFPHIESMDRSDSLSFKTGDEDDSVVDLTSNKYAAWIVEIAERTATLVARWQGVGFTHGVLNTDNMSILGQTIDYGPFGFLDAFDPSYTPNTTDLPGRRYCFANQPDIGLWNIAQFSKTLAVAQLINQKEANYAMERYGDKFMDEYQAIMSKKLGLTKYNKEVISKLLNNMSVDKVDYTNFFRLLANVKANPNTPENELLKPLKAVLLDIGKERKEAWIKWMRSYIQEVGGSEVSDEERKARMDSVNPKYILRNYLCQSAIDAAEQGDFSEVNNLIRLMKRPYEEQPGMEKYARLPPAWAYRPGVCMLSCSS

SEQ ID NO: 919 - protein, 515 aa, Arabidopsis thaliana
MMTNSDSDHCTPAKTSISGDGLEKESDFKKQLNSEIDPQASSSQNDAITMEDGAVSVNNRDLQEIKESSFSKGSEQYRVDGALEESLNFEEKEQESEAQRLLEAEKRRLLAEIELGSIFRKSVDVDTLPKIEETMDNDVDKIELVDHTALVDVVHHPKRPGTAQNEKDTPRKLKKIGDKRNVIEGSGVENNGKQFRRLYTRKQLESMRFAHIVNQKNLWSEMYSRILPEVVTEYESLVYVKNYKSSKSNRVRGRTESGNEENLGTEEGTEDPEDYTDDNDDYNSILRPAFEVDGEPDFSTGPPEDGLEYLRRVRWEAKGIPNVRVAKIDESTYIKKEQSVYMPLIPEIPKCPEYLLPMKEWEDSLLLDFVHLRQTLTQSANSCEDEIISSQCVEDLLVEMFNKHLHTEEDESFGEVVTDIQGMDSVTRVSKLKKRICLVEKESGLQSSDCKWVVALCASLETPLDADTCACLRGLLRKCASVRAETSLEVGDEEVITMANMLITIAGRYFGQMGQ

SEQ ID NO: 920 - protein, 401 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHSLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMYRVEVLEKVPIMQHFLFGWLIKWYDSSFFLLSRF

SEQ ID NO: 921 - protein, 129 aa, Arabidopsis thaliana
MTIAPALQTTFVSSTNFLKHSSSWGSPSPNNVILPKNKRSSSSVVVAAVGDVSSDGTIYLIGGAIAVALVGTAFPILFKRKDTCPECDGAGFVRKGGVTLRANAARKDLPQIVCANCNGLGKLNQIDKS

SEQ ID NO: 922 - protein, 517 aa, Arabidopsis thaliana
MELLSTINLLAIALVLLVVPKIYGACRILVWRPWMLSRRFKKQGISGPKYRILYGNLREIRKMKNEAKLMVLDPNSNDIVPRVLPHLQQWKSQYGETFLYWQGTDPRLCISDHELAKQILSNKFVFFSKSKTKPEILKLSGNGLIFVNGLDWVRHRRILNPAFSMDKLKLMTQLMVDCTFRMFLEWKKQRNGVETEQFVLISREFKRLTADIIATAAFGSSYAEGIEVFKSQLELQKCCAAALTDLYFPGIQYLPTPSNLQIWKLDMKVNSSIKRIIDARLTSESKDYGNDLLGIMLTAASSNESEKKMSIDEIIEECKTFFFAGHETTANLLTWSTMLLSLHQDWQEKLREEVFNECGKDKIPDAETCSKLKLMNTVFMESLRLYGPVLNLLRLASEDMKLGNLEIPKGTTIILPIAKMHRDKAVWGSDADKFNPMRFANGLSRAANHPNALLAFSMGPRACIGQNFAIMEAKTVLAMILQRFRLNLSADYKHAPADHLTLQPQYDLPVILEPIDG

SEQ ID NO: 923 - protein, 378 aa, Arabidopsis thaliana
MAIKKLLMISFSLTSLLFSLLYIIPTTKTLFTSSKIPSLPLESNQNSNSTLPCFAYLISASKGDAGKLKRLLRSLYHRRNHYLIHLDLEAPEEEHLEMIRFVAGEPLFQPEGNVMIVGKPNLVTYRGPTMLATTLHAMALLLRCCRWDWFINLSASDYPLVTQDDLIYAFSELPRDLNFIQHTSRLGWKMNKRGKPIIIDPGLYSLNKSEIWWVSNQRSLPTSFKLFTGSAWTFLSRPFAEYCIIGYDNLPRTLLLYYTNFVSSPEGYFQTLICNSDEFKNTTVNHDLHYIAWDNPPKQHPKILGTRDYRKMVMSNRPFARKFKSNDPVLNRIDREILRRKRKLGSKPDLGPGPGARRLKSLLMRLLLRRNFVNRQCR

SEQ ID NO: 924 - protein, 283 aa, Arabidopsis thaliana
MSPLHSYIIFFSLLMTILLQSSTTSSQSNLCRSSCGNIPINYPFSIDDGCGSPYYRHMLICSDNDTKLELRTPSGKYPVKSISYSDPHLLVSDPFMWNCQDRDNFRPTRSFSIDSSTHFTVSPQNDYLFFNCNTDKVIVEPKPLFCERFPDRCDSSCDSSSYLCRHLPECGSALGSRVSCCSYYPKATQSLRLMLQDCATYTSVYWRSTGVENAPYDQFPEYGIRVDYEFPVTMKCLLCQETTKGGGVCGFNTRTRDFLCLCKQGNVTTYCKGQNVYVHIFSS

SEQ ID NO: 925 - protein, 283 aa, Agrobacterium tumefaciens
MTEKSTPLFSFGIVADPQYADADPRPDMGRYYAESPKKLAEAINVFNSEDLAFVVTLGDIIDRGFENFDAILSVYDALRHPSVLLPGNHDFAVAPEHLSAIHARLGMKAPWHDFAMSGIRFVVLDGNDVSLFAPPPDDPRRLVAQERLKRLWDVDAINAQDWNASLSDKQFEWLRTILQQADAAGERVIVLCHYPVYPENAHNMWDAPRILDLLGSHSSVAAWFNGHNHEGNYGTLGTTHFVNFKGMVDTPDQNTFAIADVFADRIAIRGFGREEDRVLQYLR

SEQ ID NO: 926 - protein, 290 aa, Agrobacterium tumefaciens
MHVMIFGAGYSGKAIANALKTKAASVCGTTRSADKFANLAAAGMTPLLFDGVHLDDDLIAAMRNVTHLVQSIAPGKDGDPLFALLGGDLKKLLPNLKWLAYLSTVGVYGDHHGAWVNETTPCRPVSARSVERVAAEAAWTEAAQSADVPLSILRLSGIYGPGRNTFMNFEKGTARRLVKKDQVFNRIRVEDIGAAIAFLALKNERGIFNVTDDEPCPPQDVVSFAADLMGVVPPAEQDFGTADLTPMARSFYGENKRVSNAKIRELGFDFRFPEYRQSLKQLWESSLWRG

SEQ ID NO: 927 - protein, 187 aa, Saccharomyces cerevisiae
MSIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 928 - protein, 385 aa, Saccharomyces cerevisiae
MTKSVDTLLIPGPIILSGAVQKALDVPSLGHTSPEFVSIFQRVLKNTRAVFKSAAASKSQPFVLAGSGTLGWDIFASNFILSKAPNKNVLVVSTGTFSDRFADCLRSYGAQVDVVRPLKIGESVPLELITEKLSQNSYGAVTVTHVDTSTAVLSDLKAISQAIKQTSPETFFVVDAVCSIGCEEFEFDEWGVDFALTASQKAIGAPAGLSISLCSSRFMDYALNDSKNGHVHGYFSSLRRWTPIMENYEAGKGAYFATPPVQLINSLDVALKEILEEGLHKRWDLHREMSDWFKDSLVNGLQLTSVSRYPSNMSAHGLTAVYVADPPDVIAFLKSHGVVIAGGIHKDIGPKYIRIGHMGVTACNKNLPYMKNCFDLIKLALQRKK

SEQ ID NO: 929 - protein, 649 aa, Saccharomyces cerevisiae
MFSVTRRRAAGAAAAMATATGTLYWMTSQGDRPLVHNDPSYMVQFPTAAPPQVSRRDLLDRLAKTHQFDVLIIGGGATGTGCALDAATRGLNVALVEKGDFASGTSSKSTKMIHGGVRYLEKAFWEFSKAQLDLVIEALNERKHLINTAPHLCTVLPILIPIYSTWQVPYIYMGCKFYDFFAGSQNLKKSYLLSKSATVEKAPMLTTDNLKASLVYHDGSFNDSRLNATLAITAVENGATVLNYVEVQKLIKDPTSGKVIGAEARDVETNELVRINAKCVVNATGPYSDAILQMDRNPSGLPDSPLNDNSKIKSTFNQIAVMDPKMVIPSIGVHIVLPSFYCPKDMGLLDVRTSDGRVMFFLPWQGKVLAGTTDIPLKQVPENPMPTEADIQDILKELQHYIEFPVKREDVLSAWAGVRPLVRDPRTIPADGKKGSATQGVVRSHFLFTSDNGLITIAGGKWTTYRQMAEETVDKVVEVGGFHNLKPCHTRDIKLAGAEEWTQNYVALLAQNYHLSSKMSNYLVQNYGTRSSIICEFFKESMENKLPLSLADKENNVIYSSEENNLVNFDTFRYPFTIGELKYSMQYEYCRTPLDFLLRRTRFAFLDAKEALNAVHATVKVMGDEFNWSEKKRQWELEKTVNFIKTFGV

SEQ ID NO: 930 - protein, 242 aa, Xanthomonas
  misc_feature (37)..(37): Xaa can be any naturally occurring amino acid
MAELPPEVRNVTDPLDAVGNTTKAVTKGYAIGSAALXAALVLFADYTHNLHAGNPNEVFAFDLSDHTVITGLLIGGLIPYLFGAMAMEAVGRAAGAVVEEVRRQFRDIPGIMAGTAKPQYDRAVDMLTRSAIREMIVPSLLPVVVPVIVGLLLGPRALGGLLIGTIVTGLFVAISMTTGGGAWDNAKKYIEDGHFGGKGSEAHKAAITGDTVGDPYKDTAGPAINPLIKIINIVALLLVPLL

SEQ ID NO: 931 - protein, 275 aa, Xanthomonas campestris
MPSFKSFLLHRVSPVCLCVATGWGTVAMAQTVLPDATPVHAHETTQHDGHEWGYTGPEGAEHWAELAKENALCGNGQQNSPIDLKDAIDATLGKLQLDYGAVPLVVRNTGHSIQLDLHAGGTMRVGGKQYDALQLHFHHPSEHLLNGRRFPMEAHIVHQGPDGTLGVLAIFFETGKANPAFQRVLDAMPSDKNQTRQVADAVVRASDFLPPANQRSFYRYEGSLTTPPCSETVDWVVLSQPVQVSREQINAFERVYPFNARPLQPLDRRFLLKSH

SEQ ID NO: 932 - protein, 590 aa, Arabidopsis thaliana
MIPASMEEAHQLESRSDDLSQRRSYWRWRKQDFFPEFSFQSFSTYKSALSATCPRLADRLLSRSSDAYELDAARRESENPMRRCLTWWDLLWLSFGSVVGSGVFVITGQEARVGAGPAVVLSYAISGVSALLSVLCYAEFGVEIPVAGGSFSYLRVELGDFIAFIAAGNILLEAMVGAAGLGRSWSSYLASLVKNDSDYFRIKVDSFAKGFDLLDPVAVAVLLVANGIAMTGTKRTSWLNLITSMVTVCIIVFIVVVGFTHSKTSNLVPFFPYGAKGVVQSAAVVYWSYTGFDMVANMAEETEKPSRDIPIGLVGSMSMITVVYCLMALALTMMVKYTEIDANAAYSVAFAQIGMKWAKYLVGICALKGMTTSLLVGSLGQARYTTQIARSHMIPPWFALVHPKTGTPIYATLLVTILSSIISFFTSLEVLSSVFSFATLFIFMLVAVALLVRRYYVKDVTPEAGLLKFLGFLFLIIASSIGVSALWNSGVKGWIAYTVTGVIWFIGTLGLALLPKYRVPKVWGVPLVPWLPSFSIAMNLFLIGSLGYVAFLRFIICTMVMLLYYLFVGLHATYDVAHQPLEEAKFEGER

SEQ ID NO: 933 - protein, 98 aa, Arabidopsis thaliana
MERKKFSSKFIHLLIVFLLLCTFLSRTESALPYHHELFLGRKRMNYYKPNSAIGTPSSTSDHAPGSNGRKLMSIYRPNGDIFTGPSGSGHGGGRTPAP

SEQ ID NO: 934 - protein, 240 aa, Arabidopsis thaliana
MLCFKGSVKRKKQSGSVPVYLNVYDLTPMNAYGYWLGLGVFHSGVEVHGVEYAFGAHESSSTGIFEVEPKKCPGFTFRKSILVGKTDLVAKEVRVFMEKLAEEYQGNKYHLITRNCNHFCNEVCLKLAQKSIPRWVNRLARLGVLCNCVLPPRLNEAKVRRVGKGELSESEKKKLRNRSRSDPLLSSSPSSSTPDNHRSHIRAKSSGNHPSSSSSSSSGSKKNRRPKAQDQKSPSVSIKT

SEQ ID NO: 935 - protein, 234 aa, Arabidopsis thaliana
MGEKEEVKLLGVWYSPYAIRPKIALRLKSVDYDYVEENLFGSKSELLLKSNPVHKKVPVLLHNNKPIVESLNIVEYIDETWNSSAPSILPSHPYDRALARFWSDFVDNKWFPALRMAAITKSEDAKAKAMEEVEEGLLQLEDAFVSISKGKPFFGGEAIGFMDICFGSFVVLLKAREKFKAEKLLDESKTPSLCKWADRFLSDETVKNVAPEIEKVAEFLQELEVRAQSAASRS

SEQ ID NO: 936 - protein, 302 aa, Arabidopsis thaliana
MENQDKIQNVLDIMRLALVIIAAVMLFLAFIGFLLSIFGLQCLVYTLVILGWILVTVTFVLCGGFLLLHNVVGDTCVAMDQWVQNPTAHTALDDILPCVDNATARETLTRTKLVTYQLVNLLDNAISNMTNRNFPPQFRPLYYNQSGPLMPLLCNPFNADLSDRQCQPGQVHLNNATEVWKNFTCQIVTPGTCSTPGRLTPKLYSQMAAAVNVSYGLYKYGPFLADLQGCDFVRSTFTDIERDHCPGLKRYTQWIYVGLVVVSASVMSSLVFWVIYARERRHRVYTKDYNAMHSEDPRSKGH

SEQ ID NO: 937 - protein, 260 aa, Arabidopsis thaliana
MAERVYPADSPPQSGQFSGNFSSGEFPKKPAPPPSTYVIQVPKDQIYRIPPPENAHRFEQLSRKKTNRSNCRCCFCSFLAAVFILIVLAGISFAVLYLIYRPEAPKYSIEGFSVSGINLNSTSPISPSFNVTVRSRNGNGKIGVYYEKESSVDVYYNDVDISNGVMPVFYQPAKNVTVVKLVLSGSKIQLTSGMRKEMRNEVSKKTVPFKLKIKAPVKIKFGSVKTWTMIVNVDCDVTVDKLTAPSRIVSRKCSHDVDLW

SEQ ID NO: 938 - protein, 216 aa, Arabidopsis thaliana
MEPRINDLQVESRVHELLDFPVHTNQISSAIYECPNDHIENPKKKPYNCPHSGAKCDVTGDIQRLLLHLRNDHNVEMSDGRSFSHRYVHHDPKHLHHATWMLTLLDCCGRKFCLYFEAFHLRKTPMYMAFMQFMGDEEEAMSFSYSLQVGGNGRKLTWQGVPRSIRDSHKTVRDSQDGLIITRKLALFFSTDNNTTDKELKLKVSGRVWREQPVSI

SEQ ID NO: 939 - protein, 460 aa, Arabidopsis thaliana
MPLSATADTSKTVKLERYNSYLRKIHSTKVLNASSKVLFRATLLVALVLVLIFAINYPPLSDSRAAAAHHLHRRSFLSTGLFSSSSSSSSIGGAAWEKRVRQSSTAKRPHGLSVLVTGAAGFVGSHCSLALRKRGDGVLGFDNFNDYYDPSLKRARQELLEKQQVFIVEGDLNDGPLLRKLFDVVPFTHILHLAAQAGVRYAMKNPQSYIASNIAGFVNLLEVAKAANPQPAIVWASSSSVYGLNTENPFSEEHRTDQPASLYAATKKAGEEIAHTYNHIYGLSLTGLRFFTVYGPWGRPDMAYFFFTKDILHGKSIDIYRTQDNQEVARDFTYIDDIVKGCVGALDTAEKSTGSGGKKRGQAQLRVYNLGNTSPVPVGRLVSILEGLLGTKAKKHLIKMPRNGDVPYTHANVSLAYKDFGYKPTTDLAAGLRKFVKWYVGYYGIQPRVKKETSHAEDSA

SEQ ID NO: 940 - protein, 129 aa, Arabidopsis thaliana
MAASSLNLLLILSLLTFISLQRSESLSDNPSLTLLPDGFDWPISHSDEFDIIDGEESFEVTEEDDGVTDRRSLYWRRTKYYISYGALSANRVPCPPRSGRSYYTHNCFRARGPVHPYSRGCSSITRCRR

SEQ ID NO: 941 - protein, 233 aa, Agrobacterium tumefaciens
MSVPSRLSARSGRGSRECRRWNECRCLFSWSTAVKLIGWPELPDPFPILTGNTMTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 942 - protein, 347 aa, Agrobacterium tumefaciens
MRALYYERFGETPVVASLPDPAPSDGGVVIAVKATGLCRSDWHGWMGHDTDIRLPHVPGHEFAGVISAVGRNVTRFKTGDRVTVPFVSGCGHCHECRSGNQQVCETQFQPGFTHWGSFAEYVAIDYADQNLVHLPESMSYATAAGLGCRFATSFRAVTDQGRLKGGEWLAVHGCGGVGLSAIMIGAGLGAQVVAIDIAEDKLELARQLGATATINSRSVADVAEAVRDITGGGAHVSVDALGHPQTCCNSISNLRRRGRHVQVGLMLADHAMPAIPMARVIAHELEIYGSHGMQAWRYEDMLAMIESGRLAPEKLIGRHISLTEAAVALPGMDRFQESGISIIDRFE

SEQ ID NO: 943 - protein, 298 aa, Agrobacterium tumefaciens
MRAFVIGNIALDETYSIAALPQAGASIFGEQASRSLGGKGCNQAIVLARCGVETTLVAAVGTDDRAIAIGKSLTREHLTPKLIPVDSATSDISIILTTPDGENSIITTRSAAAALDRDAALDALGDTVSGDLVILQGNLSEETTLVILNAARSKGLTTAFNPSPLQPWFASILPLIDIAVLNRIEAEALTGESGAGAGAFLLRAGVGLVIITLGGQGCVLVSANGAIEVAAAPATIVDTTGAGDCFTGVALASAIRRGVAIDARALEDASRAAAITVGRRGTQDAFPSHEEMMAILRA

SEQ ID NO: 944 - protein, 248 aa, Saccharomyces cerevisiae
MARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 945 - protein, 196 aa, Saccharomyces cerevisiae
MVAEVQKQAPPFKKTAVVDGIFEEISLEKYKGKYVVLAFVPLAFSFVCPTEIVAFSDAAKKFEDQGAQVLFASTDSEYSLLAWTNLPRKDGGLGPVKVPLLADKNHSLSRDYGVLIEKEGIALRGLFIIDPKGIIRHITINDLSVGRNVNEALRLVEGFQWTDKNGTVLPCNWTPGAATIKPDVKDSKEYFKNANN

SEQ ID NO: 946 - protein, 139 aa, Arabidopsis thaliana
MAASPLVVQKTEEEWRAVLSPEQFRILRQKGTEKPGTGEYDKFFEEGIFDCVGCKTPLYKSTTKFDSGCGWPAFFEGLPGAINRTPDPDGRRTEITCAACDGHLGHVFKGEGYGNPTDERHCVNSVSISFNPAKSSSII

SEQ ID NO: 947 - protein, 87 aa, Arabidopsis thaliana
MDSYSSPPMGGSGSSVSPEVMMESVKTQLAQAYAEELIETLRTKCFDKCVTKPGSSLGGSESSCISRCVERYMEATAIISRSLFTQR

SEQ ID NO: 948 - protein, 134 aa, Arabidopsis thaliana
MNHGQQSGEAKHEDDAALTEFLASLMDYTPTIPDDLVEHYLAKSGFQCPDVRLIRLVAVATQKFVADVASDALQHCKARPAPVVKDKKQQKDKRLVLTMEDLSKALREYGVNVKHPEYFADSPSTGMDPATRDE

SEQ ID NO: 949 - protein, 430 aa, Arabidopsis thaliana
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSSYYRDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 950 - protein, 301 aa, Arabidopsis thaliana
MKNKAFGQIMDDAENPGFFKILRSADLSSEIMRGIPLNFIKSISEEELSAKMLLKVSWGSSWPIKICRNPSFYFMEKKGWDQFLSDNGLGNDEFLTFTHQGNMCFTVDIYQIDGKELLTPRRSATIASSSGRNKREQRNNIYKDVKEEEDIESWSESSYPGHKTAESTGRRQRLSLSNKKAKETEKSKKKKMKVESISYDSQDDSLSLVPEFTLTIKKSYLIFLGIPKMFEELHMPTEATMFKIHDPEGKRSWDVMYKFSNNQTRFCAGWIRLAKELGLEIGDVCTFTLIKPTEMLVRVSK

SEQ ID NO: 951 - protein, 460 aa, Arabidopsis thaliana
MAQQEASPSPGAEVVGRAFVEQYYHILHQSPGLVHRFYQDSSFLTRPDVTGAVTTVTTMQAINDKILSLKYEDYTAEIETADAQESHERGVIVLVTGRLTGNDNVRKKFSQSFFLAPQDKGYFVLNDVFRFLEEKEVTAQARSVPINGTTRDVQAPIEPERVVVSHEPEVEPEPVASIEEEDLDNVAEVYDPSDKDEGVVVDVEPIEPPTQISHNEILSVPQGDAPKHSYASILKQMKSSPAPTTHVARNKPRPAPVNQKLTAPPAEPAARPEASAHENVPNSSHVDVEDDGHSIYVRNLPFDSTPTQLEEVFKNFGAIKHEGIQVRSNKQQGFCFGFVEFETSSGKQSALEASPVTIGDRQAVVEEKKTNSRGGGNNGGSRGRYFSGRGSFRNESFKGGRGGGGRGGYGRGGGEFSGRPKSSNPRNGGEGYQRVPQNGGGGRGGRGEGGRGGARGGGSS

SEQ ID NO: 952 - protein, 354 aa, Arabidopsis thaliana
MGDWAQLAQSVILGLIFSYLLAKLISIVVTFKEDNLSLTRHPEESQLEIKPEGVDSRRLDSSCGGFGGEADSLVAEQGSSRSDSVAGDDSEEDDDWEGVESTELDEAFSAATLFVTTAAADRLSQKVPSDVQQQLYGLYKIATEGPCTAPQPSALKMTARAKWQAWQKLGAMPPEEAMEKYIEIVTQLYPTWLDGGVKAGSRGGDDAASNSRGTMGPVFSSLVYDEESENELKIDAIHGFAREGEVENLLKSIESGIPVNARDSEGRTPLHWAIDRGHLNIAKVLVDKNADVNAKDNEGQTPLHYAVVCDREAIAEFLVKQNANTAAKDEDGNSPLDLCESDWPWIRDSAKQAD

SEQ ID NO: 953 - protein, 413 aa, Arabidopsis thaliana
MARKKHRKLFPTLASETNKTLDCSNGVCDPICPYNCYPEPDYYTISPQLPPWSSSPQPSPCPSPSISAVYLPSQDSSSSLDAISIITITGAVLAILLTGFFLVAKFFSDSVNRVNQGTYQSDNEDNDTVMEEEFQDREQVDHPIWLIRTTGLQQSIINSITICNYKRGDGLIERTDCPVCLNEFEEDESLRLLPKCNHAFHISCIDTWLSSHTNCPLCRAGIAMISVTTPRYSGPVEVTPGGSGSHLENDGVDEEDHGEIENRVDSDFKESDDSDIRIEIYRFDSDGDGSETETKERVRVLKECMDPNGGDSVNSLSHTKTHVESVDFPGKSCENQSEEFTRHNGEDEASCSEENGGGSNQLRRSCDSGELNGETTGDEGKSQSDISSSTLKTNGSSSSVSCFNKNKSSVFPL

SEQ ID NO: 954 - protein, 317 aa, Arabidopsis thaliana
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFLMEYNDKLLITYLAMITNCSSNMNEMVDKFNTAYDRNTRRGGRTAFM

SEQ ID NO: 955 - protein, 500 aa, Arabidopsis thaliana [sequence omitted]

SEQ ID NO: 956 - protein, 624 aa, Arabidopsis thaliana
MEAVIQTRGLLSLPTKPIGVRSQLQPSHGLKQRLFAAKPRNLHGLSLSFNGHKKFQTFEPTLHGISISHKERSTEFICKAEAAAAGDGAVFGEGDSAAVVASPKIFGVEVATLKKIIPLGLMFFCILFNYTILRDTKDVLVVTAKGSSAEIIPFLKTWVNLPMAIGFMLLYTKLSNVLSKKALFYTVIVPFIIYFGAFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 957 - protein, 384 aa, Arabidopsis thaliana
MPVSVHSVIATNLATTLSSNYRNVSRRRTISTSVNCSVEITEADRSVKLKNGNDSLEICRVLNGMWQTSGGWGKIDRNDAVDSMLRYADAGLSTFDMADHYGPAEDLYGIFINRVRRERPPEYLEKIKGLTKWVPPPIKMTSSYVRQNIDISRKRMDVAALDMLQFHWWDYANDGYLDALKHLTDLKEEGKIKTVALTNFDTERLQKILENGIPVVSNQVQHSIVDMRPQQRMAQLCELTGVKLITYGTVMGGLLSEKFLDTNLTIPFAGPRLNTPSLQKYKRMVDAWGGWNLFQGLLRTMKTISTKHGVSIPTVAVRYVLDQQGVGGSMIGVRLGLAEHIQDANAIFSLVLDEEDVNSIQEVTKKGKDLLQVIGDCGDEYRRI

SEQ ID NO: 958 - protein, 137 aa, Arabidopsis thaliana
MAANMMRPAFAYTVVYVKDVAKSVEFYSRAFGHNVRRLDESHRWGELESGQTTIAFTPLHQHETDDLTGKVQATQSARERAPIEVCFCYPDVDAAFKRAVENGAEAVSKPEDKEWGQKVGYVRDIDGIVVRIGSHVK

SEQ ID NO: 959 - protein, 174 aa, Arabidopsis thaliana
MASASATATLLKPNLPPHKPTIIASSVSPPLPPPRRNHLLRRDFLSLAATSTLLTQSIQFLAPAPVSAAEDEEYIKDTSAVISKVRSTLSMQKTDPNVADAVAELREASNSWVAKYRKEKALLGKASFRDIYSALNAVSGHYVSFGPTAPIPAKRKARILEEMETAEKALTRGR

SEQ ID NO: 960 - protein, 448 aa, Arabidopsis thaliana
MVNSEEIADGFEPKPVSRSYSGDSSHDRSLSDLNHAAEDLSDKLKNVGLNEVTKEQSEKMMSVSESNGGLDSNAVVTINQEEEEEEEDRDGYGYGDGWSENESENVYPVRPGAEDCSFYMRTGSCKFGSSCKFNHPLARKFQIARDNKVREKEDDGGKLGLIDCKYYFRTGGCKYGETCRFNHTIPKSGLASAPELNFLGLPLRPGEVECPYYMRNGSCKYGAECKFNHPDPTTIGGTDSPSFRGNNGVSIGTFSPKATFQASSTSWSSPRHVNGTSPFIPVMLSQTHGVTSQNPEWNGYQASVYSSERGVFSPSTTYLMNNSSAETSMLLSQYRHQMPAEEFPERPDQPECSYYMKTGDCKFKFNCKYHHPKNRLPKLPPYALNDKGLPLRPDQNICTYYSRYGICKFGPACRFDHSVQPPYSTESSQAIVEPPQVSANGNESDGWN

SEQ ID NO: 961 - protein, 310 aa, Arabidopsis thaliana
MGLFESVKSIDWEQESFPTYQDLGFLPLFAVFFPTIRFLLDRFVFEKLASLVIYGRMSTNKSDNIKDRKKNSPKVRKFKESAWKCIYYLSAELLALSVTYNEPWFSNTLYFWIGPGDQIWPDQPMKMKLKFLYMFAAGFYTYSIFALVFWETRRSDFGVSMGHHITTLVLIVLSYICRLTRAGSVILALHDASDVFLEIGKMSKYCGAESLASISFVLFALSWVVLRLIYYPFWILWSTSYQIIMTVDKEKHPNGPILYYMFNTLLYFLLVLHIFWWVLIYRMLVKQVQDRGKLSEDVRSDSESDDEHED

SEQ ID NO: 962 - protein, 1065 aa, Arabidopsis thaliana
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVSDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLPAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 963 - protein, 375 aa, Arabidopsis thaliana
MDLSNRRNPLRDLSFPPPPPPPIFHRASSTGTSFPILAVAVIGILATAFLLVSYYVFVIKCCLNWHRIDILGRFSLSRRRRNDQDPLMVYSPELRSRGLDESVIRAIPIFKFKKRYDQNDGVFTGEGEEEEEKRSQECSVCLSEFQDEEKLRIIPNCSHLFHIDCIDVWLQNNANCPLCRTRVSCDTSFPPDRVSAPSTSPENLVMLRGENEYVVIELGSSIGSDRDSPRHGRLLTGQERSNSGYLLNENTQNSISPSPKKLDRGGLPRKFRKLHKMTSMGDECIDIRRGKDEQFGSIQPIRRSISMDSSADRQLYLAVQEAIRKNREVLVVGDGGGCSSSSGNVSNSKVKRSFFSFGSSRRSRSSSKLPLYFEP

SEQ ID NO: 964 - protein, 568 aa, Arabidopsis thaliana
MDSHSSHLNAANRSRSSQTPSPSHSASASVTSSLHKRKLAATTAANAAASEDHAPPSSSFPPSSFSADTRDGALTSNDELESISARGADTDSDPDESEDIVVDDDEDEFAPEQDQDSSIRTFTAARLDSSSGVNGSSRNTKLKTESSTVKLESSDGGKDGGSSVVGTGVSGTVGGSSISGLVPKDESVKVLAENFQTSGAYIAREEALKREEQAGRLKFVCYSNDSIDEHMMCLIGLKNIFARQLPNMPKEYIVRLLMDRKHKSVMVLRGNLVVGGITYRPYHSQKFGEIAFCAITADEQVKGYGTRLMNHLKQHARDVDGLTHFLTYADNNAVGYFVKQGFTKEIYLEKDVWHGFIKDYDGGLLMECKIDPKLPYTDLSSMIRQQRKAIDERIRELSNCQNVYPKIEFLKNEAGIPRKIIKVEEIRGLREAGWTPDQWGHTRFKLFNGSADMVTNQKQLNALMRALLKTMQDHADAWPFKEPVDSRDVPDYYDIIKDPIDLKVIAKRVESEQYYVTLDMFVADARRMFNNCRTYNSPDTIYYKCATRLETHFHSKVQAGLQSGAKSQ

SEQ ID NO: 965 - protein, 652 aa, Arabidopsis thaliana
MATTAVNLPIHEHPLYPSARCIIGECDGCHVNGYMYNGYFCNEPFCFIWFHKECAEAPAEISHSSHHQHPLLLTNDSIDGPCDLCGQKLLPPCYSCSTCEFKVDLTCAMKPSPPAIEHPLCHHHSLVFLKKREEKVSCELCKDSIAGPSYSCLECDVYFHVNCIQLSKEVNHPCHSAHPLKLIPFESLTDDAETTCLLCGKKPAENMLYHCSVCNFTSCLGCTKNPPLLVIEHIKTHKHPLILFPRRIPCICDICGKKCEFAVYVCPQCDFVTARGCIDLARVININRHDHRIYLTHHLGTGYSKCGVCHENVNQYKGAYSCSVCPHYAVHSTCAVRTDVWDGVELEGTTEITEDNSPFKVVGDNLICHFSHEEHPLRFQKDDVFIHDEHKRCAACIHPLGFGSIYCCETCPFILHEKCANLPMKKRLVFGTRPYTLMKETTQLTDCTLCGIFSDGFAYSSRWLDVDVHCGSLNEPLVHDGHIHPLNFDKMEGHFCDGCKKNIDDYMLRCKACDFDLCLYCATLPKKIWHRNDGHPLTLCCEEKEEASDKYWCDICEKELDPSIWFYTCFDCGVTLHAQCVLGDFSRLVLGQNYWFGEKVKFGAVPNNRNTRPLCIQCQSRCKVSVILKERNEYNRYICSRSCLLSYLGEKI

SEQ ID NO: 966 - protein, 201 aa, Arabidopsis thaliana
MGGKKTKIEIKKIINKPAKTVAFTKRREGLFRKASQLCLLSPATQIAILAAPMTSKSHASFYSFGHSSVDNVVSSLLYDHPPLTANQDNRSGLGFWWEDKRFDVSENVEELKEAVDAVSRMLNNVRCRLNDAVKSTQRDGGLEILHHQEEEVLQTRNDETKTNQTHEFEGGETSGSASWLENEDDILHFDDDFYTGIDPLF

SEQ ID NO: 967 - protein, 460 aa, Arabidopsis thaliana
MQKRELGKSGGNSGGSSGPPAKRGRPFGSTSANSAAAAAAAAAADAMSPSALLGPSLLVHNSFVEQNNRRIVLALQSGLKSEVTWALNTLTLLSFKEKEDIRRDVMPLAKIAGLLDALLLIIDDWRDIALPKDLTRGTRVRTLGTNASVTGFGNEYDALASIQPPGSGIGSSAAEALGKKSTGKHQSSQWWMEEDGLFNLDDEGRSEKQMCAIAASNVIRNFSFMPDNEVVMAQHRHCLETVFQCIHDHMTEDEELVTNSLETIVNLAHLMDLRIFSSLKQSYININEKKAVQAVVGILNSSVKAWNCAAAELLGRLIINPDNEPFISPLIPQIHKRLIDLLSIQAVDAQAAAVGALYNLVEVNMDCRLKLASERWAVDRLLKVIKTPHPVPEVCRKAAMILENLVSEPQNRGLLLAYENAFAELLFQEGKYSDSFARILYELTARSNSRVASARGIWGM

SEQ ID NO: 968 - protein, 385 aa, Arabidopsis thaliana
MKEGKDGFVRADQIDLKSLDEQLERHLSRALTLEKNKKKDEEDTTAVAIGGSASSSPVTLNGGGFVGKRKQRLEWEIDPSKLIIKTVLARGTFGTVHRGIYDGQDVAVKLLDWGEEGHRSEAEIVSLRADFAQEVAVWHKLDHPNVTKFIGATMGASGLQLQTESGPLAMPNNICCVVVEYLPGGALKSYLIKNRRRKLTFKIVVQLALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLTFSEVTSAVVRQNLRPDIPRCCPSALAAVMKRCWDANPDKRPEMDEVVPMLESIDTTKGGGMIPNDQQQGCLCFRRKRGP

SEQ ID NO: 969 - protein, 398 aa, Arabidopsis thaliana
MGGSSETKILQELILYAASAAFSCLVLFAGLRHLDPNREASKKALEHKKEISKRLGRPLVQTNPYEDVIACDVINPDHIDVEFGSIGGLETIKQALYELVILPLKRPELFAYGKLLGPQKGVLLYGPPGTGKTMLAKAIAKESGAVFINVRVSNLMSKWFGDAQKLVSAVFSLAYKLQPAIIFIDEVESFLGQRRSTDHEAMANMKTEFMALWDGFSTDPHARVMVLAATNRPSELDEAILRRLPQAFEIGIPDRRERAEILKVTLKGERVEPDIDFDHIARLCEGYTGSDIFELCKKAAYFPIREILDAERKGKPCLDPRPLSQLDLEKVLATSKKTQVAAGEYSLSSQSSAWRGSREPDEVQAAISGISKLLVSQIINLQSESQDSWQRDPEEDSR

SEQ ID NO: 970 - protein, 534 aa, Arabidopsis thaliana
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEWLTPSDEKTVDLSEKLRLSCEMANPLAAKLRPRRSFSV

SEQ ID NO: 971 - protein, 154 aa, Arabidopsis thaliana
MAGGLGKCSKIRHIVRLRQMLRRWRDQARMSSSFSRCVPSDVPSGHVAVYVGSSCRRFVVRATYLNHPVLRNLLVQAEEEFGFVNQGPLVIPCEESVFEESIRFISRSDSTRSRRFTCPDDFQKNCHVVGIRSKLDLWIESRPLLHGVTEKAVW

SEQ ID NO: 972 - protein, 253 aa, Arabidopsis thaliana
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 973 - protein, 468 aa, Arabidopsis thaliana
MVRGLMKFPGISTKLLNISVNSLCKFRNLERAETLLIDGIRLGVLPDVITYNTLIKGYTRFIGIDEAYAVTRRMREAGIEPDVTTYNSLISGAAKNLMLNRVLQLFDEMLHSGLSPDMWSYNTLMSCYFKLGRHGEAFKILHEDIHLAGLVPGIDTYNILLDALCKSGHTDNAIELFKHLKSRVKPELMTYNILINGLCKSRRVGSVDWMMRELKKSGYTPNAVTYTTMLKMYFKTKRIEKGLQLFLKMKKEGYTFDGFANCAVVSALIKTGRAEEAYECMHELVRSGTRSQDIVSYNTLLNLYFKDGNLDAVDDLLEEIEMKGLKPDDYTHTIIVNGLLNIGNTGGAEKHLACIGEMGMQPSVVTCNCLIDGLCKAGHVDRAMRLFASMEVRDEFTYTSVVHNLCKDGRLVCASKLLLSCYNKGMKIPSSARRAVLSGIRETVSYQAARKTHIKIKAAIECNTLMYP

SEQ ID NO: 974 - protein, 498 aa, Arabidopsis thaliana
MSIFLCFLLLLPLSLIFLKKLLPSKGKLPPGPKGLPIIGNLHQFGRFLHKSLHKISQEYGPVMLLHFGVVPVIIVSSKEGAEEVLKTHDLETCSRPKTVGSGLFTYNFKDIGFAPYGENWREMRKIAVSELFSQKKLKSFRYIREDESQLLVRKVSKSALETPTSSVNLRKVIFTFAASIICRLSFGQNFCDFVDMETVEELVLESETNLGSLAFADFLPAGWIIDRISGQHSTVMKAFSKLTNFFELVIDDHLKSGKIEDHSDIISVMLDMINKPTEVGSYKVTDDHLKGLMSDVFLAGVNAGSITMIWTMTELSRHPRVMRKLQEEIRAALGPNKEKITEEDLEKVEYLKMVIEEAFRLHPPAPLLLPRLTMSDINIQGYSIPKNTMIQINTYTIGRDPKNWTKPDEFIPERFVDNPIEYKGQHFELLPFGAGRRVCPGMATGITIVELGLLSLLYFFDWSLPNGMTTKDIDMEEDGAFVIAKKVSLELVPTLHRW

SEQ ID NO: 975 - protein, 377 aa, Arabidopsis thaliana
MVGSGVGGGDRSKDAVGMMALHEALRSVCFNSDWIYSVFWTIRPRPRVRGGNGCKIGDESGSLMLMWEDGFCGGGRSEDLCLETDIEGHEEDLVRKAFSKMSIQLYNYGEGLMGKVASDKCHKWVFKEPSESEPNLANYWQSSFDALPPEWTDQFESGIQTIAVIQAGHGLLQLGSCKIIPEDLHFVLRMRQMFESIGYRSGFYLSQLFSSNRTATPSSSTVPNQIPQSQGFNWGSHSPLLPSPSFQNQLPASARFGFLQDNNVPPQMLPPMEEHEDDIKWPNGLSLFNALTGRADEASRLLFNQEQNPMNVENQNEFLNLEGHHPNKFRRSYTLPARMDSSSSSTSLDQQQPLEFRNNNSGSNSGLFPDVMETFLR

SEQ ID NO: 976 - protein, 289 aa, Arabidopsis thaliana
MTSSVLTPSLKLLAMTNSSSSTLFCIPSIFNISSSESHRFNFSLSSRPVNLTLSLKSKTLRNSSPVVTFVSQTSNWAEEEEGEDGSIGGTSVTVDESFESEDGVGFPEPPEEAKLFVGNLPYDVDSQALAMLFEQAGTVEISEVIYNRDTDQSRGFGFVTMSTVEEAEKAVEKFNSFEVNGRRLTVNRAAPRGSRPERQPRVYDAAFRIYVGNLPWDVDSGRLERLFSEHGKVVDARVVSDRETGRSRGFGFVQMSNENEVNVAIAALDGQNLEGRAIKVNVAEERTRR

SEQ ID NO: 977 - protein, 644 aa, Arabidopsis thaliana
MVERGKRTHNRFRDNNNDNNRNQRRRLSYESEEKKIDNKDDLVVVYRILCPSGVMGSVIGKSGKVINLIRQETRARIKVVDPFPGCSERVITIFCSVSEKKDIVDIEYSELDYSVPLCSAQAALLKVHDAIVASLATAAENTKIDRDDFRECRLLVPSSQCSIVIGKSGSIIKNIRGRTRANVKVVSKDVSDPSHTCAMDFDNIVMISGETESVKKALFAVSAIMYKVSPREQIPLDTTVQEVPASIIIPSDLSIYPQAGLYPSQDSIFQHGANVSSFIGTLPQGYGENAANPVPVFSASALPVVHGFGGSSRSEKLAIKVICSSSKIGRVIGKGGLTIKGIRQASGSHIEVNDSRTNHDDDCVITVTATESPDDLKSMAVEAVLLLQEKINDEDEDKVKMQLLVSSKVIGCIIGKSGSIISEIRKRTKADIHISKGNNTPKCADPNDELVEISGEVSNVRDALIQIVLRLRDDVLRDRETGSRNQPPARSENNNFFSSSSSNTGLALPQSFMSSVPQVASVDFNRRPETGSSMSMLPSSGGIYGYGSFPVGNTSYGSNSSYSSNLYGGLPQSTTMEVRIPANAVGKVMGRGGGNLDNIRRISGAMIEISDSKNSHGGRVALISGTSEQKRTAENLFQAFIMST

SEQ ID NO: 978 - protein, 309 aa, Arabidopsis thaliana
MASSGDYDEIIKSISDAPPTHYMVKIESFSLLTKHAIERYETESFEAGGYKWKLVLYPNGNKSKNTKDHVSVYLSLADSSSLSPGWEVYAVFRLYLLDQNKDNYLILQGNERRFHSVKREWGFDKFIPTGTFSDASNGYLMEDTCMFGADVFVSKERRSGRGECLSMIKDATSSKHVWKIENFSKLDKESYDSNAFFAGDRKWKIEFYPTGTKQGTGTHLSIYLTLVDPETISDGTKIFVEFTIRIFDQLQGRHIAGKVTKWFSRSSSEHGWVKYVSMVYFTQPNSGLLLKDVCLVEADVCVHGITSAI

SEQ ID NO: 979 - protein, 371 aa, Arabidopsis thaliana
MNKNKIDVKIETKKGSMDEWPEPIVRVQSLAESNLSSLPDRYIKPASLRPTTTEDAPTATNIPIIDLEGLFSEEGLSDDVIMARISEACRGWGFFQVVNHGVKPELMDAARENWREFFHMPVNAKETYSNSPRTYEGYGSRLGVEKGASLDWSDYYFLHLLPHHLKDFNKWPSFPPTIREVIDEYGEELVKLSGRIMRVLSTNLGLKEDKFQEAFGGENIGACLRVNYYPKCPRPELALGLSPHSDPGGMTILLPDDQVFGLQVRKDDTWITVKPHPHAFIVNIGDQIQILSNSTYKSVEHRVIVNSDKERVSLAFFYNPKSDIPIQPLQELVSTHNPPLYPPMTFDQYRLFIRTQGPQGKSHVESHISPR

SEQ ID NO: 980 - protein, 463 aa, Arabidopsis thaliana
MGKVPSSFRSMPANLLVRKTTPSPPAPPRDFRNRTAVGGDSAKLPQNTQAPREPSLRNPFKSPNLSDAKSLFNSIAATSRIPLDLKFHNSVLQSYGSIAVVNDTVKLFQHILKSQPNFRPGRSTFLILLSHACRAPDSSISNVHRVLNLMVNNGLEPDQVTTDIAVRSLCETGRVDEAKDLMKELTEKHSPPDTYTYNFLLKHLCKCKDLHVVYEFVDEMRDDFDVKPDLVSFTILIDNVCNSKNLREAMYLVSKLGNAGFKPDCFLYNTIMKGFCTLSKGSEAVGVYKKMKEEGVEPDQITYNTLIFGLSKAGRVEEARMYLKTMVDAGYEPDTATYTSLMNGMCRKGESLGALSLLEEMEARGCAPNDCTYNTLLHGLCKARLMDKGMELYEMMKSSGVKLESNGYATLVRSLVKSGKVAEAYEVFDYAVDSKSLSDASAYSTLETTLKWLKKAKEQGLVP

SEQ ID NO: 981 - protein, 122 aa, Arabidopsis thaliana
MASKNTTAFFLTINLILFGFTVAQPPTCPRDIEACSNVFGLGRILNYQTVRPCCTLVDGLDAYVASVCICDSIKIYGISYPFTVGLVQVLSLCGADYPPPGFRCRENEISVLSYNNGASMAL

SEQ ID NO: 982 - protein, 240 aa, Arabidopsis thaliana
MCTLEKRGDLFLLTLTGDGEHRFHPDTIATILSLLEQAKSQSTRGSILITTANGKFFSNGFDLAWAQTAGSKTGAANRLHQMVESFKPVVAALLDLPMPTIAALNGHAAAAGLILALSHDYVFMRKDRGVLYMSEVDIGLSMPDYFSALVRAKIGTSAARRELLLSGKKIRGEEAVGLGIVDSAAYDSEEGVVVASVRLGEKLAAKKWSGEVYASIRKSLYPELCGILGLETRVFATPKL

SEQ ID NO: 983 - protein, 140 aa, Arabidopsis thaliana
MASLCSARFLPSPSLDILSTKTKISSDSRSLGCSSSRVFAFSSVHRSSSRRNRNQLQVVSMAPEEEKLTRRNPLDFPIEWERPKPGRRPDIFPKFSPMKTPLPPPMPYDPPEEDEEEEEKKEEEEENPDQEEEEQPEKQQ

SEQ ID NO: 984 - protein, 268 aa, Arabidopsis thaliana
MEMVTSFVYPPPPSILLNCMSVVGVAALANIGWSEIRGNHLKYSKFGVSSSSPQPQKERFGSISSRNGMLLLYTPAFLAAASSFFVVPSDDLRFLLLKSALALHFFKRVFEVLFIHKYSGGMAIDSALTISSSYFSSTALMLYSQNLTLGLTEPSFDMKLAGVVMFVVGIVGNLYHHVLLAKLRKEDGKKEYKIPKGGLFDIIICPHYLFEILVFWSFFLISQTIYSFSFAMGTMLYLIGRSYATRTWYLSKFDDFPKHIKALIPFVF

SEQ ID NO: 985 - protein, 257 aa, Arabidopsis thaliana
MSSMSRSRSRSRSRSRDRFRSRSPRDRRMRSERVSYHDAPSRREREPRRAFSQGNLCNNCKRPGHFARDCSNVSVCNNCGLPGHIAAECTAESRCWNCREPGHVASNCSNEGICHSCGKSGHRARDCSNSDSRAGDLRLCNNCFKQGHLAADCTNDKACKNCRTSGHIARDCRNDPVCNICSISGHVARHCPKGDSNYSDRGSRVRDGGMQRGGLSRMSRDREGVSAMIICHNCGGRGHRAYECPSARVADRGFRRY

SEQ ID NO: 986 - protein, 418 aa, Arabidopsis thaliana
MTKKAVLIGINYPGTKAELRGCVNDVRRMYKCLVERYGFSEENITVLIDTDESSTQPTGKNIRRALADLVESADSGDVLVVHYSGHGTRLPAETGEDDDTGFDECIVPCDMNLITDDDFRDLVDKVPPGCRMTIISDSCHSGGLIDEAKEQIGESTKKEAEDEDESEESSSRFGFRKFLRSKVEGAIESRGFHIGGNKKDEDEAEEIETKEIELEDGETIHAKDKSLPLQTLIDILKQQTGNDNIEVGKIRPSLFDAFGDDSSPKVKKFMKVILGKLQAGNGEEGGLMGMLGKLASGFLEGKLNDEDYVKPAMQTHVGSKEEVYAGGSRGSVPLPDSGILISGCQTDQTSADATPAGKPTEAYGAMSNSIQTILEETDGEISNREMVTRARKALKKQGFTQQPGLYCHDGYANAPFIC

SEQ ID NO: 987 - protein, 209 aa, Arabidopsis thaliana
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 988 - protein, 396 aa, Arabidopsis thaliana
MEETMAARYWCHMCSQMVNPVMESEIKCPFCQSGFIEEMSGNGGGGGGRGIRDVQDSETDFGTDRALSLWAPILLGMMSSPRRRRRFRRSEFGEENDDNGDDLTTNADGNGNDSNNSNNNVYRHHRARRHGGEIDLDREFESILRRRRRSSGNILQLLQGIRAGIASEYESSDNNWDNSRERDRVIMINPYNQSLVVPSDQNQNHPSLTSLGDYFIGPGLDLLLQHLAENDPNRQGTPPARKEAVEALPTVKIMEPLQCSVCLDDFEKGTEAKEMPCKHKFHVRCIVPWLELHSSCPVCRFELPSSADDDDETKTDSERVLRTRNVRETSNGNVVENVGNADRGREDEVRSGNGRRFSFPWPFSGLFSSSSSSSSSTSGSQSGENNFFSRSSGSSR

SEQ ID NO: 989 - protein, 257 aa, Arabidopsis thaliana
MDASNPNSSRKSNVSSFAQSSRSGGRGGGYERDNDRRRPQGRGDGGGGKDRIDALGRLLTRILRHMATELRLNMRGDGFVKVEDLLNLNLKTSANIQLKSHTIDEIREAVRRDNKQRFSLIDENGELLIRANQGHSITTVESEKLLKPILSPEEAPVCVHGTYRKNLESILASGLKRMNRMHVHFSCGLPTDGEVISGMRRNVNVIIFLDIKKALEDGIAFYISDNKVILTEGIDGVLPVDYFQKIESWPDRQSIPF

SEQ ID NO: 990 - protein, 350 aa, Arabidopsis thaliana
MDKYQRVVKPKADTPIDANEIRITSQGRARNYITYAMTLLQDKGSTEVVFKAMGRAINKTVTIVELIKRRIPDLHQNTSIGSTDITDTWEPTEEGLLPLETTRHVSMITITLSKIELNTSSVGYQCPIPIELVKPMGDIDYEGREGSPGGRGRGRGRGRGRGRGRGGRGNAYVNVEHEDGGWEREQSYGRGRGRGRGRSSRGRGRGGYNGPPNEYDAPQDGGYGYDAPHEHRGYDDRGGYDAPPQGRGGYDGPQGRGGYDGPQGRRGYDGPPQGRGGYDGPSQGRGGYDGPSQGRGGYDGPSQGRGGYDGPQGRGRGRGRGRGGRGRGGGRGGDGGFNNRSDGPPVQAAA

SEQ ID NO: 991 - protein, 337 aa, Arabidopsis thaliana
MATMARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 992 - protein, 325 aa, Arabidopsis thaliana
MAIKNILALVVLLSVVGVSVAIPQLLDLDYYRSKCPKAEEIVRGVTVQYVSRQKTLAAKLLRMHFHDCFVRGCDGSVLLKSAKNDAERDAVPNLTLKGYEVVDAAKTALERKCPNLISCADVLALVARDAVAVIGGPWWPVPLGRRDGRISKLNDALLNLPSPFADIKTLKKNFANKGLNAKDLVVLSGGHTIGISSCALVNSRLYNFTGKGDSDPSMNPSYVRELKRKCPPTDFRTSLNMDPGSALTFDTHYFKVVAQKKGLFTSDSTLLDDIETKNYVQTQAILPPVFSSFNKDFSDSMVKLGFVQILTGKNGEIRKRCAFPN

SEQ ID NO: 993 - protein, 367 aa, Arabidopsis thaliana
MGHLIPQTGDEETELGLAAVRLANCAAFPMVFKAAIELGVIDTLYLAARDDVTGSSSFLTPSEIAIRLPTKPSNPEAPALLDRILRLLASYSMVKCQIIDGNRVYKAEPICRYFLKDNVDEELGTLASQLIVTLDTVFLNTWGELKNVVLEGGVAFGRANGGLKLFDYISKDERLSKLFNRTGFSVAVLKKILQVYSGFEGVNVLVDVGGGVGDTLGFVTSKYPNIKGINFDLTCALTQAPSYPNVEHVAGDMFVDVPKGDAILLKRILHDWTDEDCEKILKNCWKALPENGKVIVMEVVTPDEADNRDVISNIAFDMDLLMLTQLSGGKERSRAEYVAMAANSGFPRCNFVCSAYHLWVIELTKQA

SEQ ID NO: 994 - protein, 256 aa, Arabidopsis thaliana
MRAIQTHVITFCMLVIIVTSSTRAQKSPHVPNNHELSIAIEEMEKANYFSFVMLINMLPSVNPRFLANVTFLMPKDKTLSTSNIINQQDSVTEFLLRHSIPSSLLFEHLNLIPNGSIVPSSLPHYTLEISNGGRSNYFLNNVKIISRNICSLGSIKCHGIDGILQSPSTVDDDSPRNNHTLPFISCPSSHNNSDQNSHNNSDQNSSRPADHTLTAPPPVSSPISQPKSDSPSIHDVKMLTSIVIPLFGLLASLIGM

SEQ ID NO: 995 - protein, 530 aa, Arabidopsis thaliana
MEEELRVRLNDHQVSKVFPVKPKSTAKPVSESETPESRYWSSFKNHSTPNLVSSVAALAFSPVHPHSLAVAHSATVSLFSSQSLSSSRRFSFRDVVSSVCFRSDGALFAACDLSGVVQVFDIKERMALRTLRSHSAPARFVKYPVQDKLHLVSGGDDGVVKYWDVAGATVISDLLGHKDYVRCGDCSPVNDSMLVTGSYDHTVKVWDARVHTSNWIAEINHGLPVEDVVYLPSGGLIATAGGNSVKVWDLIGGGKMVCSMESHNKTVTSLRVARMESAESRLVSVALDGYMKVFDYGRAKVTYSMRFPAPLMSLGLSPDGSTRVIGGSNGMVFAGKKKVRDVVGGQKKSLNLWSLISDVDESRRRALRPTYFRYFQRGQSEKPSKDDYLVKEKKGLKLTRHDKLLKKFRHKEALVSVLEEKKPANVVAVMEELVARRKLMKCVSNMEEGELGMLLGFLQRYCTVQRYSGLLMGLTKKVLETRAEDIKGKNEFKGLLRNLKREVNQEIRIQQSLLEIQGVIAPLMRIAGRS

SEQ ID NO: 996 - protein, 694 aa, Arabidopsis thaliana
MESLIEEEEESRFFDAHEEIASCSSPCKIESPSSISGEFRYDVWIKSPGNTEERREKFLKWMGLSSTVNESKSGNVYRLSSSVNESAVLMSLKSDDDEFSSSRCDSFSPSESVDRVVNESLCKEEGEVDSGMVLRNLGFVDDGDISSSLCSLSSSPVSDKIVKEHGEPKLLPDPMVAEEEREVSGIMKRVKEKWLSRLYKVRNKRSAGGDDNGGEVAVCGSRIERVKVKEYKKEAKELSALFKGQEIQAHEGAILAMKFSPDGRYLASAGEDGVLRVWSVVEDERCEEHDVPKIDPSCIYFEVSKLSELRPVAVEKDGITGSLMSPRKTTESACVIIPPKIFRVLDKPLHEFLGHSGDILDISWSKNNKTRPTSVDNSVRLWQIGCEDCLGIFSHNNYVTSVQFNPVDDDHFISGSIDGKVRIWSASQCQVVDWADARGIVTAVCYQPDGQAVIIGTLTSDCRFYNVSGHCLQLDGHICLHNKKKSSNKRIIGFQFDSTDPSRVMVASADSQVRIISGRNVVHKYKGSRNAGNQISASFTADGKHIVSACDDSSVYVWNCVGHDPEQSSPGFFSHTKRLKIRSFEKFSADVSVAIPWCGFTPVLSGGSELSPSLFSLGREYVLDSPKGSATWPEEKLASSFSPVKAIRRSHYKFLRSSCRRTSESSHLWGLVIVTGGWDGRIKLFHNYGLPVPV

SEQ ID NO: 997 - protein, 359 aa, Arabidopsis thaliana
MDMESKKPYLMVTIIQVIYTIMFLISKAVFNGGMNTFVFVFYRQAFATIFLAPLAFFFERKSAPPLSFVTFIKIFMLSLFGVTLSLDLNGIALSYTSATLAAATTASLPAITFFLALLFGMERLKVKSIQGTAKLVGITVCMGGVIILAIYKGPLLKLPLCPHFYHGQEHPHRNNPGHVSGGSTSWLKGCVLMITSNILWGLWLVLQGRVLKVYPSKLYFTTLHCLLSSIQSFVIAIALERDISAWKLGWNLRLVAVIYCGFIVTGVAYYLQSWVIEKRGPVFLSMFTPLSLLFTLLSSAILLCEIISLGSIVGGLLLIIGLYCVLWGKSREEKNSGDDKIDLQKENDVVCNEVKVVIS

SEQ ID NO: 998 - protein, 305 aa, Arabidopsis thaliana
MERSRVTREAPTGTRILLASLSAMVAESVTFPIDLTKTRMQLHGSGSASGAHRIGAFGVVSEIARKEGVIGLYKGLSPAIIRHLFYTPIRIIGYENLKGLIVRSETNNSESLPLATKALVGGFSGVIAQVVASPADLVKVRMQADGRLVSQGLKPRYSGPIEAFTKILQSEGVKGLWKGVLPNIQRAFLVNMGELACYDHAKHFVIDKKIAEDNIFAHTLASIMSGLASTSLSCPADVVKTRMMNQGENAVYRNSYDCLVKTVKFEGIRALWKGFFPTWARLGPWQFVFWVSYEKFRLLAGISSF

SEQ ID NO: 999 - protein, 497 aa, Arabidopsis thaliana
MPQAPMPEFSSSVKLKYVKLGYQYLVNHFLSFLLIPIMAIVAVELLRMGPEEILNVWNSLQFDLVQVLCSSFFVIFISTVYFMSKPRTIYLVDYSCYKPPVTCRVPFATFMEHSRLILKDKPKSVEFQMRILERSGLGEETCLPPAIHYIPPTPTMDAARSEAQMVIFEAMDDLFKKTGLKPKDVDILIVNCSLFSPTPSLSAMVINKYKLRSNIKSFNLSGMGCSAGLISVDLARDLLQVHPNSNAIIVSTEIITPNYYQGNERAMLLPNCLFRMGAAAIHMSNRRSDRWRAKYKLSHLVRTHRGADDKSFYCVYEQEDKEGHVGINLSKDLMAIAGEALKANITTIGPLVLPASEQLLFLTSLIGRKIFNPKWKPYIPDFKLAFEHFCIHAGGRAVIDELQKNLQLSGEHVEASRMTLHRFGNTSSSSLWYELSYIESKGRMRRGDRVWQIAFGSGFKCNSAVWKCNRTIKTPKDGPWSDCIDRYPVFIPEVVKL

SEQ ID NO: 1000 - protein, 433 aa, Arabidopsis thaliana
MEPRVGNKFRLGRKIGSGSFGEIYLGTDVQTNEEVAIKLESVKTAHPQLSYESRIYRVLQGGTGIPNMKWYGVEGDYNVLVMDLLGPSLEDLFSYCKRQFSLKTVLMLADQMINRLEFIHSKSYLHRDIKPDNFLMGLGRRANQVYIIDYGLAKKYRDSSTHRHIPYRENKSLIGTPRYASLNTHLGIEQSRRDDIESLGYILMYFLKGSLPWQGLKAGNKKQKYDKISEKKVSTSIETLCRGHPTEFASYFHYCRSLRFDDKPDYAYLKRLFRNLFIREGFQFDFVFDWTVYKYQQSQSGNPQPRPHDGGVGTSSGLNPAVGNSEKRPDVPNQRTNPDFTLKQKDKNGNDSAIAKDKLLPGSLNLGRSEGSSSRRVVDTSSREPFSGGSDNANYETALKGIDGLRINNNAGDETAATPQSNGDDVEPQSKAL

SEQ ID NO: 1001 - protein, 484 aa, Arabidopsis thaliana
MAAKKVFGSAEASNLVTELRRSFDDGVTRGYEWRVTQLKKLMIICDNHEPEIVAALRDDLGKPELESSVYEVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKIGRVIMAAAAKHLTPVVLELGGKSPVVVDSDTDLKVTVRRIIVGKWGCNNGQACVSPDYILTTKEYAPKLIDAMKLELEKFYGKNPIESKDMSRIVNSNHFDRLSKLLDEKEVSDKIVYGGEKDRENLKIAPTILLDVPLDSLIMSEEIFGPLLPILTLNNLEESFDVIRSRPKPLAAYLFTHNKKLKERFAATVSAGGIVVNDIAVHLALHTLPFGGVGESGMGAYHGKFSFDAFSHKKAVLYRSLFGDSAVRYPPYSRGKLRLLKALVDSNIFDLFKVLLGLA

SEQ ID NO: 1002 - protein, 266 aa, Arabidopsis thaliana
MASFVESGWQYLVTHFSDFQLACIGSFLLHESVFFLSGLPFIFLERQGFLSKYKIQTKNNTPAAQGKCITRLLLYHFSVNLPLMLASYPVFRAMGMRSSFPLPSWKEVSAQILFYFIIEDFVFYWGHRILHSKWLYKNVHSVHHEYATPFGLTSEYAHPAEILFLGFATIVGPALTGPHLITLWLWMVLRVLETVEAHCGYHFPWSLSNFLPLYGGADFHDYHHRLLYTKSGNYSSTFVYMDWIFGTDKGYRRLKTLKENGDMKQT

SEQ ID NO: 1003 - protein, 327 aa, Arabidopsis thaliana
MATSSPSLSNNGLSSVVTPPKTLRGLNKPKCIQCGNVARSRCPFQSCKGCCSRAENPCPIHVLKVASTSGEKTQAPSTPSSEQKATEGTPGSTTRVSSIRQLSSNFAQFNNLNASSRQRKPLTIKDAQALNEWRFTKLKEYRDRNIEVENEAFDRYMSNVNLLEEAFSFTSVPDEESHGTAAPEQNKEENIVSELKLRLRSNSARTESFKKRIAETVKAGLVKLKRLDLGSSSDDQDDIKRRVKRKKWEEKGSALNEIIDKLNKARTEEDLKSCLEMKSKLCGQVSPTAASEKNKIFPGVVRKVEMSEEALQKIAENLQSFDKVGML

SEQ ID NO: 1004 - protein, 297 aa, Arabidopsis thaliana
MRTKSPSSLNLKVIFIGSSILILIIIYLARSNISSSSSKPISKTNLSQEEEETQHKQEGCPTTQQCTKMPLSLSDALVHYVTSNVTPQQTFDEVSVSKRVLDKKSPCNFLVFGLGHDSLMWASLNHGGRTLFIEEDQAWIAIVTKKFPNLESYHVVYDTKVKDSDKLMELGRSEECRSVSDPRNSKCDLALKDFPADFYETKWDLIMVDAPTGYHEEAPGRMSAIYTAGLLARNREDGETDVFVHDVNRPVEDEFSATFLCKGYMREQNGRLRHFTIPSHRARAGRPFCPVEVDRRR

SEQ ID NO: 1005 - protein, 124 aa, Arabidopsis thaliana
MDQRIAAIPVFRWSRSRRKIHIRRRKSQVVRLGGKNSAVSRGGFSLKKMVRRMKLRWLKLHYVRVVKKIKVFYRNLVKEFVDAGAELEAIQQRMAVEAAAFAVPGLGLSFSSFSVHDRARYFLV

SEQ ID NO: 1006 - protein, 211 aa, Arabidopsis thaliana
MVSPFRSPCSSPKKSRKASKNPYSNRGLDKFSELLSELDEKRQSIYSKKLDSGGPPLVRFVFTSSGECVPVVIRSSYLHKKNKKTKDVVADKVKTEVKEAKTEEIKNTEPETEQKQSCVINENLKKIARPDHFLPVTVILVLVFLAFFGRSVAIMFTCIAWYLVPTIQEQSGNRGSSPSYAMKKKDFARKLSIENRTSFNPRTVRDHSPRK

SEQ ID NO: 1007 - protein, 264 aa, Arabidopsis thaliana
MAVDLLSENSNMSPRISFSRDFCQSDAIPIEKRPLRSSNSKPSSLNSSIDFDFCIPGGVNSGESFDQGSWSADELFSNGKILPTEIKKKPEPGKKEPEPKPVKSKPDSRKQRKQPNEEQQEDDVIITTEEKTNTKSFWGFKRSSSLNCGSTYGRSLCPLPLLNRSNSTGSTSSKQKQSSSRKHNEHVKLQQSSSLSSSSSASSSLSNNGFSKPPLKKSYGGYSYGSHGGGGIRVSPVINVVPSGNLFGFGSMFSGNGRDKNKKR

SEQ ID NO: 1008 - protein, 147 aa, Arabidopsis thaliana
MAEEFHLPLNLTEPDQTPTEEDFEADTTLIDDEYLRYLHYLDSRSNHGVNTFGSYDEIFGLVLGNSSSCTRWLNAGEELPVVEFTAEEMMERGLVVCAICREELAANERLSELPCRHYYHKECISNWLSNRNTCPLCRHNVELPNHG

SEQ ID NO: 1009 - protein, 628 aa, Saccharomyces cerevisiae
MDPGIANHTLPEEFEEVVVPEMLEKEVGAKVDVKPTLTTSSPAPSYIELIDPGVHNIEIYAEMYNRPIYRVALFFSLFLIAYAYGLDGNIRYTFQAYATSSYSQHSLLSTVNCIKTVIAAVGQIFFARLSDIFGRFSIMIVSIIFYSMGTIIESQAVNITRFAVGGCFYQLGLTGIILILEVIASDFSNLNWRLLALFIPALPFIINTWISGNVTSAIDANWKWGIGMWAFILPLACIPLGICMLHMRYLARKHAKDRLKPEFEALNKLKWKSFCIDIAFWKLDIIGMLLITVFFGCVLVPFTLAGGLKEEWKTAHIIVPEVIGWVVVLPLYMLWEIKYSRHPLTPWDLIQDRGIFFALLIAFFINFNWYMQGDYMYTVLVVAVHESIKSATRITSLYSFVSVIVGTILGFILIKVRRTKPFIIFGISCWIVSFGLLVHYRGDSGAHSGIIGSLCLLGFGAGSFTYVTQASIQASAKTHARMAVVTSLYLATYNIGSAFGSSVSGAVWTNILPKEISKRISDPTLAAQAYGSPFTFITTYTWGTPERIALVMSYRYVQKILCIIGLVFCFPLLGCAFMLRNHKLTDSIALEGNDHLESKNTFEIEEKEESFLKNKFFTHFTSSKDRKD

SEQ ID NO: 1010 - protein, 776 aa, Agrobacterium tumefaciens
MTVEDMTSHDKNNTPANTAKADIEEQALFFHRYPRPGKLEIQATKPLGNQRDLALAYSPGVAAPCLAIHENPEMAAEYTARANLVAVISNGTAVLGLGNIGPLASKPVMEGKAVLFKKFAGIDVFDIEIDAPGINDMVSTIAALEPTFGGINLEDIKAPECFEVERQLREKMNIPVFHDDQHGTAIIVAAAVTNALELAGKSLSSVKIVASGAGAAALACLNLLVAMGANKENIWVHDIEGLVYEGRNTLMDEWKEVYAQKTDKRVLADSIDGADVFLGLSAAGVLKPELLERMAENPLILALANPNPEIMPEAARAARPDAMICTGRSDFPNQVNNVLCFPYIFRGALDCGATTINEEMKMAAVQAIAELAREEVSEVAARAYSGETPIFGPNYLIPSPFDPRLILRIAPAVARAAAASGVATRPITDFEAYFDQLNRFVWRSGFIMKPVFNAAKAAEKKRIIFAEGEDERVLRAAQVLLEEGTGVPILIGRPQIIETRLKRFGLRIRPHADFAVVNPEDDPRYREYVDDYFALVGRAGINPEAARTIVRTNSTVIGALSVKRGEADALICGLEGRYDRHLRDVNQIIGKQESVRSFAGLSLLITQQGALFLTDTFVNNDPTSEEVAEMAILAAKEIRRFGITPKIALASHSNFGSRDSESARKMRRALKIIQQAAPELEVDGEMQGGSALSEALRKRAMPNSVLTGEANLLVFPNLDAANITLGVTRTLTEGLHVGPILLGTALPAHILSPSVTSRGVVNMAAFAVVQASHPSV

SEQ ID NO: 1011 - protein, 332 aa, Saccharomyces cerevisiae
MVRVAINGFGRIGRLVMRIALQRKNVEVVALNDPFISNDYSAYMFKYDSTHGRYAGEVSHDDKHIIVDGHKIATFQERDPANLPWASLNIDIAIDSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSNSSIFDAAAGIQLSPKFVKLVSWYDNEYGYSTRVVDLVEHVAKA

SEQ ID NO: 1012 - protein, 638 aa, Arabidopsis thaliana
MESTIVMMMMITRSFFCFLGFLCLLCSSVHGLLSPKGVNFEVQALMDIKASLHDPHGVLDNWDRDAVDPCSWTMVTCSSENFVIGLGTPSQNLSGTLSPSITNLTNLRIVLLQNNNIKGKIPAEIGRLTRLETLDLSDNFFHGEIPFSVGYLQSLQYLRLNNNSLSGVFPLSLSNMTQLAFLDLSYNNLSGPVPRFAAKTFSIVGNPLICPTGTEPDCNGTTLIPMSMNLNQTGVPLYAGGSRNHKMAIAVGSSVGTVSLIFIAVGLFLWWRQRHNQNTFFDVKDGNHHEEVSLGNLRRFGFRELQIATNNFSSKNLLGKGGYGNVYKGILGDSTVVAVKRLKDGGALGGEIQFQTEVEMISLAVHRNLLRLYGFCITQTEKLLVYPYMSNGSVASRMKAKPVLDWSIRKRIAIGAARGLVYLHEQCDPKIIHRDVKAANILLDDYCEAVVGDFGLAKLLDHQDSHVTTAVRGTVGHIAPEYLSTGQSSEKTDVFGFGILLLELVTGQRAFEFGKAANQKGVMLDWVKKIHQEKKLELLVDKELLKKKSYDEIELDEMVRVALLCTQYLPGHRPKMSEVVRMLEGDGLAEKWEASQRSDSVSKCSNRINELMSSSDRYSDLTDDSSLLVQAMELSGPR

SEQ ID NO: 1013 - protein, 318 aa, Arabidopsis thaliana
MILAHLPRFHLSILAKPSFSLSSSHFSFLNPKPSVTVSRTLFSFASKSNLATVEPIPLSVSDSTDLDDAPVEIALDKLFIPPETDISGEDSASLTTRILKGSNIVLSKYARDAQVVQADYVKSSVKTEDCPADGLPEFALVGRSNVGKSSLLNSLVRRKRLALTSKKPGKTQCINHFRINDKWYLVDLPGYGYASAPHELKQDWNKFTKDYFLNRSTLVSVFLLVDASIPVKPIDLEYASWLGQNQVPMTLIFTKCDKRKKKKNGGKKPEANIKEFQDLIQGFFETTPPWIMTSSVTNQGRDEILLHMAQLRNYWLKH

SEQ ID NO: 1014 - protein, 330 aa, Arabidopsis thaliana
MSLTELDDGLVRRMAMGAVFSDFGGKIHSVGFHRTDDLLVTSSEDDSLRLFDIANAKQLKITYHKKHGTDRVCFTHHPSSLICSSRYNLESTGESLRYLSMYDNRILRYFKGHKDRVVSLCMSPINDSFMSGSLDRSVRLWDLRVNACQGILHLRGRPAVAYDQQGLVFAIAMEGGAVKLFDSRCYDKGPFDTFLVGGDTAEVNDIKFSNDGKSMLLTTTNNNIYVLDAYRGEKKCGFSLEPSQGTPIEATFTPDGKYVLSGSGDGTLHAWNIENPSEVARWENNIGVVSCLKWAPRRAMFVAASTVLTFWIPNDGESPAPADPPTDQQQ

SEQ ID NO: 1015 - protein, 271 aa, Arabidopsis thaliana
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGGFTVNGFSFKPLP

SEQ ID NO: 1016 - protein, 295 aa, Arabidopsis thaliana
MAELQLVEGHQINGGFIPPAIINSIEAPETSAAAGVSVGSKRLRRPSVRLGDIGGDQYHQHVVAAYDSPQVRRPKWRPSGGGGGGGGNRKEPNNQSGKTTSSSRTRTMTNLSSGGYENTGTLDEDPVSIGSWRVKKWVKSSGGETAATTTTNTASAKRVRSNWATRNDGVEQGDEKFSGEEEEEEEDEELGGEEGFRDFSREDSESPMKERRRYENREVELLGDWQSGGRGKEGVKIWLQELGLGRYWPMFEMHEVDEQVLPLLTLEDLKDMGINAVGSRRKMYCAIQKLGREFS

SEQ ID NO: 1017 - protein, 115 aa, Arabidopsis thaliana
MENRSEMGNRRQQNLFVIASPDEIAKIHRAETSKQAGAIAGAKAAAVAAVASAIPTVAAVRMFPWAKANLNYTAQALIISSASIAAFFITADKTILQGARRNTEAQLKKVQQDSK

SEQ ID NO: 1018 - protein, 529 aa, Arabidopsis thaliana
LIDLSGLNCIRVSRRNYILMDPHKKVALETEFFTEYGEASRYQIQEVIGKGSYGVVASAIDTHSGEKVAIKKINDVFEHVSDATRILREIKLLRLLRHPDIVEIKHVMLPPSRREFRDIYVVFELMESDLHQVIKANDDLTPEHYQFFLYQLLRGLKFIHTANVFHRDLKPKNILANSDCKLKICDFGLARVSFNDAPSAIFWTDYVATRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKITKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQTGYSARSLLKSASISASKCIGMKPRNKSEYGESNNDTVDALSQKVAALHT

SEQ ID NO: 1019 - protein, 245 aa, Arabidopsis thaliana
MASSEGLASVDPWSFRQNFNIDSWLLSDSFSHDSDILAKALHRSISTSTESSPLSPSSFFDSSTAAVDFSPPQTLSNVSFGSDPEIPAASALGLGKRKRGPGVSGGKQTKRRSRVSNKKSQTTFITADAANFRQMVQQVTGAKFLGSSNSIFAPIVKPEPHRLASRLPPSCGNLDRSSAVPTLDTSSFLSNHHQENIITDLGAPTGSFHHQSSAGTTTANVGGGSSAVELDSYPSFPTLESWKVM

SEQ ID NO: 1020 - protein, 232 aa, Arabidopsis thaliana
MPKRTTHTYSSEDAAPDGPDSDLFVYYCKHCGSHVLITDTQLQKMPKRKTDRSNVLDKKTHLARLNVSEGGKVLLKRGEGKMERQFRMNCIGCELFVCYRAEENLETASFIYIVDGALSAVAAETNPQDAPVPPCISQLDGGLVQVAIEVEDRAQRSAITRVNADDVRVTVAAPAARGEANNELLEFMGRVLGLRLSQMTLQRGWNSKSKLLVVEDLSARQVYEKLLEAVVP

SEQ ID NO: 1021 - protein, 581 aa, Arabidopsis thaliana
MTGLGVRSSSYGSLEKTGLNGVVLPIQITTTTRTKPSKMQKDREGIVHWICKFAGRKKVGMLLLFLISAVVFLRVLYVGKGEDSQEGQGPPSLHFNGSSGVNYSNMLQTNEELNMNIGNISFKAKEVIVFPPPPIHFLGYSLPQGHPCNSFTLPPPPADRKRTGPRPCPVCYLPVEEAVALMPNAPSFSPVLKNLTYIYEEPLNRETEFGGSDFGGYPTLKHRNDSFDIKETMSVHCGFVKGPQPGRNTGFDIDEADLLEMKQCRGIVVASAVFDAFDDVKAPQNISKYAEETVCFYMFVDEETESILKRERGLDGNKKVGIWRVVVVHNLPYSDGRRNGKVPKLLVHRMFPNARYSLWIDGKLELVVDPYQILERFLWRKNATFAISRHYKRFDVLVEAEANKAAGKYDNASIDFQVDFYKNEGLTPYSVAKLPITSDVPEGCVILREHVPISNLFTCLWFNEVDRFTSRDQISFSTVRDKIAAKTNWTVSMFLDCERRNFVVQRYHRAEQERFARQRPPVPNFPPPPPSPPPPVLISSDLPRKMSSGRATPPRRRGRDRRSGQRGHRKANLPVRLPDSA

SEQ ID NO: 1022 - protein, 466 aa, Arabidopsis thaliana
MASKSDVNIIETSSKVHFSGFHQMDGLASNRPEQMAEEEEHGQPFVIGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDADADVRLARRIKRDTVEKGRDIATVLDQYSKFVKPAFEDFILPTKKYADIIIPRGGDNHVAIDLIVQHIHTKLGQHDLCKIYPNLYVIQSTFQIRGMHTLIRDSKTTKHDFIFYSDRLIRLVVEHGLGHLPFTEKQVVTPTGSVYSGVDFCKKLCGVSVIRSGESMENALRACCKGIKIGKILIHREGDNGQQLIYEKLPSDISERHVLLLDPILGTGNSAVQAIRLLISKGVPESNIIFLNLISAPEGVNVVCKKFPRIKIVTSEIELGLNDEFRVVPGMGEFGDRYFGTDDE

SEQ ID NO: 1023 - protein, 636 aa, Arabidopsis thaliana
MGKSSKKSVTEVETPASMTKPLKKGKRDAEEDLDMQVTKKQKKELIDVVQKEKAEKTVPKKVESSSSDASDSDEEEKTKETPSKLKDESSSEEEDDSSSDEEIAPAKKRPEPIKKAKVESSSSDDDSTSDEETAPVKKQPAVLEKAKVESSSSDDDSSSDEETVPVKKQPAVLEKAKIESSSSDDDSSSDEETVPMKKQTAVLEKAKAESSSSDDGSSSDEEPTPAKKEPIVVKKDSSDESSSDEETPVVKKKPTTVVKDAKAESSSSEEESSSDDEPTPAKKPTVVKNAKPAAKDSSSSEEDSDEEESDDEKPPTKKAKVSSKTSKQESSSDESSDESDKEESKDEKVTPKKKDSDVEMVDAEQKSNAKQPKTPTNQTQGGSKTLFAGNLSYQIARSDIENFFKEAGEVVDVRLSSFDDGSFKGYGHIEFASPEEAQKALEMNGKLLLGRDVRLDLANERGTPRNSNPGRKGEGSQSRTIYVRGFSSSLGEDEIKKELRSHFSKCGEVTRVHVPTDRETGASRGFAYIDLTSGFDEALQLSGSEIGGGNIHVEESRPRDSDEGRSSNRAPARGAPRGRHSDRAPRGGRFSDRAPRGRHSDRGAPRGRFSTRGRGPSKPSVMESSKGTKTVFNDEE

SEQ ID NO: 1024 - protein, 153 aa, Arabidopsis thaliana
MNKGCGSGSDSCLSSMEEELHVLAVDDNLIDRKLVERILKISSCKVTTAENGLRALEYLGLGDPQQTDSLTNVMKVNLIITDYCMPGMTGFELLKKVKESSNLKEVPVVILSSENIPTRINKCLASGAQMFMQKPLKLSDVEKLKCHLLNCRS

SEQ ID NO: 1025 - protein, 374 aa, Arabidopsis thaliana
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQLEQEVLEKEIGRLRALYQQQQQTQKPSASRGRATSKDLDSQFSSLSLNTKDSNCRRDSVSVMGQFHF

SEQ ID NO: 1026 - protein, 351 aa, Arabidopsis thaliana
MDAFRRQASKLRDQVAKQQLAVIKQFSGTGYESSDVMVIDELEMQRHHQLDKLYRSTRSAKEFQRDIVKAAEAFTTIGLRHIEAGTKLSEDCCRYGNENSQNIDENILAKAAAIYGDARKHVDKEQEDFNKLLASQVLDPLRAMVAGSPLEDARHLAQRYSRMRQEAETHATEVSRRQARVREAPIPENVAKLQLAEAKMQELKANMAVLGKEATAALAAVESQQHRLTFQRLVAMVEGEKNYHLRIAAILSDIEAEMVTEKQHKESAPPAIPTENGSEKTSYFLAEVIHPFSAASEKELDLDKGDYIVVRKVSQTGWAEGECKGKAGWFPMAYIEKRQRLPTTNFAAEVY

SEQ ID NO: 1027 - protein, 644 aa, Saccharomyces cerevisiae
MSKVYLNSDMINHLNSTVQAYFNLWLEKQNAIMRSQPQIIQDNQKLIGITTLVASIFTLYVLVKIISTPAKCSSSYKPVKFSLPAPEAAQNNWKGKRSVSTNIWNPEEPNFIQCHCPATGQYLGSFPSKTEADIDEMVSKAGKAQSTWGNSDFSRRLRVLASLHDYILNNQDLIARVACRDSGKTMLDASMGEILVTLEKIQWTIKHGQRALQPSRRPGPTNFFMKWYKGAEIRYEPLGVISSIVSWNYPFHNLLGPIIAALFTGNAIVVKCSEQVVWSSEFFVELIRKCLEACDEDPDLVQLCYCLPPTENDDSANYFTSHPGFKHITFIGSQPVAHYILKCAAKSLTPVVVELGGKDAFIVLDSAKNLDALSSIIMRGTFQSSGQNCIGIERVIVSKENYDDLVKILNDRMTANPLRQGSDIDHLENVDMGAMISDNRFDELEALVKDAVAKGARLLQGGSRFKHPKYPQGHYFQPTLLVDVTPEMKIAQNEVFGPILVMMKAKNTDHCVQLANSAPFGLGGSVFGADIKECNYVANSLQTGNVAINDFATFYVCQLPFGGINGSGYGKFGGEEGLLGLCNAKSVCFDTLPFVSTQIPKPLDYPIRNNAKAWNFVKSFIVGAYTNSTWQRIKSLFSLAKEAS

SEQ ID NO: 1028 - protein, 358 aa, Glycine max
MTNDNIAVTDLTSALNEDNRADLVNALKSKIQSLAGAHSDVLETLSPNVRKRVESLREIQGKHDELEADFLKEREALEAKYQKLYQPLYTKRYEIVNGVTEVEGAANESTDESEENKEKGVPSFWLNAMKNNDVLAEEISERDEGALKFLKDIKWSRIENPKGFKLDFFFDTNPYFSNTVLTKTYHMIDEDEPILEKAIGTEIEWYPGKCLTQKVLKKKPKKGSKNAKPITKTESCESFFNFFKPPEVPEDDADIDEDLAEELQNQMEQDYDIGSTLRDKIIPHAVSWFTGEAAQGDEFEDLEDDEDEEEDEDEDEDEEDDEDEDDEEEDDTKTKKKKSGKAQAGDGDGERPPECKQQ

SEQ ID NO: 1029 - protein, 274 aa, Glycine max
MRAKLFVFPIRGRNWCFSRTIDHSLSASHASSQSPSTLKDLWTNINVGDKPLNTKTELFVDYIANKMNNAWIGLEKAPEGSFKNKIHGLGLRLLSRVKPSEIFLKSISKEITSVEIIYPSSLNAQLVRRRLRHIAVRGAVIHRNYLYGLVSLIPLTSALSILPLPNVPFFWVLFRTYSHWRALQGSERLFQLVSDNSKTSNTCTYEKKTEHKESKSQRHSSNEPCWVLRPSKELENLVHLEDGQESLSQHAIINICKIYDLNPVDVIKYEKSVF

SEQ ID NO: 1030 - protein, 316 aa, Glycine max
MMSFAMDSVSVLNPKLSHSHSSLPFSRFPHSLNFHPLLKPRAVNAAVPRNGLAACFLTLHRRKPLTVAFTASHQDSEHREIEVEKERDVHAGSEESQEAWKQVLETFREQAEKFQGVSQEAYEVYSKKAAVILTDATEQLKVLADKTKNELSVAAKEITDEGKEYLSAAADSSPEVKEIVETFTSPPEDIQKLSGVRDFYVGVPYGLMLSLGGFLSFMVTGNTAAIRFGMILGGVLLALSILSLKSYKKGRTSPLALKGQAAIASILFLREISSIGKGSSYFTALISGAVVAFYIYRIVLERNHQKSSNLETEPGN

SEQ ID NO: 1031 - protein, 270 aa, Glycine max
MVDNDSLSEFLASAVDAAQKAGEIIRKGFYQTKNVEHKGQVDLVTETDKACEELIFNHLKQLYPTHKFIGEETTAAYGTTELTDEPTWIVDPLDGTTNFVHGFPFVCVSIGLTIGKTPTIGVVYNPIINELFTGIHGKGAFLNGNPIKVSSQTELISSLLATEAGTKRDKETVDASTDRIKSLLFKVRSLRMSGSCALNLCGIACGRLDVFFELGFGGPWDVAGGAVIVREAGGVVFDPSGADFDITSQRVAASNPFLKDALVDTLRQMV

SEQ ID NO: 1032 - protein, 346 aa, Glycine max
MEAQIHLLEQEAYSAVLRAFKAQSDALTWEKEGLITELRKELRVSDDEHRELLTRVNSDEIIHRIREWRQTGCYQPARRSTSQPGHDILPSPTVSASRKKQKTSHSGQSLPALSSVKSVQYTSAGPTGGRHFANRSSSALASNVPAEAAAFDPLIGKKVWTRWPEDNHFYEAVVTDYNPADGRHALVYDINKVNETWEWVDLKEISPEDIRWEGEDPGVLHRGGHGGQGRGGRKFFGHGGDSLGAGRGRGHPRFQARQEFLPPQNGIGRRVLDDIELLNTDSLVKEVERIFASSPPDSMELEKAKQMLKEHEQALVDAIARIADASDGESDGEQPFLQHGQLMERG

SEQ ID NO: 1033 - protein, 413 aa, Glycine max
MGSLGAILKHPDDFYPLLKLKMAARNAEKQIPPEPHWAFCYTMLHKVSRSFALVIQQLGTELRNAVCIFYLVLRALDTVEDDTSIETDVKVPILIAFHRHIYDRDWHFSCGTKEYKVLMDQFHHVSTAFLELGKNYQEAIEDITKRMGAGMAKFICKEVETIDDYDEYCHYVAGLVGLGLSKLFHASGSEDLAPDDLSNSMGLFLQKTNIIRDYLEDINEIPKSRMFWPRQIWSEYVNKLEDLKYEENSVKAVQCLNDMVTNALMHAEDCLKYMAALRDPPIFRFCAIPQIMAIGTLALCYNNIEVFRGVVKMRRGLTAKVIDRTKTMADVYGAFFDFASMLEPKVDKNDPNATKTLSRLEAIQKTCRESGLLSKRKSYIVNDESGYGSTMIVILVIMVSIIFAYLSANHHNS

SEQ ID NO: 1034 - protein, 721 aa, Glycine max
MSLSAFSFPLHLRQTTPPSDPKTSSTPLPLSSHSHWGADLLTQSQRKLNQVKRRPHGVCASLSEMGEYYSQKPPTPLLDTINYPIHMKNLATKKLKQLADELRSDVIFHVSRTGGHLGSSLGVVELTIALHYVFNAPKDKILWDVGHQSYPHKILTGRRDKMHTMRQTDGLAGFTKRSESDYDCFGTGHSSTTISAGLGMAVGRDLKGDKNNVVAVIGDGAMTAGQAYEAMNNAGYLDSDMIVILNDNKQVSLPTANLDGPIPPVGALSSALSKLQSNRPLRELREVAKGVTKQIGGPMHELAAKVDEYARGMISGSGSTLFEELGLYYIGPVDGHNIDDLVSILNEVKSTKTTGPVLLHVVTEKGHGYPYAERAADKYHGVTKFDPATGKQFKSNAATQSYTTYFAEALIAEAEADKDIVGIHAAMGGGTGMNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGIGVELPLGNKGIPLEIGKGRILIEGERVALLGYGSAVQSCLAAASLLEHHGLRATVADARFCKPLDRSLIRSLAQSHEVLITVEEGSIGGFGSHVVQFMALDGLLDGKLKWRPIVLPDCYIDHGSPVDQLSAAGLTPSHIAATVFNLLGQTREALEVMT

SEQ ID NO: 1035 - protein, 341 aa, Arabidopsis thaliana
MGHRHSKSKSSDPPPSSSSSSSGNVVHHVKPAGERRGSSGSGTVGSSGSGTGGSRSTTSTQQNGRILGRPMEEVRRTYEFGRELGRGQFGVTYLVTHKETKQQVACKSIPTRRLVHKDDIEDVRREVQIMHHLSGHRNIVDLKGAYEDRHSVNLIMELCEGGELFDRIISKGLYSERAAADLCRQMVMVVHSCHSMGVMHRDLKPENFLFLSKDENSPLKATDFGLSVFFKPGDKFKDLVGSAYYVAPEVLKRNYGPEADIWSAGVILYILLSGVPPFWGENETGIFDAILQGQLDFSADPWPALSDGAKDLVRKMLKYDPKDRLTAAEVLNHPWIREDGE

SEQ ID NO: 1036 - protein, 537 aa, Glycine max
MGRKHDAVLASEPVAEEAPCSPELDSEKKKKKKKKNKNKDKHQTESSPKRKLDEHDPQNGTESKKKKKKHHESKGNAEETNGDSNNNNGDGANREETATDGSVVVTGNNAGEAKYAAVKSFADSGLPENVLECCKGFEKPSPIQSRAWPFLLDGRDLIGIAATGSGKTLAFGIPAVMHVLGKRKGKSSKGRNPLGLVLSPTRELAQQISDVMCDAGRSCGVQSICLYGGTSKGPQISSLKSGIDIVIGTPGRIQDLIEMGICCLKEVSFVVLDEADRMLDMGFEQIVRSILGQTCSDRQMVMFSATWPLPVHYLAQEFMDPNPVKVVVGSEDLAANHDVMQIVEVLDDRSRDKRLVALLEKYHKSQRNRVLVFVLYKLEAKRVENMLQEGGWKVVSIHGDKAQHDRTKALSLFKNASCPLMIATDVAARGLDIPDVEVVINYSFPLTTEDYVHRIGRTGRAGKKGVAHTFFMQQNKGLAGELVNVLREAGQIVPDALLKFGTHVKKKESKLYGAHFKEIPVDAPKSQKKTFDDSDED

SEQ ID NO: 1037 - protein, 330 aa, Glycine max
LNIVAMARFSLDEISDTGAFVRSASTFRNWISRDLNSQFPPESGRYHLYVSYACPWASRCLAYLNIKGLNKAISFSAVKPIFERTNESDDYKGWVFPESETEVPGAEPDMLNGAKTIRELYEIASANYTGKYTVPVLWDKKLKTIVNNESSEIIRMFNTEFNSIAENPTLDLYPTDLKPQIDDTNEWIYTSINNGVYKCGFAKKQEPYNEAARQLYGALDKCEDILSKQRYICGNTLTEADIRLFVTLIRFDEVYAVHFKCNKKLLREYPNLFNYTKDIFQIPGISSTVNMEHIKLHYYGSHPSINPFGIVPVGPNIDYSAPHDRERFSA

SEQ ID NO: 1038 - protein, 332 aa, Glycine max
MEMEGEKQHKFDVDLGNLMAFDSYHTFPSQPSLSREDLIKQCLLKGTHLVQAIADALFILPSTEDLDGPLVTLPPPLTKLPREKHLPKPKPPTKWEAFAKKKGIQKRKKDKIVYDEQSGTWKRRHGYDRANDEAAIPIIEAKPTDDPEEDPFAKRKENKKNRIEKQEKNRLQNLKEAAKFGALPSHIQLAATALPITGTQAAPKKVTKDELGNVAGIAATATASGGKFDKKLAGEKPQKHEGKYRKFLPVVEGTGIGSLEREQTEKILNKIISKNSHNILNVEKAVTMHNVKKEKKRRSEKGKTSATTDKKLKTQKKSFKKGSSKKGKAKGK

SEQ ID NO: 1039 - protein, 298 aa, Glycine max
MKPPTKPISSPGRTEKFPPPLMRFLRNNASSRSRGRSRTTTAMFLRKKNTNNIETQEPSSPKVTCMGQVRVKRSASKRVPSAGAGTPTKFRCCSWVPHALFFHRLIKPEVCFPFQCKQVWPNWRFLQRKKRDSKVTETSSPKTELNFRGRFNPNYDDSEHKDRVIVNPPAFVSNTSSTPPRNALLLTRCRSAPGRRFLNEETEVVEKNRVNREHSENNRDRKLEAKLRFFKELEESLRERIIMESEKAREESDSVHPLVLTRCKSEPARTAQKLDPEMNGLSKKTTLGFAHAWFSHGL

SEQ ID NO: 1040 - protein, 266 aa, Glycine max
MGTSILDALNVRVEGSGDKYLVLAHGFGTDQSAWQRVLPYFTRNYSVILYDLVCAGSVNPDHFDYRRYTTLDAYVDDLLNILDALRVPRCAYVGHSISAMIGMLASIRRPDLFSKLILIGASPRFLNDKDYHGGFEQGEIEQVFSAMEANYEAWVNGFAPLAVGADVPAAVREFSRTLFNMRPDISLFVSRTVFNSDLRGILGLVNVPCCIMQTARDMSVPASVATYMRDHIAGKSTIQWLDTEGHLPHLSAPSYLARQLEIALSQ

SEQ ID NO: 1041 - protein, 656 aa, Glycine max
MLPHKHTLVVVATVATLALAAVLAAPQADLASERAALLSLRSSVGGRTLFWNATRDSPCNWAGVQCEHGHVVELHLPGVALSGEIPVGIFGNLTQLRTLSLRFNALRGSLPSDLASCVNLRNLYIQRNLLTGQIPPFLFHLPDLVRLNMGFNNFSGPFPSAFNNLTRLKTLFLENNQLSGPIPDLNKLTLDQFNVSDNLLNGSVPLKLQTFPQDSFLGNSLCGRPLSLCPGDVADPLSVDNNAKGNNNDNKKNKLSGGAIAGIVVGSVVFLLLLVFLLIFLCRNKSAKNTSAVDIATVKHPETESEVLADKGVSDVENGGHANVNPAIASVAAVAAGNGGSKAEGNAKKLVFFGNAARAFDLEDLLRASAEVLGKGTFGTAYKAVLEAGPVVAVKRLKDVTISEKEFKEKIEAVGAMDHESLVPLRAYYFSRDEKLLVYDYMPMGSLSALLHGNKGAGRTPLNWEVRSGIALGAARGIEYLHSRGPNVSHGNIKSSNILLTKSYDARVSDFGLAHLVGPSSTPNRVAGYRAPEVTDPRKVSQMADVYSFGVLLLELLTGKAPTHALLNEEGVDLPRWVQSVVREEWTSEVFDLELLRYQNVEEEMVQLLQLAVDCAAQYPDKRPSMSEVVRSIQELRRSSLKEDQDQIQHDNDILL

SEQ ID NO: 1042 - protein, 255 aa, Glycine max
MGTTLMRCSHANALFRALKPKPRNSSLPLSSMAINKGNSNKAYDALLLDAGGTLLQLAKPVEEIYATIGSKYGVTVDPAMIKQGFKRAFAAPWPEKLRYQGDGRPFWKLVVSEATGCGDEDYFEEVYEYYAKGDAWHLPDGAFETITFLKDAGVKMAVVSNFDNRLRKLLKDLNVLNLFDAVIISSEVGYEKPDPRIFQAALDEVNVEACKALHIGDDQKADKLGANAVGIDCWLWGIDVKTFSDIQIRILNSEA

SEQ ID NO: 1043 - protein, 581 aa, Glycine max
MGNTCVGPSISKNGFVQSVSAAIWRSQLPEGSVSNRESVKEEATSVPESPLPVQNKPPEQITMPKQEAKQEGKSEIEPEKEQDKKKQKKRGSVKRVSSAGLRVDSVLQRETDNFKEFFTLGRKLGQGQFGTTFLCVEKATGLECACKSIAKRKLVTDDDVEDVRREIQIMHHLAGHPNVISIKGAYEDAVAVHVVMELCAGGELFDRIIQRGHYTERQAAKLTKTIVGVVEACHSLGVMHRDLKPENFLFVNQHEDSLLKTIDFGLSVFFKPGDIFNDVVGSPYYVAPDVLRKRYGPEADVWSAGVILYILLSGVPPFWAENEQGIFEQVLRGDLDFSSDPWPSISESAKDLVRKMLVRDPRRRLTAHQVLCHPWIQVDGVAPDKPLDSAVLSRLKQFSAMNKLKKMALIIIAESLSEEEIAGLKEMFKMIDADNSGQITFEELKAGLKRVGANLKESEIYDLMQAADVDNSGTIDYGEFLAATLHRNKIEREDNLFAAFSYFDKDGSGYITQEELQQACDEFGIKDVRLEEIIKEIDEDNDGRIDYNEFVAMMQKGNLPAVGKKGLENSFSVKFREALKL

SEQ ID NO: 1044 - protein, 290 aa, Glycine max
MASRPEVVAPPEIFYDDAEARKYTSSSRIVQIQATLSERALELLALPDDSVPKLLLDIGCGSGLSGETLSENGHHWIGLDISASMLNVAVEREVEGDLLLGDMGQGLGIRPGVIDGAISISAVQWLCNADKSSHNPRLRLKAFFTSLYKCLSNGARAVFQVYPENIDQRELILNAAMHAGFAGGIVVDFPHSSKKRKEFLVLTCGQRSVNVSISKGKNEDRESCSDEDSEDEEKQTVCISDRHRPRKKQKNNKSGKGKEWLLRKKEQMRRRGNVVPPNTKYTGRKRKDRF

SEQ ID NO: 1045 - protein, 497 aa, Glycine max
MAKHEELPIPIYNNLEPVYGGSSALEEAQLRFDILKSKFIDIFGHHPQIFARSPGRVNLIGEHIDYEGYSVLPMAIRQDTIVAIRKNDAEKVLKIANVNGEKYSLCTYPADPLQEIDLKNHKWGHYFICGYKGFHDYAKLKGVDVGKPVGLEVLVDGTVPTGSGLSSSAAFVCSSTIAIMAAFDVNFPKKELAQVTCDCERHIGTQSGGMDQAISVMAKTGFAELIDFNPIRATDVQLPAGGTFVIAHSLAESQKAVTAATNYNNRVVECRLASIVLAIKLGMDPKEAISKVNTLSDVEGLCVSFAGIHNSSDPVLAVKEYLKEEPYTAEEIEAVTGEKLTSFLNNNAAYLEVVKVAKQYKLHQRAAHVYSEAKRVHAFKDVVSSTLSDEDMLKKLGDLMNESHHSCSVLYECSCPELEELVNICRNNGALGARLTGAGWGGCAVALVKESIVPQFILNLKECFYQSRIDKGVIKKNDLGLYVFASKPSSGAAIFKF

SEQ ID NO: 1046 - protein, 622 aa, Glycine max
MENTCLWIQKEGRRRKDSLHGLLNDREISEEESSKSQLKKLIKRSNSHRAIVVNAIQSQISKVFFKDLFFRRVHGLDNRIPKHVVSVDEKYIRRCLEFIHNTALKAAQFNIPESLRATNMETLSESLNTVKFFGGNACGLGHFVFECPVATENGRVVISANAGDQWTLGSIMGSKSMINILNSTLLQQFGASHRTDNLNRMNFSDPEGLVCYDFMDSPSDLCISSSHKLGKEKQLVRSHKYGSISVHKRLVSTSSTTSTSSDWLSSTSSTLSQGMIQCSWKQGIPHFVFSADDQKEVYVAKLKKVDSTDNKALDYVYEFHLNKGGQKGREIPDGDFPFVGKMHVSTSFTLCPNNCRIRETEFTLFHNMEISDKEMSTSEHSHRKSKGLSKVSKVFKTSPSSKRRTLSRFGGSSAIKESCPWEPYALGGTNLLDTDVPPNFEMATIVVKNHLPCKKPEKVGGWGLKFLNKSGENQITLPSESSNQNNGDCSSSTSILIPAGFHGGPRTRNGGPSSLIDRWKSGGHCDCGGWDEGCPLTVLERRSNKAEVMSKIDTGDGCKSVDLVIQGSSDYGPTLRMVNVHDGLYYIHFHPPLSALQSFSIAVAIIHAQSPTLQPNGAKKLS

SEQ ID NO: 1047 - protein, 428 aa, Glycine max
MGGQNSKEESWRQSSSVRSSSSSWSAYLDPLSSYGFNEPQPSYSSYGYEAYGGDGMVRYDSTKLERRYSRISDHYSSIDQVSEALALAGLESSNLIVGVDFTKSNEWTGKNSFNRRSLHHIGRGLNPYEQAISIIGKSLAAFDEDNLIPCFGFGDASTHDQDVFSFYPSERFCDGFEDVLSRYREIVPHLRLAGPTSFAPIIEMAMSIVEQSGGQYHVLVIIADGQVTKNVDTKHGRPSPQEQKTVDAIVAASKFPLSIILVGVGDVPWDMMKEFDDNIPARAFDNFQFVNFTEIMSKSIPPSRKEAAFALAALMEIPSQYKAAIELKLLGSRQANAPQRHALPPPRYSSHAARFEPSIPPQHGNSHPFATAPSAPSSTSDNQLCPICLSNAKDMAFGCGHQTCCECGQDLQSCPMCRSPINTRIKLY

SEQ ID NO: 1048 - protein, 99 aa, Arabidopsis thaliana
MAIFRSTLVLLLILFCLTTFELHVHAAEDSQVGEGVVKIDCGGRCKGRCSKSSRPNLCLRACNSCCYRCNCVPPGTAGNHHLCPCYASITTRGGRLKCP

SEQ ID NO: 1049 - protein, 290 aa, Arabidopsis thaliana
MEVSWNELHIKERVGAGSFGTVHRAEWHGSDVAVKILSIQDFHDDQFREFLREVAIMKRVRHPNVVLFMGAVTERPRLSIITEYLPRGSLFRLIHRPASGELLDQRRRLRMALDVAKGLNYLHCLNPPVVHWDLKSPNLLVDKNWTVKVCDFGLSRFKANTFIPSKSVAGTPEWMAPEFLRGEPTNEKSDVYSFGVVLWELITLQQPWNGLSPAQVVGAVAFQNRRLIIPPNTSPVLVSLMEACWADEPSQRPAFGSIVDTLKKLLKSPVQLIQMGGDKGVIPTKSAPIL

SEQ ID NO: 1050 - protein, 434 aa, Arabidopsis thaliana
MYKNQLQELAQRSCFNLPSYTCIREGPDHAPRFKATVNFNGEIFESPQYCSTLRQAEHSAAEVALNALSNRGPSHSLAARILDETGVYKNLLQEIAQRVGAPLPRYTTFRSGLGHQPVFTGTVELAGITFTGDPAKNKKQAEKNAAMAAWSSLKQLAKETSSSMPEPENIDELEQVIIARALINYRIKENIGTGSSSSAPVPFAKKFFMQNLRPTSPQPSPATTSRILPFICPKQPSRSSRSSLAATSGIDRIMAAALESRSYQRPQQRFANPPYVPMRQFRSQCHGMAPPVTIRTAVPVFSAPPMPPPPCTNNTQLPSSVYVPSLMRTAPPVRIAPPVTIRTAVPVFASAPPVRIRTAVKPTVEAGETRISSVQEKESIPVLPDSLEIGVEGSTITITDCEKTASKETERAEFKDSSKGEPETARERLENLKI

SEQ ID NO: 1051 - protein, 312 aa, Arabidopsis thaliana
MAEVNGVIPTIDLEEVNDQILNEKIREASERWGCFTVINHGVSLSLMAEMKKTVRDLHERPYEMKLRNTDVLLGNGYKPLSEFNPFYESFGLFDMASPQAVNSFCDKLDASPDQREILLKYAKATDDLARSLARRLAESYGVVEPNFLRGWPSQFRMNKYHFKPDSVGKLGVILHTDPGFLTILQGDEDVGGLEAMDNSSGSFFPIHTLPNTLLVNLGDMATIWSNGRLCNVKHRVQCIEAKMRITIASFLLGPVDRDLEAPDEFVDAEHPRLYKPISNGGLRKIRLSKHLHAGESLKFITINELSDVPKID

SEQ ID NO: 1052 - protein, 120 aa, Arabidopsis thaliana
MAEESRVPSSVSVTVAHDLLLAGHRYLDVRTPEEFSQGHACGAINVPYMNRGASGMSKNPDFLEQVSSHFGQSDNIIVGCQSGGRSIKATTDLLHAGFTGVKDIVGGYSAWAKNGLPTKA

SEQ ID NO: 1053 - protein, 576 aa, Arabidopsis thaliana
MATHSMIIPSPSSSSSSLATAASPFKETLPLFSRSLTFPRKSLFSQVRLRFFAEKHSQLDTSNGCATNFASLQDSGDQLTEEHVTKGESTLSITVVGASGDLAKKKIFPALFALFYEGCLPQDFSVFGYARTKLTHEELRDMISSTLTCRIDQREKCGDKMEQFLKRCFYHSGQYNSEEDFAELNKKLKEKEAGKISNRLYYLSIPPNIFVDVVRCASLRASSENGWTRVIVEKPFGRDSESSGELTRCLKQYLTEEQIFRIDHYLGKELVENLSVLRFSNLVFEPLWSRNYIRNVQLIFSEDFGTEGRGGYFDQYGIIRDIMQNHLLQILALFAMETPVSLDAEDIRSEKVKVLRSMKPLRLEDVVVGQYKGHNKGGKTYPGYTDDPTVPNHSLTPTFAAAAMFINNARWDGVPFLMKAGKALHTRGAEIRVQFRHVPGNLYKKSFATNLDNATNELVIRVQPDEGIYLRINNKVPGLGMRLDRSDLNLLYRSRYPREIPDAYERLLLDAIEGERRLFIRSDELDAAWDLFTPALKELEEKKIIPELYPYGSRGPVGAHYLASKYNVRWGDLGEA

SEQ ID NO: 1054 - protein, 171 aa, Arabidopsis thaliana
MASGGSKSAAFMLLMLNLGLYFVITIIASWAVNHGIERTRESASTLSLPAKIFPIYFPVGNMATGFFVIFTLIAGVVGMATSLTGIINVLQWDSPNLHSAAASSLISWSLTLLAMGLACKEINIGWTEANLRTLEVLTIIVSATQLLCTGAIHAGVGETVASGERPHLGRV

SEQ ID NO: 1055 - protein, 347 aa, Arabidopsis thaliana
MATVTSNASPKSFSFTVSNPFKTLIPNKSPSLCYPTRNKNHHRLGFSIKATVSTPPSIATGNAPSPDYRVEILSESLPFIQKFRGKTIVVKYGGAAMTSPELKSSVVSDLVLLACVGLRPILVHGGGPDINRYLKQLNIPAEFRDGLRVTDATTMEIVSMVLVGKVNKNLVSLINAAGATAVGLSGHDGRLLTARPVPNSAQLGFVGEVARVDPSVLRPLVDYGYIPVIASVAADDSGQAYNINADTVAGELAAALGAEKLILLTDVAGILENKEDPSSLIKEIDIKGVKKMIEDGKVAGGMIPKVKCCIRSLAQGVKTASIIDGRRQHSLLHEIMSDEGAGTMITG

SEQ ID NO: 1056 - protein, 368 aa, Arabidopsis thaliana
MASVSRRLLRRETIPCFSHTVRKLFSTVGSPSFAQRLRDLPKDFPSTNAKRDASLLIGKTPLVFLNKVTEGCEAYVAAKQEHFQPTCSIKDRPAIAMIADAEKKKLIIPGKTTLIEPTSGNMGISLAFMAAMKGYRIIMTMPSYTSLERRVTMRSFGAELVLTDPAKGMGGTVKKAYDLLDSTPDAFMCQQFANPANTQIHFDTTGPEIWEDTLGNVDIFVMGIGSGGTVSGVGRYLKSKNPNVKIYGVEPAESNILNGGKPGPHAITGNGVGFKPEILDMDVMESVLEVSSEDAIKMARELALKEGLMVGISSGANTVAAIRLAKMPENKGKLIVTIHASFGERYLSSVLFDELRKEAEEMKPVSVD

SEQ ID NO: 1057 - protein, 232 aa, Arabidopsis thaliana
LKAFSLKSAMTKQHANWSPYDNNGGTCVAIAGSDYCVIAADTRMSTGYSILSRDYSKIHKLADRAVLSSSGFQADVKALQKVLKSRHLIYQHQHNKQMSCPAMAQLLSNTLYFKRFFPYYAFNVLGGLDEEGKGCVFTYDAVGSYERVGYGAQGSGSTLIMPFLDNQLKSPSPLLLPKQDSNTPLSEAEAVDLVKTVFASATERDIYTGDKLEIMILKADGIKTELMDLRKD

SEQ ID NO: 1058 - protein, 348 aa, Arabidopsis thaliana
MAMVVPKEGLVVMDKESVSSASSDSHLRLQPHFPDFTIPVKDFFKSREAREFLSGALAGAMTKAVLAPLETIRTRMIVGVGSRSIPGSFLEVVQKQGWQGLWAGNEINMIRIIPTQAIELGTFEWVKRAMTSAQVKLKKIEDAKIEIGDFSFSPSISWISPVAVAGASAGIASTLVCHPLEVLKDRLTVSPEIYPSLSLAIPRIFRADGIRGFYAGLGPTLVGMLPYSTCYYFMYDKMKTSYCKSKNKKALSRPEMLVLGALAGLTASTISFPLEVARKRLMVGALKGECPPNMAAAIAEVVKKEGVMGLYRGWGASCLKVMPSSGITWVFYEAWKDILLAANTKPLI

SEQ ID NO: 1059 - protein, 149 aa, Arabidopsis thaliana
MQAVSVDETKNTVVLRAEHKNEEGRKSVDKFEVKTRNPETIKSVERKLMEKGVQRMDRHPSDGIPLRRPPSKSGHGGKYTWEGPDRMEDYEMQPDPPAMDEGDPNYDEEQVKKSGDDVAVELVKGEVEVAKEAPAGVARVEVDPRLVGR

SEQ ID NO: 1060 - protein, 197 aa, Arabidopsis thaliana
MADYDDEIDQNNQPFIPKETALQALNSIIQLHFEKTLEKKRAIDHQKKKLHKLFQLFFIFLAVIFFSLSQPSGRLHCRHCWAPICLLSFSHLFFYVSVAQTLRCINGFKYQRRCHKLTLGLATHKLRFIKSRIAAGDFLGGGDGDEASAAAWDLEVPYQEPPDSYFGKFKRNWALYFGFLILLYTFMISFSVVILCF

SEQ ID NO: 1061 - protein, 412 aa, Arabidopsis thaliana
MAEEKWVVMVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 1062 - protein, 511 aa, Arabidopsis thaliana
MDIISGQALFLLFCFISSCFLISTTARSRRSSGRAATLPPGPPRLPIIGNIHQVGKNPHSSFADLAKIYGPIMSLKFGCLNSVVITSPEAAREVLRTHDQILSGRKSNDSIRCFGHEEVSVIWLPPSSARWRMLRKLSVTLMFSPQRTEATKALRMKKVQELVSFMNESSERKEAVDISRASYTTVLNIISNILFSVDLGSYDSKKSNEFQDTVIGAMEAAGKPDAANYFPFMGFLDLQGNRKAMRGLTERLFRVFRGFMDAKIAEKSLGNYSKDVSNRDFLDSLLILNEGDEAELDNNDIEHLLLDMFTAGTDTSSSTLEWAMAELLRNPKTMVKAQAEMDRVLGQNSVVQESDISGLPYLQAVVKETFRLHPAAPLLVPRKAESDVEVLGFMVPKDTQVLVNVWAIGRDPSVWENPSQFEPERFMGKDIDVKGRDYELTPFGGGRRICPGLPLAVKTVSLMLASLLYSFDWKLPNGVVSEDLDMDETFGITLHRTNTLYAIPVKKQTIN

SEQ ID NO: 1063 - protein, 515 aa, Arabidopsis thaliana
MDLSLIQGMSLPLYFLLTLFFFFFATAKTRRSSSTGTLPPGPPILPLVGNIFQLGFNPHRSLAAFSKTYGPIMSLKLGRLTAVVISSPEAAKEALRTHDHVMSARTFNDALRAFDHHKHSIVWIPPSARWRFLKKTITKYLLSPQNLDAIQSLRMRKVEELVSLVNEFRERGEAIDLARASFVTSFNIISNALFSVDLATYDSNSSSYEFHNTVVHLTDIAGIPNVGDYFQYMRFLDLQGTRKKAVLCIEKLFRVFQEFIDARLAKRFSRTEKEPKEASSIDMLDSLLDLTQQNEAELTMNDLKHLLLDVFVAGTDTNSSTMEWAMTELFRSTEKMVKAQSEIRQVIGQNGFVQESDIPSLPYLQAIVKETLRLHPAAPLIPRKSESDVQIMGFLVPKNTQVVVNVWAIGRDASVWENPMKFEPERFLLRETDVKGRDFELIPFGSGRRMCPGISMALKTMHMVLASLLYSFDWKLQNGVVPGNIDMSETFGLTLHKAKSLCAVPVKKPTISSSY

SEQ ID NO: 1064 - protein, 479 aa, Arabidopsis thaliana
MWALLIWVSLLLISITHWVYSWRNPKCRGKLPPGSMGFPLLGESIQFFKPNKTSDIPPFIKERVKKYGPIFKTNLVGRPVIVSTDADLSYFVFNQEGRCFQSWYPDTFTHIFGKKNVGSLHGFMYKYLKNMVLTLFGHDGLKKMLPQVEMTANKRLELWSNQDSVELKDATASMIFDLTAKKLISHDPDKSSENLRANFVAFIQGLISFPFDIPGTAYHKCLQGRAKAMKMLRNMLQERRENPRKNPSDFFDYVIEEIQKEGTILTEEIALDLMFVLLFASFETTSLALTLAIKFLSDDPEVLKRLTEEHETILRNREDADSGLTWEEYKSMTYTFQQFINETARLANIVPAIFRKALRDIKFKEFVNDTDYTIPAGWAVMVCPPAVHLNPEMYKDPLVFNPSRWEGSKVTNASKHFMAFGGGMRFCVGTDFTKLQMAAFLHSLVTKYRWEEIKGGNITRTPGLQFPNGYHVKLHKKRD

SEQ ID NO: 1065 - protein, 514 aa, Arabidopsis thaliana
MSFLSFSPISLDLLSSNVFLTILAIIISGLLKTITYRKHNSNHLNLPPGPPGWPVIGNLFQFTRSGKQFFEYVEDLVKIYGPILTLRLGTRTMIIISDASLAHEALIERGAQFATRPVETPTRKIFSSSEITVHSAMYGPVWRSLRRNMVQNMLSSNRLKEFGSVRKSAMDKLIERIKSEARDNDGLVWVLQNSRYAAFCVLLDICFGVEMEEESIEKMDQLMTAILNAVDPKLHDYLPILTPFNYNERNRALKLRRELVDFVVGFIEKRRKAIRTATVSSFSYLDTLFDLRIIEGSETTPSDEDLVTLCSEFLNAGTDTTGAAIEWGIAELIANPEIQSRLYDEIKSTVGDRAVDERDVDKMVLLQAVVKEILRRHPPTYFTLSHGVTEPTTLSGYNIPVGVNIEFYLPGISEDPKIWSEPKKFDPDRFLSGREDADITGVAGVKMMPFGVGRRICPGMGMATVHVHLMIARMVQEFEWLAYPPQSEMDFAGKLVFAVVMKKPLRAMVRPRVQ

SEQ ID NO: 1066 - protein, 246 aa, Arabidopsis thaliana
MSSSNACASPSPFPAVTKLHVDSVTFVPSVKSPASSNPLFLGGAGVRGLDIQGKFVIFTVIGVYLEGNAVPSLSVKWKGKTTEELTESIPFFREIVTGAFEKFIKVTMKLPLTGQQYSEKVTENCVAIWKQLGLYTDCEAKAVEKFLEIFKEETFPPGSSILFALSPTGSLTVAFSKDDSIPETGIAVIENKLLAEAVLESIIGKNGVSPGTRLSVAERLSQLMMKNKDEKEVSDHSVEEKLAKEN

SEQ ID NO: 1067 - protein, 555 aa, Arabidopsis thaliana
  misc_feature (121)..(121): Xaa can be any naturally occurring amino acid
  misc_feature (342)..(342): Xaa can be any naturally occurring amino acid
MTNIWLLSLIFVICILVAVFNHKNRRNYQRTPPSPPGCPIIGNLHQLGELPHQSLWKLSKKYGPVMLLKLGRVPTVIVSSSETAKQALKIHDLHCCSRPGFAGTTILTLVSLFKPLNLESXNLESFCILNHSLGARELSYNYLDIAFSPYDDYWKEVRKLAVQELFSSKQVHSIQPIKDEEVKKLIDSISESAAQKTPINLNKTLLALTVSVVCRTAFSVNFEGTVLNSERFNNIVREALEMLGSFSASDFIPYVGRIIDLLTGLQGRRERSMRDLDAFYEQMFDLHKQKKEEGSEDFVDLLLRLEKEEAVLGNDKLTRNHIKAILMVTNHIFTIKSVRKIXTIDVYMLLQDVLLAGMDTSAITMTWAMAELAKNPRVMKKVQSEIRSQIKNKERISFDDTDKLEYLKMVIKETWRLHPTTPLLIPREAMSEFEINGYTIPVKTRLHVNVWAIGRDPDTWKDPEVFLPERFTDNNIDAKGQHFELLPFGGGRRMCPAVYMGTTMVEFGLANLLYHFDWKLPEGMKVDDIDMEEAPGLTVNKKNELILVPTKFLDP

SEQ ID NO: 1068 - protein, 541 aa, Arabidopsis thaliana
MNTFTSNSSDLTTTATETSSFSTLYLLSTLQAFVAITLVMLLKKLMTDPNKKKPYLPPGPTGWPIIGMIPTMLKSRPVFRWLHSIMKQLNTEIACVKLGNTHVITVTCPKIAREILKQQDALFASRPLTYAQKILSNGYKTCVITPFGDQFKKMRKVVMTELVCPARHRWLHQKRSEENDHLTAWVYNMVKNSGSVDFRFMTRHYCGNAIKKLMFGTRTFSKNTAPDGGPTVEDVEHMEAMFEALGFTFAFCISDYLPMLTGLDLNGHEKIMRESSAIMDKYHDPIIDERIKMWREGKRTQIEDFLDIFISIKDEQGNPLLTADEIKPTIKELVMAAPDNPSNAVEWAMAEMVNKPEILRKAMEEIDRVVGKERLVQESDIPKLNYVKAILREAFRLHPVAAFNLPHVALSDTTVAGYHIPKGSQVLLSRYGLGRNPKVWADPLCFKPERHLNECSEVTLTENDLRFISFSTGKRGCAAPALGTALTTMMLARLLQGFTWKLPENETRVELMESSHDMFLAKPLVMVGDLRLPEHLYPTVK

SEQ ID NO: 1069 - protein, 521 aa, Arabidopsis thaliana
MAAMITVDFQNSFIFILFCLFSLICYSLFFRKPKDSRAGRDLPPSPPSFPSNNLHLLLSALVHKSFQKISYKYGPLLHLRVFHVPIVLASSASVAYEIFKAQDVNVSSRGHAPAGESLLFGSSSFFFAPYGDYFKFMRKLIATKLLGPQALERSRKIRADELDRFYRNLLDKAMKKESVDIVEEAAKLNNNIICKMIMGRSCSEDNGEAERVRGLVIESTALTKQIFLGMIFDKPLKKLGISLFQKDIKSVSRFDELLEKILVEHEERMGKHYKANDMMDLLLEAYGDENAEYKITRNHIKSLFVDLVIAGTDTSAQTIEWTMAELINNPNILERLREEIESVVGNTRLVQETDLPNLPYLQAVVKEGLRLHPPGAVFLRTFQERCELKGFYIPEKTLLVVNVYAIMRDPKLWEDPEEFKPERFIASSRSGQEDEIREEVLKYMPFSTGRRGCPGSNLAYVSVGTAIGVMAQCFDWRIKGEKVNMNEAAGTLVLTMAQPLMCTPGPRTLNPLPSSLHVPIS

SEQ ID NO: 1070 - protein, 501 aa, Arabidopsis thaliana
MFYYVIVLPLALFLLAYKLFFTSKTKRFNLPPSPPYSLPILGHHNLLKPPVHRLFHRLSKTHGPIFSLQFGSRRAVVISSSSLATQCFTGQNDIILSNRPCFLTAKYVAYNYTTVGTAPYGDHWRNLRRICSLEILSSNRLTNFLHIRKDEIHRMLTRLSRDVNKEIELEPLLSDLTFNNIVRMVTGKRYYGDEVHNEEEANVFKKLVADINDCSGARHPGDYLPFMKMFGGSFEKKVKALAEAMDEILQRLLEECKRDKDGNTMVNHLLSLQQNEPEYYTDVTIKGLMLGMMIAGTDTSAVTLEWAMSSLLNHPEALEKAKLEIDEKIGQERLIDEPDIANLPYLQNIVSETFRLYPAAPLLVPRSPTEDIKVGGYDVPRGTMVMVNAWAIHRDPELWNEPEKFKPERFNGGEGGGRGEDVHKLMPFGNGRRSCPGAGLGQKIVTLALGSLIQCFDWQKVNGEAIDMTETPGMAMRKKIPLSALCQSRPIMSKLQAHLKG

SEQ ID NO: 1071 - protein, 279 aa, Arabidopsis thaliana
MGSQQVAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLKAVVANFNADQLLTERPQVSALVRDALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 1072 - protein, 330 aa, Arabidopsis thaliana
MGGKGVMMVAILCLWALSATSEAVTEAEPGLMMNFYKDTCPQAEDIVREQVKLLYKRHKNTAFSWLRNIFHDCAVESCDASLLLDSTRRELGEKEHDRSFGLRNFRYIEEIKEALERECPGVVSCSDILVLSAREGIEAVGGPYIPLKTGRRDGLKSRTDMLESYLPDHNESISVVLEKFKSIGIDTPGLVALLGSHSVGRTHCVKLVHRLYPEVDPSLNPDHVPHMLHKCPDSIPDPKAVQYVRNDRGTPMVLDNNYYRNILDNKGLLLVDHQLAHDKRTRPIVKKMAKDQAYFFKEFTRAIQILSENNPLTGSKGEIRKQCNLANKNH

SEQ ID NO: 1073 - protein, 383 aa, Arabidopsis thaliana
MDKLKIAEWGEKLKTGGAQMSRMVSEKVKDMLQAPTLESKMVDEATLETLEEPNWGMNMRICAQINNDEFNGTEIVRAIKRKISGKSPVSQRLSLELLEACAMNCEKVFSEVASEKVLDEMVWLIKNGEADSENRKRAFQLIRAWGQSQDLTYLPVFHQTYMSLEGENGLHARGEENSMPGQSSLESLMQRPVPVPPPGSYPVPNQEQALGDDDGLDYNFGNLSIKDKKEQIEITRNSLELLSSMLNTEGKPNHTEDDLTVSLMEKCKQSQPLIQMIIESTTDDEGVLFEALHLNDELQQVLSSYKKPDETEKKASIVEQESSGSKDTGPKPTEQEEQEPVKKTGADDDKKHSEASGSSNKTVKEEKQAVKIELGLSSDEDEK

SEQ ID NO: 1074 - protein, 309 aa, Arabidopsis thaliana
MEITLNSGFKMPIVGLGVWRMEKEGIRDLILNAIKIGYRHLDCAADYRNETEVGDALTEAFKTGLVKREDLFITTKLWNSDHGHVIEACKDSLKKLQLDYLDLFLVHFPVATKHTGVGTTDSALGDDGVLDIDTTISLETTWHDMEKLVSMGLVRSIGISNYDVFLTRDCLAYSKIKPAVNQIETHPYFQRDSLVKFCQKHGICVTAHTPLGGATANAEWFGTVSCLDDPVLKDVAEKYKKTVAQVVLRWGIQRKTVVIPKTSKPARLEENFQVFDFELSKEDMEVIKSMERKYRTNQPAKFWNIDLYA

SEQ ID NO: 1075 - protein, 562 aa, Arabidopsis thaliana
MEKNQQKQEFLAETSEMKNTKNNDDCSVQQQQRFVWPWVGLVANIPTEVEPSGRRVGKSGSTLRDEFTMKGFNPTRVQPIWDFKGHSGFALVEFAKDFEGFESAMNFERSFNLDRHGKRDWEKGHRLRDNKLYGWVAREDDYNRSDTVGKNVKKKRDLKSISQIVEEDERKMVHLVENMSQTIEKKKQSKQELEQKVDETSRFLESLELHNVLLNKNYQEEGFQKMQMKMEELYQQVLDGHEKSLAELEAKREKLDERARLIEQRAIINEEEMEKSRLEREMNQKAMCEQNEANEEAMKLAEKHQASSSLKEKEKLHKRIMEMEAKLNETQELELEIEKLKGTTNVMKHMVGSDGDKDIVEKIAKTQIQLDAQETALHEKMMTLARKERATNDEYQDVLKEMIQVWNANEELMKQEKIRVKRMGQLNPAPFLPAVMKKHKVTQSKAENKAMKLCSVWEANIGDVQWTPFRVDESDGTPKRVVDENDEKLRTLKNQYGEEVYNEVVRTKLEIEEHNASGSYVILELWNYEENRKATMEEATDVMLKIRSKLAAMKNKRKRLEV

SEQ ID NO: 1076 - protein, 413 aa, Arabidopsis thaliana
MKMRTKSIPVRSSRKSLDSLLDDEANENTQCDERDVPHKKRRCLGTSETTDRGGSVEPLLDLDACIVCEVSDERVSRCCGVDCLLSFHGECLYADLGSTSSSSSSSSEDVSNPFCPYCWLKIVALKSKTLREKTVEAEKAVCKYLDKEMKSRDEDITLSGDEIGNQEQSTDIVSDHELQGEKDGCSSKPDADQGKVGTGKVIDEVGASEKVATEKFQDAEDDETAKDQGTRILNTGAGKKREVSSFLSMQESFSAKEQDQVQQNEKRRRRGLKIIDSDISSKGSSNERNGEDVTEQVTSSVQVTSPSGRMRNQQATTKVVAKSKTVRLDISFFKMDQRRRLLWTYEEEEMLKVGVEKFAAEANKNMPWRKILEMGEKVFHETRTPADLKDKWRSMVKIMNKNEQGSTLTPTAM

SEQ ID NO: 1077 - protein, 329 aa, Arabidopsis thaliana
MKQASSSSSCNPTSLTNRLKTIFKKAEELSILCAIDVCVIYYGPDGDLRTWPKDRETVKNMALRYKEDRKRKKCLNLHEFLEKEKVKDKDKYKGKTNYVKNPNWYPNFDHYSPQQLSQLIQSLERTLSTLQKRLRIVESQKKQNTNLVHQSLTPSYLNQTQHLDPSKFSLYMYNHGDATLSQLPLSASQSNQLINYQMQHGFGQNMCLDNITNNNNFQHPGVSNTQDYSPLLSANNYGLNNHLMQQQDQLHGFDQNLCMMSEIINNNNGLQHPNLSNTVPHEFPYGNTSFSQDMFSSYDGSSLLQTSSLPPLHNIPNSYCFSDNSRLLC

SEQ ID NO: 1078 - protein, 260 aa, Arabidopsis thaliana
MASQVRSVKVGNLSSGATEHDIKEFFSFSGEVESIDIQSSNEHSAYVTFKETQGAETAVLLSGASIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHSSEYSKN

SEQ ID NO: 1079 - protein, 283 aa, Arabidopsis thaliana
MAEHLASIFGTEKDRVNCPFYFKIGACRHGDRCSRLHNRPTISPTLLLSNMYQRPDMITPGVDPQGQPLDPSKIQDHFEDFYEDIFEELNKFGEVESLNVCDNLADHMIGNVYVLFKEEDHAAAALQALQGRFYSGRPIIADFSPVTDFREATCRQYEENSCNRGGYCNFMHVKQISRELRRKLFGRYRRSYRRGSRSRSRSISPRRKREHSRERERGDVRDRDRHGNGKRSSDRSERHDRDGGGRRRHGSPKRSRSPRNVREGSEERRARIEQWNRERDEGV

SEQ ID NO: 1080 - protein, 667 aa, Arabidopsis thaliana
MDSDGVSVPLIHEHLMMPCNDLRRGDCCERLEAISDGYYCTTCDFFVHKKCGDEASECIENPFHSNHPLRLGFLSRLQRQHWLKVVRSCDLCGKNIGDLFYRCEICDFDMDLHCAKYPPLEVIDIPEMHSHKLNLLKDRVEFDCDAKCGKIGYGFPYECHECDSKFHVDCVRYSSSEEVKHPLEVNHSYHSLHPLKLLMGQPPDYSDGKCRLCGRKIDDKLFYHCSSCNFTLDMRCVLNPPPKSVLDLKTHDHQLNLLPRLIFFTCNACGLNGDRSPYACFQCDFLIHKDCFGLPRLININRHDHRISRTSLIGIVNSVCGVCRQKVDWTCGGYSCQRCSTYIAHSKCATREDVWNGKELEGVPEEIEDIEPYVVIDDNTIQHFSHKEHYMRLNVNGLMCEVNKRCNACNHPISPQSFYGCMDCDFILHQNCAGFPRRKWHVLHNERLALVTSEVNIFGCSACHKIFNGFRYEHEDTKLDVLCGSFSEPFIHPSHPHHPLYCISPEDDEVCSGCNERSYHVLRCIEDNCGFILDFGCATFPQVVKHRIEDQPLSLCYGEKASGKYWCDICEKETNPNTWFYTCKDHRASLHTWCVLGDFMGLIPKSTIELWNISYEVVLNNSISRPICRHCKSHCIPPIILKKIGTSDPYFCSLDCIESFKRLWRAK

SEQ ID NO: 1081 - protein, 585 aa, Saccharomyces cerevisiae
MLHRHGSKQKNFENIAGKVVHDLAGLQLLSNDVQKSAVQSGHQGSNNMRDTSSQGMANKYSVPKKGLPADLSYQLIHNELTLDGNPHLNLASFVNTFTTDQARKLIDENLTKNLADNDEYPQLIELTQRCISMLAQLWHANPDEEPIGCATTGSSEAIMLGGLAMKKRWEHRMKNAGKDASKPNIIMSSACQVALEKFTRYFEVECRLVPVSHRSHHMLDPESLWDYVDENTIGCFVILGTTYTGHLENVEKVADVLSQIEAKHPDWSNTDIPIHADGASGGFIIPFGFEKEHMKAYGMERWGFNHPRVVSMNTSGHKFGLTTPGLGWVLWRDESLLADELRFKLKYLGGVEETFGLNFSRPGFQVVHQYFNFVSLGHSGYRTQFQNSLFVARAFSFELLNSSKLPGCFEIVSSIHESIENDSAPKSVKDYWEHPQAYKPGVPLVAFKLSKKFHEEYPEVPQAILSSLLRGRGWIIPNYPLPKATDGSDEKEVLRVVFRSEMKLDLAQLLIVDIESILTKLIHSYEKVCHHIELASEQTPERKSSFIYEMLLALASPQDDIPTPDEIEKKNKLKETTTRNYRGTC

SEQ ID NO: 1082 - protein, 575 aa, Glycine max
MGLKALFVWCIIWLGLAHLSLGGRVRHYKFDVEYMIRKPDCLEHVVMGINGQFPGPTIRAEVGDILDIALTNKLFTEGTVIHWHGIRQVGTPWADGTAAISQCAINPGEAFHYRFTVDRPGTYFYHGHHGMQRSAGLYGSLIVDLPKGQNEPFHYDGEFNLLLSDLWHTSSHEQEVGLSSKPFKWIGEPQTLLINGKGQFNCSLASKFINTTLPQCQLKGGEECAPQILHVEPNKTYRIRIASTTALASLNLAISNHKLVVVEADGNYVSPFAVDDIDIYSGESYSVLLRTDQDPNKNYWLSIGVRGRRAPNTPQGLTILNYKPISASIFPISPPPITPIWNDFERSKAFTKKIIAKMGTPQPPKRSDRTIFLLNTQNLLDGFTKWAINNVSLTLPPTPYLGSIKFKINNAFDKTPPPVTFPQDYDIFNPPVNPNTTIGNGVYMFNLNEVVDVILQNANQLSGSGSEIHPWHLHGHDFWVLGYGEGKFKPSDEKKFNLTHAPLRNTAVIFPYGWTALRFKADNPGVWAFHCHIEPHLHMGMGVIFAEGVHKVGKIPRDALTCGLTGNKLVGNRHY

SEQ ID NO: 1083 - protein, 600 aa, Glycine max
MTSKQTYSVCFCWRRRFKLALAEAPSEIKTLFNEYSENELMTPSHLKRFLVDVQRQEKATEEDAQAIIDSFRHFHRRGAGLNLETFFKYLFSDDNPPLLPSHGVHHDMTLPLSHYFIYTGHNSYLTGNQLSSDCSDVPIINALKKGVRVIELDIWPNASKDSIDVLHGRTLTTPVELIRCLRSIKDHAFVASEYPVVITLEDHLTPDLQAKVAEMVTQTFGDILFTPNSESVKEFPSPESLKKRIIISTKPPKEYLEAKEKEKGDDSQHEKEKGDDSEHGKASGEDEAWGKEVPSLKGGTIEDYKDNNVDEDLNDEEEFDESDKSHHNEAPEYRHLIAIHAGKPKGGLVECLKVDPEKVRRLSLSEQQLEKAAINYGQQIVRFTQRNILRVYPKGTRIDSSNYNPLIGWMHGAQMVAFNMQGYGRSLWLMHGMFRANGGCGYVKKPNFLLETGPDDEVFNPKAKLPVKTTLKVTVYMGEGWYYDFKHTHFDQYSPPDFYTRVGIAGVPNDTIMKRTKAIEDNWLPTWNEAFEFPLTVPELALLRVEVHEYDMSEKDDFGGQTCLPIWELRSGIRAIPLHSQKGDKYNTVKLLMRFEFINN

SEQ ID NO: 1084 - protein, 256 aa, Glycine max
MSQEQPRRPQGQDPIKYGDVFDVYGDLAQMPIAPEDAAMMQSAEARVLGKTQPGGASSVMQSAATRNEQAGLVGHQDVTDITGDHGVTVTETTFHGRRIITEAVGGQVVEQYVEPNPVEAGRTSAIKESAITIGEALEATAQTVGHKPVDQSDASAIQAAEVRATGSNVITPGGLAAMAQSAAAYNADCKHDQDKVKLADVLTGATAKLPADKAATLQDAEGVASAEARNNPDATATPGGVAASVAAAARLNENVK

SEQ ID NO: 1085 - protein, 281 aa, Glycine max
MEASLVERGRERAGHVNKVGYVRRVIAKKKKQLYRRVRRPELSVSKTLHQLFDSCREAFKGPGTVPSPQDVQRLTHILDNMKPEDVGLSRDLQFFKPGNIVKENQRVTYTTVYKCDNFSLCIFFIPEGGVIPLHNHPDMTVFSKLLLGLMHIKSYDWVDPEASDDNMLQPQSQLRLAMLKVDKVFTSSCDTSVLYPTTGGNIHEFTAITPCAVLDVIGPPYSKEDGRDCSYYRDHPYTCFPNERIIGEAKEENDSYTWLEEIEMPENSEMNGVEYLGPTPS

SEQ ID NO: 1086 - protein, 322 aa, Glycine max
MVGGGNRREEGSLVLNNTNVFAALDTLKKKKKSDKEKSKGSSTKSQAQSAKAEAQVFWAPAPLNAKSWADVDDEDDDDYYATTAPPQSVWGVSEPHHSKEDKHGNFEDSESEEDILDEGDDEVEEEHDHEPEESLKPEPEVKKDAEVPLPPPKETERQLSKKERKKKELAELEALLADFGVAPKQSKDGQDESQGAQDKTGVETDGDGEKKENVPAESKTSKKKKKKDKASKEVKESQDQPNSSDTNNGPDLATGTENVEEDTSTVDVKERLKKVASTKKKKSSKEMDAAARAAAQEAAARSARLAAAKKKEKNHYNQQPIR

SEQ ID NO: 1087 - protein, 313 aa, Glycine max
MSDERAVHPDCRNASNPYHECSDYCFRVIAEAKIRSQQQESEVGQASGGNNSKQAIPDESYVEKEIHNGRPDLEENSDSDPDQPAVQEAEQEVDYTKLSARQKKWMELRSKMQEAKKRNQIEIAAEKKRMEAPTESRGVSKQKWLEDRKKKIGKLLDANGLDMTKAYMLDTQEAAEEKYKKWEKDPAPFGWDVFNQKTLYNAYKKRTKNVEVDVEEYNRMKEADPEFYRDASSLQYGKAPKISEEKIDRMVRELKDRDEKRNSFSRRRRFHEEKDIDSINDRNEHFNKKIERAFGKYTLEIKNNLERGTALPD

SEQ ID NO: 1088 - protein, 719 aa, Arabidopsis thaliana
MDGMKLSFPPESPPLSVIVALSLSASPVTIDSSAAATTVPSFVFSDGRKLNGATVLLRYVGRSAKKLPDFYGNNAFDSSQIDEWVDYASVFSSGSEFENACGRVDKYLESSTFLVGHSLSIADVAIWSALAGTGQRWESLRKSKKYQSLVRWFNSILDEYSEVLNKVLATYVKKGSGKPVAAPKSKDSQQAVKGDGQDKGKPEVDLPEAEIGKVKLRFAPEPSGYLHIGHAKAALLNKYFAERYQGEVIVRFDDTNPAKESNEFVDNLVKDIGTLGIKYEKVTYTSDYFPELMDMAEKLMREGKAYVDDTPREQMQKERMDGIDSKCRNHSVEENLKLWKEMIAGSERGLQCCVRGKFNMQDPNKAMRDPVYYRCNPMSHHRIGDKYKIYPTYDFACPFVDSLEGITHALRSSEYHDRNAQYFKVLEDMGLRQVQLYEFSRLNLVFTLLSKRKLLWFVQTGLVDGWDDPRFPTVQGIVRRGLKIEALIQFILEQGASKNLNLMEWDKLWSINKRIIDPVCPRHTAVVAERRVLFTLTDGPDEPFVRMIPKHKKFEGAGEKATTFTKSIWLEEADASAISVGEEVTLMDWGNAIVKEITKDEEGRVTALSGVLNLQGSVKTTKLKLTWLPDTNELVNLTLTEFDYLITKKKLEDDDEVADFVNPNTKKETLALGDSNMRNLKCGDVIQLERKGYFRCDVPFVKSSKPIVLFSIPDGRAAK

SEQ ID NO: 1089 - protein, 646 aa, Arabidopsis thaliana
MSSKRASQYHQVEIPPPQPFLKSLKNTLNEILFADDPFRRIRNESKTSKKIELGLRHVFPILEWARGYSLEYLKSDVISGITIASLAIPQGISYAQLANLPPILGLYSSLVPPLVYAIMGSSRDLAVGTVAVASLLTAAMLGKEVNAVVNPKLYLHLAFTATFFAGLMQTCLGLLRLGFVVEILSHAAIVGFMGGAATVVCLQQLKGLLGLHHFTHSTDIVTVLRSIFSQSHMWRWESGVLGCCFLIFLLTTKYISKKRPKLFWISAMSPLVSVIFGTIFLYFLHDQFHGIQFIGELKKGINPPSITHLVFTPPYVMLALKVGIITGVIALAEGIAVGRSFAMYKNYNIDGNKEMIAFGMMNILGSFSSCYLTTGPFSRSAVNYNAGCKTALSNVVMAVAVAVTLLFLTPLFFYTPLVVLSSIIIAAMLGLVDYEAAIHLWKLDKFDFFVCLSAYLGVVFGTIEIGLILSVGISVMRLVLFVGRPKIYVMGNIQNSEIYRNIEHYPQAITRSSLLILHIDGPIYFANSTYLRDRIGRWIDEEEDKLRTSGDISLQYIVLDMSAVGNIDTSGISMLEELNKILGRRELKLVIANPGAEVMKKLSKSTFIESIGKERIYLTVAEAVAACDFMLHTAKPDSPVPEFNNV

SEQ ID NO: 1090 - protein, 570 aa, Arabidopsis thaliana
MITGNEFYTVMCAMAPLYFAMFVAYGSVKWCKIFTPAQCSGINRFVSVFAVPVLSFHFISQNNPYKMDTMFILADTLSKIFVFVLLSLWAVFFKAGGLDWLITLFSIATLPNTLVMGIPLLQAMYGDYTQTLMVQLVVLQCIIWYTLLLFLFELRAARLLIRAEFPGQAAGSIAKIQVDDDVISLDGMDPLRTETETDVNGRIRLRIRRSVSSVPDSVMSSSLCLTPRASNLSNAEIFSVNTPNNRFFHGGGGSGTLQFYNGSNEIMFCNGDLGGFGFTRPGLGASPRRLSGYASSDAYSLQPTPRASNFNELDVNGNGTPVWMKSPAAGRIYRQSSPKMMWESGQRHAAKDINGSVPEKEISFRDALKAAPQATAAGGGASMEEGAAGKDTTPVAAIGKQEMPSAIVMMRLILTVVGRKLSRNPNTYSSLLGLVWSLISFKWNIPMPNIVDFSIKIISDAGLGMAMFSLGLFMALQPKMIPCGAKKATMGMLIRFISGPLFMAGASLLVGLRGSRLHAAIVQAALPQGIVPFVFAREYNLHPDLLSTLVIFGMIVSLPVTILYYVLLGL

SEQ ID NO: 1091 - protein, 427 aa, Arabidopsis thaliana
MKQTDGRERKAYLSLLYFAVILLPVFLLGCYLYNEKQLRVGQFQEFNTHNLQEHITPLQQSKEDKDKKTDLVPLEFCDVFTGKWVLDNVTHPLYKEDECEFLSEWVACTRNGRPDSKYQKWRWQPQDCSLPRFDSKLLLEKLRGKKLMFIGDSIHYNQWQSMVCMVQSVIPSGKKTLKHTAQMSIFNIEEYNATISFYWAPFLVESNADPPDKRDGKTDPVIIPNSISKHGENWKDADYLIFNTYIWWTRHSTIKVLKQESFNKGDSKEYNEIGIYIVYKQVLSTWTKWLEQNINPSQTSIFFSSMSPTHIRSSDWGFNEGSKCEKETEPILNMSKPINVGTNRRLYEIALNATKSTKVPIHFLNITTMSEYRKDGHTSFYGSINGKLMTPEQKLDPRTFADCYHWCLPGLPDSWNELLSLYIIYKI

SEQ ID NO: 1092 - protein, 468 aa, Arabidopsis thaliana
MGEIVVLSSDDGMETIKNRVKSSEVVQWEKYLPKTVLRVLLVESDYSTRQIITALLRKCCYKVVAVSDGLAAWEVLKEKSHNIDLILTELDLPSISGFALLALVMEHEACKNIPVIMMSSQDSIKMVLKCMLRGAADYLIKPMRKNELKNLWQHVWRRLTLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 1093 - protein, 503 aa, Arabidopsis thaliana
MYRTAASRARALKGVLTRSLRPARYASSSAVAETSSSTPAYLSWLSGGSRAALTSLDMPLQGVSLPPPLADKVEPSKLQITTLPNGLKIASETTPNPAASIGLYVDCGSIYEAPYFHGATHLLERMAFKSTLNRTHFRLVREIEAIGGNTSASASREQMSYTIDALKTYVPEMVEVLIDSVRNPAFLDWEVNEELRKMKVEIAELAKNPMGFLLEAIHSAGYSGPLASPLYAPESALDRLNGELLEEFMTENFTAARMVLAASGVEHEELLKVAEPLTSDLPNVPPQLAPKSQYVGGDFRQHTGGEATHFAVAFEVPGWNNEKEAVTATVLQMLMGGGGSFSAGGPGKGMHSWLYRRVLNEYQEVQSCTAFTSIFNDTGLFGIYGCSSPQFAAKAIELAAKELKDVAGGKVNQAHLDRAKAATKSAVLMNLESRMIAAEDIGRQILTYGERKPVDQFLKSVDQLTLKDIADFTSKVISKPLTMGSFGDVLAVPSYDTISSKFR

SEQ ID NO: 1094 - protein, 183 aa, Arabidopsis thaliana
MKNPILKTWRKVKSFGHTSSSTTPSFTKSKSCHGSFRLEDAKSNESKGKPKKESPSHGFFTVYVGPTKQRIVVKTKLLNHPLFKNLLEDAETEYGYRRDGPIVLPCEVDFFFKALADMKSNPGHHDHDDDYDDDDGFTNSPICGFVCSPYRSYGGGVTDPLAMKRNGSYKLLRSPSLFKLTRF

SEQ ID NO: 1095 - protein, 400 aa, Arabidopsis thaliana
MASLALTSPPSVKIPSYLSSSSSSLFSRSSISFRTTESRSRICVSGYAKCNLPKALNGNARVPIINETTIPKFFDSSRLEKSVSRNNTKLKLFSGTANPALSQEIAWYMGLELGKVSIKRFADGEIYVQLKESVRGCDVFLVQPTCTPTNENLMELLIMVDACRRASAKKVTAVIPYFGYARADRKTQGRESIAAKLVANLITEAGADRVLACDLHSGQSMGYFDIPVDHVYCQPVILDYLASKSISSEDLVVVSPDVGGVARARAFAKKLSDAPLAIVDKRRHGHNVAEVMNLIGDVKGKVAVMVDDIIDTAGTIVKGAALLHEEGAREVYACCTHAVFSPPAIERLSSGLLQEVIVTNTLPVAEKNYFPQLTILSVANLLGETIWRVHDDSSVSSIFL

SEQ ID NO: 1096 - protein, 174 aa, Arabidopsis thaliana
MASHPKVFFDMTIGGAPAGKIVMELYTDKTPKTAENFRALCTGEKGVGRSGKPLHFKGSSFHRVIPNFMCQGGDFTKGNGTGGESIYGAKFEDENFERKHTGPGILSMANAGANTNGSQFFICTVKTDWLDGKHVVFGQVVEGLDVVKAIEKIGSSSGKPTKPVVIADCGEISS

SEQ ID NO: 1097 - protein, 402 aa, Arabidopsis thaliana
MMRSVDVYVKTLGPPVRSILYSIFTSQQKPSSLPSLPFHFSLRSSSNIPTRCFSNVVAKSNSPIYDFQGFRNLFTERAISSSTTTPVASAQPQQLQNQNQHPAEVDEEISMGLEDEAKLSIPVRAYFFSTSVDLRSLIEQNKQNFIPPTSRMTNYVVLKFGNHSDPTDTTRGRISGSESIYMVVFHYGSIVLFNVREHEVDEYLKVVERHASGLLPEMRKDEYEVRENPNLDTWMEVGRDFIRLQFLNTDGIRTIGCVLGQSIALDYYGRQVDGMVAEFTEINRQLEITGTFTMKRKKLFQLVGKANVILADVILKLGLFERSDIAWKDAKYGQIWEFLRDEFELTQSFANLDYKLKFVEHNVRFLQEILQNRKSATLEWLIIILISMEIAISFYNMSRASL

SEQ ID NO: 1098 - protein, 288 aa, Arabidopsis thaliana
MEIKVKAKDVESTMMSTKEEDEIKKMKECVVIQKADEEVTKGQETMKILDGSRQNQDETRQADSKNIDSPSSSSLEMKKKLEIDQKFTSQNEENTKKEEEKKKETNNNNLSNMKHKKTSSHVWDCGSTLYDSFELNSFKRQLDSAISASSARTMSMSHLPDRRIPSLSSLSPEYSPPLPPPPTTSSSSSSGGKKHSNKISRSLQRFLKSMFKPKQHQSLTTPSSPVYKAVGHGGGDKDRYYVVYDKSGSLTTIPESTEKEVSPEINSLVRKTVSERFPASRVVGISCA

SEQ ID NO: 1099 - protein, 125 aa, Arabidopsis thaliana
MAGRLSGVASRIMGGNGVVARSVGSSLRQRAGMGLPVGKHIVPDKPLSVNDELMWDNGTAFPEPCIDRIADTVGKYEALAWLSGGLGFFVGLGLLAVLNDKASKVPFTPRVYPYDNLRVELGGEP

SEQ ID NO: 1100 - protein, 170 aa, Arabidopsis thaliana
MQQRKPTAGRPSGTDGSDFSYRMVVDSRYTKVTKEKARLRPLIFVQAAIYVIGLSCAFLTTTKKDEKNTLAIAAAVAGLVCSLIGELGCRRSRVNLLRLYTAASTIVMVLSVFCAVRSRLTMEERNSSGTTAKLELAGFICAQLGAVVQILAIIVTGSLVNNMSPPTKAA

SEQ ID NO: 1101 - protein, 224 aa, Arabidopsis thaliana
MADSVLKEVNCGRPEKIPKLDKACEGSKSSWKHLKLGNVEDDEYLRQYCLFHYEFHKSEGFTVDWEKYDYMFHIRPLENSPPISDIRTNADVIRDVTLFAIEKHNEAHGSKLVFVEHVSANFKFANGLLCWLTFWATDMASSAPTSQIYQVELWRRGKQFEIPIFRVKPKDEEMDDVEVKPPSPMPYDDYDKPPVVFVRAAPEDGVPFVFDRTGALYDLYRSGL

SEQ ID NO: 1102 - protein, 180 aa, Arabidopsis thaliana
MASSLIFLLLVTLTFSASTLISAKSNTTTIIESTCKTTNYYKFCVSALKSDPRSPTADTKGLASIMVGVGMTNATSTANYIAGNLSATVKDTVLKKVLQDCSEKYALAADSLRLTIQDLDDEAYDYASMHVLAAQDYPNVCRNIFRRVKGLAYPVEIRRREASLRRICGVVSGILDRLVE

SEQ ID NO: 1103 - protein, 133 aa, Arabidopsis thaliana
MASFTASASTVSAARPALLLKPTVAISAPVLGLPPMGKKKGGVRCSMETKQGNVSVMGAGVSAAATAALTAVMSNPAMALVDERMSTEGTGLPFGLSNNLLGWILFGVFGLIWTFFFVYTSSLEEDEESGLSL

SEQ ID NO: 1104 - protein, 134 aa, Arabidopsis thaliana
MASKALAVTALLITLNLLFFTFVTSTKCPPTTPKPPKTPKSPKKAPAVKPTCPTDTLKLGVCADLLGLVNVVVGSPPKTPCCTLLQGLANLEAAVCLCTALKANVLGINLNVPIDLTLLLNYCGKKVPHGFQCS

SEQ ID NO: 1105 - protein, 132 aa, Arabidopsis thaliana
MAGRGKTLGSGVAKKSTSRSSKAGLQFPVGRIARFLKNGKYATRVGAGAPVYLAAVLEYLAAEVLELAGNAARDNKKTRIVPRHIQLAVRNDEELSKLLGDVTIANGGVMPNIHSLLLPKKAGASKPSADED

SEQ ID NO: 1106 - protein, 140 aa, Arabidopsis thaliana
MSTSGDKATSSTNNPNNSYEITPPATDSISSLSFSPKADILVATSWDCQVRCWEITRSDGSIASEPKVSMSHDQPVLCSAWKDDGTTVFTGGCDKQAKMWPLLSGAQPSTVAMHDAPFNQIAWIPGMNLLVTGSWDKTLK

SEQ ID NO: 1107 - protein, 469 aa, Arabidopsis thaliana
MPRVIPPENLGCPPFRALTFDSLGLIKVTEARGQERGIPTVVNTWGEMNASRSVLAASIDDRLRNPLLAVARKDGNVEVINPCNGDLHFSYSVFGDDGCSPEDNEISALHLFRKKIDDQTERSCTLLTCTKKGDVSLRSVKFPDAHGNSTDDASPKTWKACGSGEILVGKVDGSENFSLFGGKRVEANIWDLEQCTKIWSAKCPPKNNLGIFTPTWFTSATFLSKDDHRKFVTGTKSHQVRLYDISTQRRPVLSFDFRETAITSIAEDPDGHTIYVGNASADLASFDIRTGKLLGSFLGKCSGSIRSVVRHPQHQVIASCGLDRYLRVYDVKTRQLISAVFLKQHLTGLVFDSGFSGEAETAVANTVAEAATEEKMTIMDQEDDETEKAPVKRKKSKKEKRSREIVFEGEDDEENEDEIEKAPVKTKKSKKEKRSREKVSEGEEKDELRSKKTREHKKKTKIVKHNQED

SEQ ID NO: 1108 - protein, 511 aa, Arabidopsis thaliana
MALEIEARDVIKIMLQFCKENSLNQTFQTLQSECQVSLNTVDSVETFISDINSGRWDSVLPQVSQLKLPRNKLEDLYEQIVLEMIELRELDTARAILRQTQVMGVMKQEQAERYLRMEHLLVRSYFDPHEAYGDSTKERKRAQIAQAVAAEVTVVPPSRLMALIGQALKWQQHQGLLPPGTQFDLFRGTAAMKQDVEDTHPNVLTHTIKFGKKSHAECARFSPDGQFLASSSVDGFIEVWDYISGKLKKDLQYQADESFMMHDDPVLCIDFSRDSEMLASGSQDGKIKIWRIRTGVCIRRFDAHSQGVTSLSFSRDGSQLLSTSFDQTARIHGLKSGKLLKEFRGHTSYVNHAIFTSDGSRIITASSDCTVKVWDSKTTDCLQTFKPPPPLRGTDASVNSIHLFPKNTEHIVVCNKTSSIYIMTLQGQVVKSFSSGNREGGDFVAACVSTKGDWIYCIGEDKKLYCFNYQSGGLEHFMMVHEKDVIGITHHPHRNLLATYSEDCTMKLWKP

SEQ ID NO: 1109 - protein, 555 aa, Arabidopsis thaliana
MSSDQRWRLLRPAFFIFFFLFFLPHNLTFGLCFNTEALALMKFKERIEIDPFGALVNWGELSHCSWSGVVCSHDGRVVILNLRDLSLQGTLAPELGNLTHLKSLILRNNSFSGKVPEEVTELQELEILDLCDNNFGQPFPFARRLLQISPPPSQPSPPSPMEEVPIDFPFFFAPPPQNIGASPPTETQVIPNPSPVPPPPAQPPPAQTPPPQLSEVPHAVNKKKSHKSKMYIIVGVLVGVLGVMAALVAFFFLWNQKVKLIKPWGETGSSGQLQDVVTTGVPKLKLAELETACEDFSNIIGSTSSDATIYKGTLSTGSEIAVLAVASGSLQDWSEDHETQFQEKIQRLSQVNHKNFLNVIGYCHEDEPFNRMLVFEYAPNGSLFEHLHDQDAEHLDWPMRLRIVMGIAYCMEHMHNLNPKPISHTNLNSSSVYLATDYAAKVSDFTFLSSTPLDPMTNVSSFGALLQEIITGKIPDPDSLLQEETKPVADPTLKSFQEEVMERVWEVVKECLSQKVEMKEVVVKLREITGITPEAALPSRSPAWWAELEIISTEM

SEQ ID NO: 1110 - protein, 485 aa, Arabidopsis thaliana
MVGRRKALLFSLCFFFLSLPSFSSLPSFQTLFPNSHSLPCASPVSFQPDSDSESLLESEFESGSDSESSSSITLNLDHIDALSSNKTPDELFSSRLQRDSRRVKSIATLAAQIPGRNVTHAPRPGGFSSSVVSGLSQGSGEYFTRLGVGTPARYVYMVLDTGSDIVWLQCAPCRRCYSQSDPIFDPRKSKTYATIPCSSPHCRRLDSAGCNTRRKTCLYQVSYGDGSFTVGDFSTETLTFRRNRVKGVALGCGHDNEGLFVGAAGLLGLGKGKLSFPGQTGHRFNQKFSYCLVDRSASSKPSSVVFGNAAVSRIARFTPLLSNPKLDTFYYVGLLGISVGGTRVPGVTASLFKLDQIGNGGVIIDSGTSVTRLIRPAYIAMRDAFRVGAKTLKRAPDFSLFDTCFDLSNMNEVKVPTVVLHFRGADVSLPATNYLIPVDTNGKFCFAFAGTMGGLSIIGNIQQQGFRVVYDLASSRVGFAPGGCA

SEQ ID NO: 1111 - protein, 266 aa, Arabidopsis thaliana
MAGAEQSQRWSLKAKTVLVTGGTKGIGHAIVEEFAGFGAVIHTCARNEYELNECLSKWQKKGFQVTGSVCDASLRPEREKLMQTVSSMFGGKLDILINNLGAIRSKPTLDYTAEDFSFHISTNLESAYHLSQLAHPLLKASGCGNIIFMSSIAGVVSASVGSIYSATKGALNQLARNLACEWASDGIRANAVAPAVIATPLAEAVYDDEFKKVVISRKPLGRFGEPEEVSSLVAFLCMPAASYITGQTICVDGGLTVNGFSYQPQG

SEQ ID NO: 1112 - protein, 173 aa, Arabidopsis thaliana
MDHDKTGCQSPPEGPKLCTNNCGFFGSAATMNMCSKCHKDMLFQQEQGAKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKAEKLDKI

SEQ ID NO: 1113 - protein, 108 aa, Arabidopsis thaliana
MKIIVSILVLASLLLISSSLASATISDAFGSGAVAPAPQSKDGPALEKWCGQKCEGRCKEAGMKDRCLKYCGICCKDCQCVPSGTYGNKHECACYRDKLSSKGTPKCP

SEQ ID NO: 1114 - protein, 460 aa, Arabidopsis thaliana
MAKTGVFDSDPTAIAKAKELKREMKKLLIKIDDEDDLGVQTIDQLQDALSALREATMRKMAKSSSLEMLETVSCPEEFRCPLSNELMRDPVVLASGQTYDKLFIQKWLSSGNRTCPKTQQVLPHTALTPNLLIREMISKWCKKNGLETKSQYHPNLVNEDETVTRSDREIFNSLLCKVSSSNLQDQKSAAKELRLLTRKGTEFRALFGESPDEITRLVNPLLHGSNPDEKLQEDVVTTLLNISIHDDSNKKLVCENPNVIPLLIDALRRGTVATRSNAAAAIFTLSALDSNKVLIGKSGILKPLIDLLEEGNPLAIKDVAAAIFTLCIAHENRSRAVRDGAVRVLGKKISNGLYVDELLAILAMLVTHWKAVEELGELGGVSWLLKITRESECKRNKENAIVILHTICFSDRTKWKEIKEEENAHGTITKLSREGTSRAQRKANGILDRLRKAMNLTHTA

SEQ ID NO: 1115 - protein, 391 aa, Arabidopsis thaliana
MVQISDLPRDLTEEVLSRIPVTSMRAVRFTCKKWNTLSKDRSFTKKHLRGARAAAKKKQTKEFQVIMMIQFRVYLYSVNLLNPSIERIGKLISLDVEDHVDISKIFHCGGLLLCITKDISRLVVWNPYSGQTRWIKPRNSYHRLDRYALGYEEKNKSCRCYKILRFMDDYEDDRALRLIREFEIYDLNSDSWKVVNVTPDWDVEFYHRGLSLKGNTYWFAQEKLPPLPRGRVITISDMADFLLCFDFTRERFGPRLPLPFHSFVEDTVTLSSVRDKKLAVLFQPCSASTVKIWISRKIEPNAVSWRKVFLAVDMKSLTGFQFDINAASFFVDEKKKVAMVLDKDRFSYKFTRNIAYIIGKKGYFEKVDLGESTVSSCASLVCSYVPSSVQI

SEQ ID NO: 1116 - protein, 430 aa, Arabidopsis thaliana
MAMATRTLGFVLPTSLSSQPSFDRRGGGFRVSVIRCSTSPLTFPTSGVVEKPWTSYNARLVLEDGSIWPAKSFGAPGTRIAELVFNTSLTGYQEILTDPSYAGQFVLMTNPQIGNTGVNPDDEESGQCFLTGLVIRNLSISTSNWRCTKTLADYLTERDIMGVYDLDTRAITRRLREDGSLIGVLSTEQSKTDDELLQMSRSWDIVGIDLISDVSCKSPYEWVDKTNAEWDFNTNSRDGKSYKVIAYDFGIKQNILRRLSSYGCQITVVPSTFPAAEALKMNPDGILFSNGPGDPSAVPYAVETVKELLGKVPVYGICMGHQLLGQALGGKTFKMKFGHHGGNHPVRNNRTGQVEISAQNHNYAVDPASLPGGVEVTHVNLNDGSCAGLSFPEMNVMSLQYHPEASPGPHDSDNAFREFIELMKRSKQSS

SEQ ID NO: 1117 - protein, 415 aa, Arabidopsis thaliana
MSKKKKGSNNFKLLCFFLFLGGLVQTDASFGVGGGVGVGIGGGGGGGGGGVWVGGGYNNGGNRNAVPGSSAPNRVAYNALQVWKSAMREDPSNVLKTWVGSDVCSYKGVFCSGQSITSIDLNHANLKGTLVKDLALLSDLNILHLNSNRFSGQIPDSFKSLASLQELDLSNNKLSGPFPLVTLYIPNLVYLDLRFNSLTGFIPEELFNKRLDAILLNNNQFVGEIPRNLGNSPASVINLANNRFSGEIPTSFGLTGSRVKEVLLLNNQLTGCIPESVGMFSEIEVFDVSYNALMGHVPDTISCLSAIEILNLAHNKFSGEVPDLVCSLRNLINLTVAFNFFSGFSSECSSRVSFGFDFVGNCIPGRNSQRPQPDCSGYSGGAMSCFRIPTQPLACAAISVGLRESNNQYYTSSPP

SEQ ID NO: 1118 - protein, 526 aa, Arabidopsis thaliana
MASSCLFNASVSSLNPKQDPIRRHRSTSLLRHRPVVISCTADGNNIKAPIETAVKPPHRTEDNIRDEARRNRSNAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFKDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTS

SEQ ID NO: 1119 - protein, 285 aa, Arabidopsis thaliana
MSTNTESSSYSSLPSQRLLGKVALITGGATGIGESIVRLFHKHGAKVCIVDLQDDLGGEVCKSLLRGESKETAFFIHGDVRVEDDISNAVDFAVKNFGTLDILINNAGLCGAPCPDIRNYSLSEFEMTFDVNVKGAFLSMKHAARVMIPEKKGSIVSLCSVGGVVGGVGPHSYVGSKHAVLGLTRSVAAELGQHGIRVNCVSPYAVATKLALAHLPEEERTEDAFVGFRNFAAANANLKGVELTVDDVANAVLFLASDDSRYISGDNLMIDGGFTCTNHSFKVFR

SEQ ID NO: 1120 - protein, 126 aa, Arabidopsis thaliana
MDSPFKPDVVRGQVALITGGGSGIGFEISSQFGKHGASIAIMGRRKQVLDDAVSALRSLGIQAIGLEGDVRKQEDARRVVEATFQHFGKLDILVNAAAGNFLAAAEDLSPNGFRTGSFFVFSLRRA

SEQ ID NO: 1121 - protein, 364 aa, Arabidopsis thaliana
MKKKKEGLGWIESIKGWSCVFHEFLFQRFMASHLQNPLPLPSLNHLTCIVTGSTSGIGRETARQLAEAGARVVMAVRNTKAAHELIQQWQKEWSGKGIPLNLEAMELDLLSLDSVVGFCNLWNARLSPLHVLINNAGIFSMGEEQKFSKDGYEQHMQVNHLAPALLSLLLLPSLIRGSPSRIINVNSVMHYVGFVDPDDMNVVSGKRKFTSLVGYSGSKLAQVMFSNVLLKRLPLETRISVVCLSPGIVLTNVARDLPRYVQVQYALIPYFIFSPQEGSRSTLFSATDAQIPEHCEKLKTEDKPVCTFISQNCKHTKPSEEAHNVETAERVWEKTIKLIGLPLDAVERLIEGEEVQCRYGTHQQ

SEQ ID NO: 1122 - protein, 348 aa, Arabidopsis thaliana
  misc_feature (281)..(281): Xaa can be any naturally occurring amino acid
MATWSGFNVSSSPLLRLRSSSVSNVTKLPFLSPICRRRLLAERFGLATVVVTRQNLTVTPSSAAVEARISGKREPMTPPYNILITGSTKGIGYALAREFLKAGDNVVICSRSAERVETAVQSLKEEFGEHVWGTKCDVTEGKDVRELVAYSQKNLKYIDIWINNAGSNAYSFKPLAEASDEDLIEVVKTNTLGLMLCCREAMNMMLTQSRGGHIFNIDGAGSDGRPTPRFAAYGATKRSVVHLTKSLQAELQMQDVKNVVVHNLSPGMVTTDLLMSGATTXQAKFFINVLAEPAEVVAEYLVPNIRAIPASGSMKPTYIRFLTGIKAYTKIFSRVALGARKNRYVTEE

SEQ ID NO: 1123 - protein, 591 aa, Arabidopsis thaliana
MMGICEMKSCCSWLLLISLLCSLSNESQAISPDGEALLSFRNAVTRSDSFIHQWRPEDPDPCNWNGVTCDAKTKRVITLNLTYHKIMGPLPPDIGKLDHLRLLMLHNNALYGAIPTALGNCTALEEIHLQSNYFTGPIPAEMGDLPGLQKLDMSSNTLSGPIPASLGQLKKLSNFNVSNNFLVGQIPSDGVLSGFSKNSFIGNLNLCGKHVDVVCQDDSGNPSSHSQSGQNQKKNSGKLLISASATVGALLLVALMCFWGCFLYKKLGKVEIKSLAKDVGGGASIVMFHGDLPYSSKDIIKKLEMLNEEHIIGCGGFGTVYKLAMDDGKVFALKRILKLNEGFDRFFERELEILGSIKHRYLVNLRGYCNSPTSKLLLYDYLPGGSLDEALHERGEQLDWDSRVNIIIGAAKGLSYLHHDCSPRIIHRDIKSSNILLDGNLEARVSDFGLAKLLEDEESHITTIVAGTFGYLAPEYMQSGRATEKTDVYSFGVLVLEVLSGKRPTDASFIEKGLNVVGWLKFLISEKRPRDIVDPNCEGMQMESLDALLSIATQCVSPSPEERPTMHRVVQLLESEVMTPCPSEFYDSSSD

SEQ ID NO: 1124 - protein, 563 aa, Arabidopsis thaliana
MESFALHSLSTTATSTLLSHHHHHHPSRLSLLRRTSSRSPPSTISLRSLSVQPLSFPLLKPIPRFSTRIAAAPQDNAPPPPPPSPSPSPSPQGAKLIPLILSISVGLILRFAVPVPEGVTPQGWQLLSIFLSTIAGLVLSPLPVGAWAFIGLTASIVTKTLSFSAAFSAFTSEVIWLIVISFFFARGFVKTGLGDRIATYFVKWLGKSTLGLSYGLTLSEALIAPAMPSTTARAGGIFLPIIKSLSLSAGSKPNDSSSRKLGSYLIQSQFQCAGNSSALFLTAAAQNLLCLKLAEELGVVISNPWVSWFKAASLPAIISLLCTPLILYKLYPPETKDTPEAPGIAATKLKQMGPVTKNEWIMVGTMLLAVTLWICGETLGIPSVVAAMIGLSILLVLGVLNWDDCLSEKSAWDTLAWFAVLVGMAGQLTNLGVVTWMSDCVAKVLQSLSLSWPAAFGLLQAAYFFIHYLFASQTGHVGALFSAFLAMHIAAGVPGILAALALAYNTNLFGALTHYSSGQAAVYYGAGYVDLPDVFKIGFVMATINAIIWGVVGTFWWKFLGLY

SEQ ID NO: 1125 - protein, 352 aa, Arabidopsis thaliana
MTSSEPLDLVVTVVSAKHLKNVNWRNGDLKPYVVLYLDQDHPLSTRSDDSSSIKPVWNERITLPLTRSVHESVLNIEVFHSNSSDLAKTLVGSVRFPLARLIDSDGSMIPELINSLELVRPSGRPQGKIRLKLAIKDRPIPPPQHPPPRPQSQPLDYYSAPQGNHYYSPSPPPPPPPQAPITAPSPQRDYREFSQSPSPSPYAFTDHYYSGYYYPPPPPRSMYDRASNYGLPSGPSAPVDAFSSIDHKQPPLAPPRFSNYGPPPSGPSAPVDAFLVTEYKPQAPPMGSRLSSYGVPNGPSAPVDYSPYDHRQLQKTMGGLSLEEERAAAERSESDFGARPNYSYGRDYRREC

SEQ ID NO: 1126 - protein, 223 aa, Arabidopsis thaliana
MVLNDEEMKAGESSEEPKGQGLSRKNSHSSMCPTDDDEEEEDKKLELGPMIALKEQLEKDKDDESLRRWKEQLLGSVDLEEVGETPDPLVKILTLTIRSPDREDMVLTIPENGKPASKGPWFTLKEGSKYTLIFTFRVTNNIVSGLQYSNTVWKTGIKVYSRKEMLGTFSPQAEPYTHVMFEETAPSGLLVRGSYSVKSKFVDDDNQCYLENNYTFDIRKNWL

SEQ ID NO: 1127 - protein, 597 aa, Arabidopsis thaliana
MEGKKEMGSYKFCLIFTRKFRMTESGPVEDVRDLFEKYTEGDAHMSPEQLQKLMTEEGGEGETSLEEAERIVDEVLRRKHHIAKFTRRNLTLDDFNYYLFSTDLNPPIADQVHQNMDAPLSHYFIFTGHNSYLTGNQLSSNCSELPIADALRRGVRVVELDLWPRGTDDVCVKHGRTLTKEVKLGKCLESIKANAFAISKYPVIITLEDHLTPKLQFKVAKMITQTFGDMLYYHDSQGCQEFPSPEELKEKILISTKPPKEYLEANDTKEKDNGEKGKDSDEDVWGKEPEDLISTQSDLDKVTSSVNDLNQDDEERGSCESDTSCQLQAPEYKRLIAIHAGKPKGGLRMALKVDPNKIRRLSLSEQLLEKAVASYGADVIRFTQKNFLRIYPKGTRFNSSNYKPQIGWMSGAQMIAFNMQGYGRALWLMEGMFRANGGCGYVKKPDFLMDASPNGQDFYPKDNSSPKKTLKVKVCMGDGWLLDFKKTHFDSYSPPDFFVRVGIAGAPVDEVMEKTKIEYDTWTPIWNKEFTFPLAVPELALLRVEVHEHDVNEKDDFGGQTCLPVSEIRQGIRAVPLFNRKGVKYSSTRLLMRFEFV

SEQ ID NO: 1128 - protein, 339 aa, Arabidopsis thaliana
MKPKSKVAESTAASCFLVMSLLCSCIIGDQMETNNEGLSYSYYEKTCPKVEEIVRSSLSSMFILDPTSPAALLRLMFHDCQVQGCDASILLEPIRDQQFTELDSAKNFGIRKRDLVGSIKTSLELECPKQVSCSDVIILAARDAVALTGGPLISVPLGRKDSLSTPSKHVADSELPPSTADVDTTLSLFANKGMTIEESVAIMGAHTIGVTHCNNVLSRFDNANATSENMDPRFQTFLRVACPEFSPTSQAAEATFVPNDQTSVIFDTAYYDDAIAGRGNLRIDSEIGADPRTRPFVEAFAADQDRFFNAFSSAFVKLSSYKVLTGNEGVIRSVCDKVD

SEQ ID NO: 1129 - protein, 506 aa, Arabidopsis thaliana
MASISLLQVSVAILCFLILHYFLFKKPHGRYPRNWPVLRMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 1130 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 1131 - protein, 491 aa, Arabidopsis thaliana
MDYVLIVLPLALFLIAYKFLFSSKTQGFNLPPGPTPFPIVGHLHLVKPPVHRLFRRFAEKYGDIFSLRYGSRQVVVISSLPLVRESFTGQNDVILTNRPHFLTAKYVAYDYTTIGTAAYGDHWRNLRRICSLEILSSNRLTGFLSVRKDEIRRLLTKLSREYDGRVVELEPLLADLTFNNIVRMVTGRRYYGDQVHNKEEANLFKKLVTDINDNSGASHPGDYLPILKVFGHGYEKKVKALGEAMDAFLQRLLDECRINGESNTMVSHLLSLQLDQPKYYSDVIIKGLMLSMMLAGTDTAAVTLEWAMANLLKKPEVLKKAKAEIDEKIGEERLVDEPDIANLPYLQNIVSETFRLCPAAPLLVPRSPSEDLKIGGYDIPRGTIVLVNAWAIHRDPRLWDEPEKFMPERFEDQEASKKLMVFGNGRRTCPGATLGQRMVLLALGSLIQCFDWEKVNGEDVDMTENPGMAMRKLVQLRAVCHKRPIMTNLLA

SEQ ID NO: 1132 - protein, 579 aa, Arabidopsis thaliana
MDSLSSMGFQTASFFLILLFLFYHLPCVPSQQERSRLCKPFQCGDITVGFPFWGENRQSDCGHFSLKLNCNKPSNTTSLTISGHNYSVLHIDNKSNILSLSRQDFSGPFCSASFSSTPLRSDLFQNLQPYRNLTVFYMCDPRRHFFGNFTCPVKGLGSVVQNSTYRKLCDKSFSVTVPTSYVPEEEALNLTHLESVLRKGLEVKLKISEMSGQECVTTDGNSGFTRFCCTNVSGPEISCLTSITTMNNGTYSDNRPFLVTIGTAFYLNERRIAKAARIQHLEALGTLRGGRLRDGRKVAVKVLKDSKGNCEDFINEVASMSQTSHVNIVTLLGFCYEGSKRAIIYEFLENGSLDQSLNLDVSTLYGIALGVARGLEYLHYGCKTRIVHFDIKPQNVLLDENLRPKVADFGLAKLCEKQESILSLLDTRGTIGYIAPELFSRMYGSVSHKSDVYSYGMLVLEMIGARNKERVQNADPNNSSAYFPDWIYKDLENFDNTRLLGDGLTREEEKNAKKMILVGLWCIQFRPSDRPSMNKVVEMMEGSLDSLDPPPKPLLHMPMQNNNAESSQLSVESSIYSEV

SEQ ID NO: 1133 - protein, 512 aa, Arabidopsis thaliana
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 1134 - protein, 480 aa, Arabidopsis thaliana
MVKICCIGAGYVGGPTMAVIALKCPDVEVAVVDISVPRINAWNSDTLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIKDLFNPDRVLIGGRETPEGFKAVQTLKNVYAHWVPEGQIITTNLWSAELSKLAANAFLAQRISSVNAMSALCEATGADVTQVSYAVGTDSRIGPKFLNSSVGFGGSCFQKDILNLVYICECNGLPEVAEYWKQVIKINDYQKSRFVNRVVSSMFNSVSNKKIAVLGFAFKKDTGDTRETPAIDVCKGLLEDKARLSIYDPQVTEDQIQRDLSMNKFDWDHPLHLQPMSPTTVKQVTVTWDAYEATKDAHGICIMTEWDEFKNLDFQKIFDNMQKPAFVFDGRNIMNLQKLREIGFIVYSIGKPLDDWLKDMPAVA

SEQ ID NO: 1135 - protein, 159 aa, Arabidopsis thaliana
  misc_feature (117)..(117): Xaa can be any naturally occurring amino acid
MAEQQDHHKELQLLPSPPSTESPVRKHRPTVITTDHHNNHHRSSSMIHHDLDLKLSISLSSISTAEELPNGGVEALKWQAAEQIRLAAIEKAYAERVRELTRREMEMAQSEFARARXVMWQKAREEVERAERLKERSMTKIDTACLEITCHSCRQRFRP

SEQ ID NO: 1136 - protein, 333 aa, Arabidopsis thaliana
MGLCFSSPKATRRGTGSRNPNPDSPTQGKASEKVSNKNKKNTKKIQLRHQGGIPYGKRIDFGYAKDFDNRYTIGKLLGHGQFGFTYVATDNNNGNRVAVKRIDKAKMTQPIEVEDVKREVKILQALGGHENVVGFHNAFEDKTYIYIVMELCDGGELLDRILANRYTEKDAAVVVRQMLKVAAECHLRGLVHRDMKPENFLFKSTEEGSSLKATDFGLSDFIKPGVKFQDIVGSAYYVAPEVLKRRSGPESDVWSIGVITYILLCGRRPFWDKTQDGIFNEVMRKKPDFREVPWPTISNGAKDFVKKLLVKEPRARLTAAQALSHSWVKEGGE

SEQ ID NO: 1137 - protein, 453 aa, Arabidopsis thaliana
MLEVLQAIVLFILFWVWLSWMGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 1138 - protein, 595 aa, Arabidopsis thaliana
MVSDASKKKAAQKKAAAAAKRGGKAAAPSKSAATSSNGVDSLSSGVDALQISDRTCTGVLCSHPQSRDIRIESLSVTFHGYDLIVDSMLELNYGRRYGLLGLNGCGKSTLLTAIGRREIPIPDQMDIYHLSHEIEATDMSSLEAVVSCDEERLRLEKEVEILVQQDDGGGERLQSIYERLDAMDAETAEKRAAEILFGLGFDKEMQAKKTKDFSGGWRMRIALARALFIMPTILLLDEPTNHLDLEACVWLEESLKNFDRILVVVSHSQDFLNGVCTNIIHMQSKQLKYYTGNFDQYCQTRSELEENQMKQYRWEQEQISHMKEYIARFGHGSAKLARQAQSKEKTLAKMERGGLTEKVARDSVLVFRFADVGKLPPPVLQFVEVSFGYTPDYLIYKNIDFGVDLDSRVALVGPNGAGKSTLLKLMTGELHPTEGMVRRHNHLKIAQYHQHLAEKLDLELPALLYMMREFPGTEEEKMRAAIGRFGLTGKAQVMPMKNLSDGQRSRVIFAWLAYKQPNMLLLDEPTNHLDIETIDSLAEALNEWDGGLVLVSHDFRLINQVAHEIWVCEKQCITKWNGDIMDFKRHLKAKAGLED

SEQ ID NO: 1139 - protein, 296 aa, Arabidopsis thaliana
MLRSGLASLIVDVNLRRTLRPSPTFSFPAHLSRCIITSRYSSRTSLRFPIQISRHQHRLSYFSSSSSSEQSRPTSSSRNSFSGHGQLDSDDNSSPPPSQSSSKVLTLPTVLTLGRVAAVPLLVATFYVDSWWGTTATTSIFIAAAITDWLDGYLARKMRLGSAFGAFLDPVADKLMVAATLILLCTKPIQVAELGPLPWLLTVPSIAIIGREITMSAVREWAASQNGKLLEAVAVNNLGKWKTATQMTALTILLASRDSNVGWLVASGAGLLYVSAGLSVWSLAVYMRKIWKVLMK

SEQ ID NO: 1140 - protein, 393 aa, Saccharomyces cerevisiae
MGLILRWKEKKQLSSKQNAQKSRKPANTSFRQQRLKAWQPILSPQSVLPLLILMACVFAPIGIGLVVSTISVQRLVVNYTECDALAPSKHFETIPSEYVDYHFSKKVTVQPQWMVLTDPELGNQTCRIQFEVPNHIKKSTYVYYRLTNFNQNYREYVQSLDLDQLKGKALIGNDLDPNCDPLRTVENKTIFPCGLIANSMFNDTFGTTLTGVNDTADYLLTTKGIAWDTDSHRYGKTEYNASDIVPPPNWAKLFPNGYTDDNIPDLQNWEQFKIWMRTAALPNFYKLAMKNETNGLGKGIYIADIELNYPVRSFYGTKSFVLTTNSIIGAGNEALGIVYLIVAGIATLFAILFLIKVIFKPRPMHDHSYLNFENSDTPFDESSVVSIPLREIL

SEQ ID NO: 1141 - protein, 663 aa, Saccharomyces cerevisiae
MTLGNRRHGRNNEGSSNMNMNRNDLDDVSHYEMKEIQPKEKQIGSIEPENEVEYFEKTVEKTIENMEYEGEHHASYLRRFIDSFRRAEGSHANSPDSSNSNGTTPISTKDSSSQLDNELNRKSSYITVDGIKQSPQEQEQKQENLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIVGFFILAIIIDCGGAGTDGYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAAAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPIWIALYIFYKVWKKDWSLFIPADKVDLVSHRNIFDEELLKQEDEEYKERLRNGPYWKRVLDFWC

SEQ ID NO: 1142 - protein, 528 aa, Glycine max
MADSTPLLSQPNPSSSSSPDTQEAPPSNQHHPSLGSTVELCIGEFNWSQFLQSILVSLAWIFDAQQTFISVFTDALPEWHCTERGANACKTATTVCSLPKGSWAWDVPTQASIVSEWGLECANSAITGLPASMFFLGCLIGGFVLASLADSSLGRKNMLFFSCLVMAITSLLVTLSPNVWIYSALKFLCGFARATIGTSALVLASELVGKRWRGQISVIGFFCFTIGFLSLPAMAYINRSSSWRNLYLWTSISTMFYCILVKLFVTESPRWLLVRGKTEEAVETLKCITSITQSNLNLAINNMSHKEETWNVDIFSALKILLQKKWSSRRLSLIMAMGIGIGLVYYGMPLGLQNLSFNLYLSVTFNALSELPSALIVLFFVDKFNRRVALLLFTILSGVFSVMSIMEMKTSSWTNNIQIVFELVSFFSACSSFNVYLIYTTELFPTCVRNSALSMARLAVVLGGTFSPLLVSAARGNKFMCYGVFGLVIGFSGVFGIFLPETKGRALCDTMDEEENKEKNMTCDMFLA

SEQ ID NO: 1143 - protein, 478 aa, Glycine max
MESDLGKLFIGGISWDTDDERLKEYFGKYGEVIEAVIMRDRTTGRARGFGFVVFADPSAAERVIMDKHIIDGRTVEAKKAVPRDDQQTINRQSGSIHGSPSPGRTKKIFVGGLPSTITESDFKKYFDQFGTIADVVVMYDHNTQRPRGFGFITYDSEEAVDRVLYKTFHELNGKMVEVKRAVPKELSPGPTRSPLIGYNYGLNRTSGFLNSYAQGFNMNPIGGYGVRMDGRFSPLTSARSGFSPFGSSGYGMGVNLDLGLNPSYGGTSSYGGSLGYARMSPFNNGNSNRYTTPIGNSGGNGRSDSLMNSASRSVWGNGGQNNAANSPVSPGAYLGSGNGAFGVSIGNGGTNWGPSVPTQGGGAATGYSTWGNSYDGGDNNISLGGGGYGRNSSPSVPQSSTFTAPTGDYEGSYGNLYRNGSVYSDSTWRSAASEIDASGSFGYGGLGGIASDDPVKSSDGFIGNYNVISRQTNRGIAA

SEQ ID NO: 1144 - protein, 526 aa, Glycine max
MGQSPSTTAAPPPDLNRHQIPQIHPNTDSDFTDYTLRLSDDCLAAIFHFLSTADRKRCSLVCRRWLRVDGQRRHRLSLNAQPELLDFVPSLFNRFDSVTKLALRCDRKCASINDDALVLISLRCRNLTRLKLRGCRDITELGMAGVGENCKALKKLSCASCMFGAKGIAAVLDRCVTLEDLTLKRLRGVHHITDVEVGAAASLKSICLKELVNGQSFAPLVIDSKKLRTLKIIGCTGDWDETLVRVGCFNNGLVEVHLEKLQVTDVGLVAVSKCFGLDTLHVVKTAECSDVGLCAVADRCRLLRKVHIDGWRTNRIGDDGLHAIAKHCLNLQELVLIGVYPTFSSLAAIASNCRNLERLALCGIGTVGDAEIECIADKCVALRKLCIKGCPVSNAGIGALASGCPNLVKVKVKKCKRITGKGVEWVREQRVSLAFNYDDSEVEALDGSASDGIGGARDNTVEFLPTINQTTVAVAEADAEASSSNNNNRLTMLRSRFGFLAGRNLVPGAFRRWSNGDNVSSSSSFG

SEQ ID NO: 1145 - protein, 559 aa, Arabidopsis thaliana
MAASMQFYGVKTPELALNSKRIEFSSKGLNFSALVSSARVFSRNVDRSCKNIALRVTCEAGRVELLERKASETFKLNKTEKKLTCVMKFGGSSVASAERMIQVAKLILSFPDEKPVVVLSAMAKTTNKLLMAGEKAVCCGVTNVDTIEELSYIKELHIRTAHELGVETAVIAEHLEGLEQLLKGVAMMKELTLRSRDYLVSFGECMSTRLFAAYLNKIGHKARQYDAFEIGIITTDDFTNADILEATYPAVSKKLLGDWSKENALPVVTGFLGKGWRSCAVTTLGRGGSDLTATTIGKALGLREIQVWKDVDGVLTCDPNIYCGAQPVPHLTFDEAAELAYFGAQVLHPLSMRPAREGNIPVRVKNSYNPTAPGTVITRSRDMSKAVLTSIVLKRNVTMLDITSTRMLGQYGFLAKVFSTFEKLGISVDVVATSEVSISLTLDPSKFCSRELIQHELDQVVEELEKIAVVNLLRHRSIISLIGNVQRSSFILEKGFRVLRTNGINVQMISQGASKVNISLIVNDDEAEHCVKALHSAFFETDTCEAVSECPTGYIAASS

SEQ ID NO: 1146 - protein, 431 aa, Arabidopsis thaliana
MTLIASLSLPPPAIQRQSLSEFHNLPAKSQSFNCQFRSSSSPLSSLHSSSLSNFLDFRLRRRNSGLVPVVACSTTPFMGRVGLHWRDGNMSLLSFCGGTDVTEKADSSQFWSALLPFVVALTAVAALSYPPSFTWVSKDLYAPALGGIMLSIGIQLSVDDFALAFKRPVPLSVGFVAQYVLKPLLGVLVANAFGMPRTFYAGFILTCCVAGAQLSSYASSLSKADVAMSILLTSSTTIASVIFTPLLSGLLIGSVVPVDAVAMSKSILQVVLVPITLGLVLNTYAKPVVTLLQPVMPFVAMVCTSLCIGSPLSINRSQILSAEGLGLIVPIVTFHAVAFALGYWFSKIPGLRQEEEVSRTISLCTGMQSSTLAGLLASQFLGSSQAVPAACSVVVMAIMGLCLASFWGNGFRIRDVLSLSTPQSTGYTAES

SEQ ID NO: 1147 - protein, 605 aa, Arabidopsis thaliana
MYLLQVAYLIPLKADLKEDNSSPRITLSEGPNIIGRGNVSIVDKRLSRKHITIIVSTSGSASLSVDGTNPVVIRSSGDGERKKVKPSEEVSVCNDDLIELIPGHHFFKLVLLNGRAAKKARKAEDDVEAIRRFCPPNEKLPSTFRLLSVDALPDWANTSCVSINDVIEGDVVAAILSNYMVDIDWLMSACPKLANIPQVMVIHGEGDGRQEYIQRKKPANWILHKPRLPISFGTHHSKAIFLVYPRGVRVVVHTANLIHVDWNNKSQGLWMQDFPWKDDDKDPPKGCGFEGDLIDYLNVLKWPEFTANLPGRGNVKINAAFFKKFDYSDATVRLIASVPGYHTGFNLNKWGHMKLRTILQECIFDREFRRSPLIYQFSSLGSLDEKWLAEFGNSLSSGITEDKTPLGPGDSLIIWPTVEDVRCSLEGYAAGNAIPSPLKNVEKPFLKKYWARWKADHSARGRAMPHIKTFTRYNDQKIAWFLLTSSNLSKAAWGALQKNNSQLMIRSYELGVLFLPSPIKTQGCVFSCTESNPSVMKAKQETKDEVEKRSKLVTMTWQGDRDLPEIISLPVPYQLPPKPYSPEDVPWSWDRGYSKKDVYGQVWPR

SEQ ID NO: 1148 - protein, 308 aa, Arabidopsis thaliana
MEEGLKIQSLVIYPIKSCRGISVPQATVTHTGFQWDRYWLVVNYKGRAYTQRVEPTLALVESELPKEAFLEDWEPTNDSLLVIRAPGMSPLKIPLTRPSSVAEGVSMWEWSGSAFDEGEEAAKWFSDYLGKQSRLVRFNKDTETRPSPPEFAAGYSTTFMDMFPFLVASQGSLDHLNTLLPEPVPINRFRPNILVDNCDPFGEDLWDEIKINDLVFQGVRLCSRCKVPTVNQETGVMGKAEPTETLMKFRSDNVLMPDKKPRGKVFFGKEMVWNWNLTNTEGEGKKTIKVGDTISVIRKIPSRAEAAV

SEQ ID NO: 1149 - protein, 322 aa, Arabidopsis thaliana
MASRIAKDVTELIGNTPLVYLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 1150 - protein, 425 aa, Arabidopsis thaliana
MQTISPAFSCDLKSVIQPNLTAKKARYSHVNGKRVSVRCSYRSESFSFPNGVGSSRADWQSSCAILASKVVSAENSSSVAVVNGHSNGSVDLSLVPSKSQHNGKPGLIQPLTITDLSPAPSHGSTLRVAYQGVPGAYSEAAAGKAYPNSEAIPCDQFDVAFQAVELWIADRAVLPVENSLGGSIHRNYDLLLRHRLHIVGEVQIPVHHCLLALPGVRTDCITRVISHPQALAQTEGSLNKLTPKAAIEAFHDTAAAAEYIAANNLHDTAAVASARAAELYGLQILADGIQDDAGNVTRFLMLARDPIIPRTDRPFKTSIVFAAQEHKGTSVLFKVLSAFAFRNISLTKIESRPHQNCPVRVVGDENVGTSKHFEYTFYVDFEASMAEARAQNALAEVQEYTSFLRVLGSYPMDMTPWSTLPSEDV

SEQ ID NO: 1151 - protein, 465 aa, Arabidopsis thaliana
MISLSGLTSSVESDLDMQQAMLTNKDEKVLKALERTRQLDIPDEKTMPVLMKLLEEAGGNWSYIKLDNYTALVDAIYSVEDENKQSEGSSNGSSIQVVQKQPQLSNGDRKRKYKSRIADITKGSESVKIPLVDDVGSEAVPKFTYIPHNIVYQSAYLHVSLARISDEDCCANCKGNCLSADFPCTCARETSGEYAYTKEGLLKEKFLDTCLKMKKEPDSFPKVYCKDCPLERDHDKGTYGKCDGHLIRKFIKECWRKCGCDMQCGNRVVQRGIRCQLQVYFTQEGKGWGLRTLQDLPKGTFICEYIGEILTNTELYDRNVRSSSERHTYPVTLDADWGSEKDLKDEEALCLDATICGNVARFINHRCEDANMIDIPIEIETPDRHYYHIAFFTLRDVKAMDELTWDYMIDFNDKSHPVKAFRCCCGSESCRDRKIKGSQGKSIERRKIVSAKKQQGSKEVSKKRK

SEQ ID NO: 1152 - protein, 281 aa, Arabidopsis thaliana
MVLTHNVLAVTFGVLGNIISFIVFLAPVPTFVRICKKKSIEGFESLPYVSALFSAMLWIYYALQKDGAGFLLITINAVGCFIETIYIILFITYANKKARISTLKVLGLLNFLGFAAIILVCELLTKGSNREKVLGGICVGFSVCVFAAPLSIMRVVIRTKSVEFMPFSLSLFLTISAITWLFYGLAIKDFYVALPNILGAFLGAVQMILYVIFKYYKTPLVVDETEKPKTVSDHSINMVKLSSTPASGDLTVQPQTNPDVSHPIKTHGGDLEDQMDKKMPN

SEQ ID NO: 1153 - protein, 410 aa, Arabidopsis thaliana
MGERFFRNEMPEFVPEDLSGEEETVTECKDSLTKLLSLPYKSFSEKLHRYALSIKDKVVWETWERSGKRVRDYNLYTGVLGTAYLLFKSYQVTRNEDDLKLCLENVEACDVASRDSERVTFICGYAGVCALGAVAAKCLGDDQLYDRYLARFRGIRLPSDLPYELLYGRAGYLWACLFLNKHIGQESISSERMRSVVEEIFRAGRQLGNKGTCPLMYEWHGKRYWGAAHGLAGIMNVLMHTELEPDEIKDVKGTLSYMIQNRFPSGNYLSSEGSKSDRLVHWCHGAPGVALTLVKAAQVYNTKEFVEAAMEAGEVVWSRGLLKRVGICHGISGNTYVFLSLYRLTRNPKYLYRAKAFASFLLDKSEKLISEGQMHGGDRPFSLFEGIGGMAYMLLDMNDPTQALFPGYEL

SEQ ID NO: 1154 - protein, 335 aa, Arabidopsis thaliana
MSGTELDEPGKLKRAVIDASAGGVAGAISRMVTSPLDVIKIRFQVQLEPTATWALKDSQLKPKYNGLFRTTKDIFREEGLSGFWRGNVPALLMVVPYTSIQFAVLHKVKSFAAGSSKAENHAQLSPYLSYISGALAGCAATVGSYPFDLLRTVLASQGEPKVYPNMRSAFLSIVQTRGIKGLYAGLSPTLIEIIPYAGLQFGTYDTFKRWSMVYNKRYRSSSSSSTNPSDSLSSFQLFLCGLASGTVSKLVCHPLDVVKKRFQVEGLQRHPKYGARVELNAYKNMFDGLGQILRSEGWHGLYKGIVPSTIKAAPAGAVTFVAYELASDWFEANLT

SEQ ID NO: 1155 - protein, 379 aa, Arabidopsis thaliana
MDGSKHPSVFQKLHGQSYLINRLSPSVQARGYCVSGAYVNGGLQSLLQPTSHGVGSSLIPHGSFPVLAHAPSEKTGTGFLIDFLMGGVSAAVSKTAAAPIERVKLLIQNQDEMIKAGRLSEPYKGISDCFARTVKDEGMLALWRGNTANVIRYFPTQALNFAFKDYFKRLFNFKKEKDGYWKWFAGNLASGGAAGASSLLFVYSLDYARTRLANDAKAAKKGGQRQFNGMVDVYKKTIASDGIVGLYRGFNISCVGIVVYRGLYFGLYDSLKPVVLVDGLQDSFLASFLLGWGITIGAGLASYPIDTVRRRMMMTSGEAVKYKSSLQAFSQIVKNEGAKSLFKGAGANILRAVAGAGVLAGYDKLQLIVLGKKYGSGGG

SEQ ID NO: 1156 - protein, 448 aa, Arabidopsis thaliana
MGSCLSSSGGGGSRRSLHGSPHVPGPGRRKRPPKRRPGSCSSSFDNTEEPLLHRIPGRMFLNGSTDTVSLFSQQGKKGPNQDAMIVWENFGSMEDTVFCGVFDGHGPYGHIVAKRVRDLLPLKLGSHLESYVSPEEVLKEISLNTDDRKISEDLVHISANGESRVYNKDYVKDQDMIQMLIGSIVKAYRFMDKELKMQVDVDCFCSGTTAVTMVKQGQHLVIGNIGDSRAVLGVRNKDNKLVPFQLTEDLKPDVPAEAERIKRCRGRIFALRDEPGVARLWLPNHNSPGLAMARAFGDFCLKDFGLISVPDVSYRRLTEKDEFVVLATDGIWDALTNEEVVKIVAKAPTRSSAGRALVEAAVRNWRWKFPTSKVDDCAVVCLFLDSEPNRLSTASFSKEKHINNGVTEPEPDTASSSTPDSGTGSPELNGVNRIDTLVNLPVYVPTKE

SEQ ID NO: 1157 - protein, 481 aa, Arabidopsis thaliana
MKNLKMVFFKILFISLMAGLAMKGSKINVEDLQKFSLHHTQNNLQTISLLLFLVVFVWILYMLTRPKPVYLVDFSCYLPPSHLKVSIQTLMGHARRAREAGMCWKNKESDHLVDFQEKILERSGLGQETYIPEGLQCFPLQQGMGASRKETEEVIFGALDNLFRNTGVKPDDIGILVVNSSTFNPTPSLASMIVNKYKLRDNIKSLNLGGMGCSAGVIAVDVAKGLLQVHRNTYAIVVSTENITQNLYLGKNKSMLVTNCLFRVGGAAVLLSNRSRDRNRAKYELVHTVRIHTGSDDRSFECATQEEDEDGIIGVTLTKNLPMVAARTLKINIATLGPLVLPLKEKLAFFITFVKKKYFKPELRNYTPDFKLAFEHFCIHAGGRALIDELEKNLKLSPLHVEASRMTLHRFGNTSSSSIWYELAYTEAKGRMKEGDRIWQIALGSGFKCNSSVWVALRDVKPSANSPWEDCMDRYPVEIDI

SEQ ID NO: 1158 - protein, 1006 aa, Arabidopsis thaliana
MGEQQISVTVPRDRTDEQAILALKKGAQLLKCRRRGNPKFCPFKLSMDEKYLIWYSGEEERQLRLSSVITIVRGQITPNFQKQAQSDRKEQSFSLIYANGEHTLDLICKDKAQADSWFKGLRAVITKHHNIRNSVNHRSSRGAQSCINSPAGFMRRKQNLGLLEETPDVTQIRSLCGSPSTLLEERCLSNGLSCSSDSFAESDALGPVSSYYETDYDFRNSDCDRSTGSELCRFSSQRFAASPPLSIITQPVTRSNVLKDIMIWGAITGLIDGSKNQNDALSPKLLESATMFDVQSISLGAKHAALVTRQGEVFCWGNGNSGKLGLKVNIDIDHPKRVESLEDVAVRSVACSDHQTCAVTESGELYLWGIDGGTIEQSGSQFLTRKISDVLGGSLTVLSVACGAWHTAIVTSSGQLFTYGSGTFGVLGHGSLESVTKPKEVESLRRMKVISVSCGPWHTAAIVETANDRKFYNAKSCGKLFTWGDGDKGRLGHADSKRKLVPTCVTELIDHDFIKVSCGWTLTVALSISGTVYTMGSSIHGQLGCPRAKDKSVNVVLGNLTRQFVKDIASGSHHVAVLTSFGNVYTWGKGMNGQLGLGDVRDRNSPVLVEPLGDRLVESIACGLNLTAAICLHKEISLNDQTACSSCKSAFGFTRRKHNCYNCGLLFCNACSSKKAVNASLAPNKSKLSRVCDSCFDHLWSITEFSRNVKMDNHTPRMQMVTRRVSEDLTEKQSENEMQNLPQANRSSDGQPRWGQVSGPSLFRFDKISTSSSLNLSVSARRTSSTKISTSSESNKILTEEIERLKAVIKNLQRQCELGNEKMEECQQELDKTWEVAKEEAEKSKAAKEIIKALASKLQANKEKPSNPLKTGIACNPSQVSPIFDDSMSIPYLTPITTARSQHETKQHVEKCVTKSSNRDSNIKLLVDASPAITRTGYLQNETQDSSAEQVEQYEPGVYITFTALPCGQKTLKRVRFSRKRFSEKEAQRWWEEKQVLVYNKYDAEI

SEQ ID NO: 1159 - protein, 157 aa, Saccharomyces cerevisiae
MNGGGKNVLNKNSVGSVSEVGPDSTQEETPRDVRLLHLLLASQSIHQYEDQVPLQLMDFAHRYTQGVLKDALVYNDYAGSGNSAGSGLGVEDIRLAIAARTQYQFKPTAPKELMLQLAAERNKKALPQVMGTWGVRLPPEKYCLTAKEWDLEDPKSM

SEQ ID NO: 1160 - protein, 827 aa, Saccharomyces cerevisiae
MHSNVFVGVKPGFNHKQHSKKSRFLENVSSHSPELPSNYDYVLLPITTPRYKEIVGQVFKDFQRQSIQNWKPLQIPEPQLQDICIPPFNVKKLDNDDTPSYIGLLSSWLELESRDPNVRDLGLKVLLNECKYARFVGINKLILAPPRDLSNLQLYGQMIYRLLQNRIVFAAPALTISISLPLYEDSDPLATWELWNTVRKQCEYHPSLTISLALPRTRTPSYVLNRWLAEPVSCLLVSSSIFASNQYDYPVLHKFNQNLILKFQKVNGDSQILGNELCVILHGMEKYANNVKGGESAYLEYINYLLKKGDKVLNSNSNHQFLLQEDSRIMPPLKPHSDNLLNSTYLTFEKDLVKYDLYESAILEALQDLAPRASAKRPLVILVAGAGRGPLVDRTFKIISMLFMDSKVSIIAIEKNPQAYLYLQKRNFDCWDNRVKLIKEDMTKWQINEPSEKRIQIDLCISELLGSFGCNELSPECLWSIEKYHSHNDTIFIPRSYSSYIAPISSPLFYQKLSQTNRSLEAPWIVHRVPYCILSSRVNEVWRFEHPMAQKDTVQDEDDFTVEFSQSSLNEFKIKHRGEIHGFIGFFSANLYNNIFLSTLPNDSTVRLKFSEETLMNTRREENLIKKCDHTPNMTSWSPIIFPLKQPISFIDDSELSVLMSRIHSDTEQKVWYEWSLESFIYLMLSNYTSAVTAASMTIPRSIVTDDTKTLAHNRHYSATTNQKLDNQIDLDQDIENEEEQGFLSNLETGWQSVQDIHGLSETAKPDHLDSINKPMFDLKSTKALEPSNELPRHEDLEEDVPEVHVRVKTSVSTLHNVCGRAFSLPL

SEQ ID NO: 1161 - protein, 298 aa, Saccharomyces cerevisiae
MSGELANYKRLEKVGEGTYGVVYKALDLRPGQGQRVVALKKIRLESEDEGVPSTAIREISLLKELKDDNIVRLYDIVHSDAHKLYLVFEFLDLDLKRYMEGIPKDQPLGADIVKKFMMQLCKGIAYCHSHRILHRDLKPQNLLINKDGNLKLGDFGLARAFGVPLRAYTHEIVTLWYRAPEVLLGGKQYSTGVDTWSIGCIFAEMCNRKPIFSGDSEIDQIFKIFRVLGTPNEAIWPDIVYLPDFKPSFPQWRRKDLSQVVPSLDPRGIDLLDKLLAYDPINRISARRAAIHPYFQES

SEQ ID NO: 1162 - protein, 712 aa, Saccharomyces cerevisiae
MLNSALLWKVWLRIDNSTDEVNQPIAVQFDEIDTVDDLKSRFFQKLSSTRWREINDNASIAIGLYAPKFDNQADNTSSNNTNDNSCRSKSNGAGSGANLSVNSNTKSSVSPTAGSFGLSKDLAKDRNVLQHPKPTQKRGALYDAFAAVPTVAATTNVDFPPNEAPMLSPQRPYSTSPKQFPATTKSPLLRFASVSPYPKFHSDNQIMASAGLTYVSPHNKNKYTRPLIRKGLNFTTESVNDCTYKIIFEPDELAINIYKELFGTMGSQPASQPLLIFSNVNLRQDVPPLDILNVVDYVPTNEEISQQKTQPTDHGAVGVFHLDDHISPGEQGLKQTIGDKADLKGKDGNSSPQEFKLITDEEQLRRASQELKDEEKDAESPWQAILLLPKGYKGGVDFRNKPVAHTDSSFNNEDTITHSELEVNTGSPSQESGSLNEAGIGITQPMSEVQRRKEDVTPASPILTSSQTPHYSNSLYNAPFAVSSPPDPLPNLFTTTSEKVFPKINVLIVEDNVINQAILGSFLRKHKISYKLAKNGQEAVNIWKEGGLHLIFMDLQLPVLSGIEAAKQIRDFEKQNGIGIQKSLNNSHSNLEKGTSKRFSQAPVIIVALTASNSQMDKRKALLSGCNDYLTKPVNLHWLSKKITEWGCMQALIDFDSWKQGESRMTDSVLVKSPQKPIAPSNPHSFKQATSMTPTHSPVRKNSNLSPTQIEL

SEQ ID NO: 1163 - protein, 197 aa, Saccharomyces cerevisiae
MKYIPPLNFSPVVSTDVSLYRSGYPMPLNYSFIKHQLHLKTIIYIGDKDRPLEEYQSFLESEKIKYYHIFMDSSRDEGIQERMNQVLHLVLDVRNYPILVHSNKGKHRVGVVVGIIRKLLQGWSTAGIYQEYGLFSGGMKDGVDLEFITMFETNLKIPRNVIPGFAKHCLYLNELEAAEGSDDESGSESILTAKQPI

SEQ ID NO: 1164 - protein, 240 aa, Saccharomyces cerevisiae
MADEERLKEFKEANKIVFDPNTRQVWENQNRDGTKPATTFQSEEDIKRAAPESEKDTSATSGIVPTLQNIVATVTLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 1165 - protein, 322 aa, Saccharomyces cerevisiae
MKPTQDSQEKVSIEQQLAVESIRKFLNSKTSYDVLPVSYRLIVLDTSLLVKKSLNVLLQNSIVSAPLWDSKTSRFAGLLTTTDFINVIQYYFSNPDKFELVDKLQLDGLKDIERALGVDQLDTASIHPSRPLFEACLKMLESRSGRIPLIDQDEETHREIVVSVLTQYRILKFVALNCRETHFLKIPIGDLNIITQDNMKSCQMTTPVIDVIQMLTQGRVSSVPIIDENGYLINVYEAYDVLGLIKGGIYNDLSLSVGEALMRRSDDFEGVYTCTKNDKLSTIMDNIRKARVHRFFVVDDVGRLVGVLTLSDILKYILLGSN

SEQ ID NO: 1166 - protein, 592 aa, Arabidopsis thaliana
MNSVQLPTAQSSLRSHIHRPSKPVVGFTHFSSRSRIAVAVLSRDETSMTPPPPKLPLPRLKVSPNSLQYPAGYLGAVPERTNEAENGSIAEAMEYLTNILSTKVYDIAIESPLQLAKKLSKRLGVRMYLKREDLQPVFSFKLRGAYNMMVKLPADQLAKGVICSSAGNHAQGVALSASKLGCTAVIVMPVTTPEIKWQAVENLGATVVLFGDSYDQAQAHAKIRAEEEGLTFIPPFDHPDVIAGQGTVGMEITRQAKGPLHAIFVPVGGGGLIAGIAAYVKRVSPEVKIIGVEPADANAMALSLHHGERVILDQVGGFADGVAVKEVGEETFRISRNLMDGVVLVTRDAICASIKDMFEEKRNILEPAGALALAGAEAYCKYYGLKDVNVVAITSGANMNFDKLRIVTELANVGRQQEAVLATLMPEKPGSFKQFCELVGPMNISEFKYRCSSEKEAVVLYSVGVHTAGELKALQKRMESSQLKTVNLTTSDLVKDHLRYLMGGRSTVGDEVLCRFTFPERPGALMNFLDSFSPRWNITLFHYRGQGETGANVLVGIQVPEQEMEEFKNRAKALGYDYFLVSDDDYFKLLMH

SEQ ID NO: 1167 - protein, 471 aa, Saccharomyces cerevisiae
MSRSLLVENSRTINSNEEKGVNESQYILQKRNVPRTILGNVTNNANILQEISMNRKIGMKNFSKLNNFFPLKDEVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLAINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 1168 - protein, 316 aa, Saccharomyces cerevisiae
MAFLNIFKQKRGDEASQLSAKGREEISQSIKICKSDDAANEHSCSGDCKTEIEEGEQAFAKLKIEHETPLLNSSKTPKIHFVVPTSQIDWQHDACLEDPKSVQYKISQWCDKNSAKFSNVGTGKTLNCAVSSLPKDIMDIDVMRGTKNNVLILPYFIWLNDLRSDDVEATLDGLVPDLLDENISREKLLETRPNVAVARERAFVFICSHTTRDKRCGITAPYLKKVFDSKLQEHGLYRDNSDYRAEGVKIAFVNHVGGHKFAANVQIYLRNPNTLIWLGRVTPTIVPSIVEHLIVPEEPTLPFPEKVRCIKKYQSW

SEQ ID NO: 1169 - protein, 311 aa, Saccharomyces cerevisiae
MLRITVKTLQQRASFHHSFKHISVPDLHTRAQNDQTNCYCQEINARLPSKTDPLDPHIKLPHRTPNYNKHVLLLSPGDRFAQPWKVAWNHNLDTNTNRPYNAISKLRSHLGGSPGILINAVHLQNEFIPRPKQHDEWLYFFVIPDMKLYVIKETDIEEFASFLDEGAIQAPKLSFQDYLSGKAKASQQVHEVHHRKLTRFQGETFLRDWNLVCGHYKRDAKCGEMGPDIIAAFQDEKLFPENNLALISHIGGHIFAGNVIFYKLFGREKMQNKLDSLWFGKVYPHNLKLLCENLENGKIIDEMYRGGISMN

SEQ ID NO: 1170 - protein, 240 aa, Arabidopsis thaliana
MSLVSGARDMGFDDNNNNKNNKDGDDENSSSRTRADDDALSRQMSESSLCATEEEEDDDSKLQLGPQYTIKEHLEKDKDDESLRKWKEQLLGSVDVTNIGETLDPEVRIDSLAIISPGRPDIVLLVPENGNPKGMWFTLKEGSKYNLKFTFHVNNNIVSGLRYTNTVWKTGVKVDRAKEMLGTFSPQLEPYNHVMPEETTPSGMFARGSYSARTKFLDDDNKCYLEINYSFDIRKEWPAL

SEQ ID NO: 1171 - protein, 894 aa, Arabidopsis thaliana
MAFSSCFLLVLLQIFSALLLCLAQDQSGFISLDCGSPRETSFREKTTNITYISDANFINTGVGGSIKQGYRTQFQQQTWNLRSFPQGIRNCYTLNLTIGDEYLIRANFLHGGYDDKPSTQFELYLGPNLWSTVTTTNETEASIFEMIHILTTDRLQICLVKTGNATPFISALELRKLMNTTYLTRQGSLQTFIRADVGATVNQGYRYGIDVFDRVWTPYNFGNWSQISTNQSVNINNDYQPPEIAMVTASVPTDPDAAMNISLVGVERTVQFYVFMHFAEIQELKSNDTREFNIMYNNKHIYGPFRPLNFTTSSVFTPTEVVADANGQYIFSLQRTGNSTLPPLLNAMEIYSVNLLPQQETDRKEVDAMMNIKSAYGVNKIDWEGDPCVPLDYKWSGVNCTYVDNETPKIISLDLSTSGLTGEILEFISDLTSLEVLDLSNNSLTGSVPEFLANMETLKLINLSGNELNGSIPATLLDKERRGSITLSIEGNTGLCSSTSCATTKKKKKNTVIAPVAASLVSVFLIGAGIVTFLILKRKKRTKLGLNPNSGTGTTPLHSRSHHGFEPPVIAKNRKLTYIDVVKITNNFERVLGRGGFGVVYYGVLNNEPVAVKMLTESTALGYKQFKAEVELLLRVHHKDLTCLVGYCEEGDKMSLIYEFMANGDLKEHLSGKRGPSILTWEGRLRIAAESAQGLEYLHNGCKPQIVHRDIKTTNILLNEKFQAKLADFGLSRSFPLGTETHVSTIVAGTPGYLDPEYYRTNWLTEKSDVFSFGVVLLELVTNQPVIDMKREKSHIAEWVGLMLSRGDINSIVDPKLQGDFDPNTIWKVVETAMTCLNPSSSRRPTMTQVVMDLKECLNMEMARNMGSRMTDSTNDSSIELSMNFTTELNPGAR

SEQ ID NO: 1172 - protein, 720 aa, Arabidopsis thaliana
MGVDVKRFLVVMLLLRICEYAAASTFPLALRNCSDHCGNVSVPYPFGIGKGCYKNKWFEIVCKSSSDQQPILLLPRIRRAVTSFNLGDPFSISVYNKFYIQSPLKHSGCPNRDGYSSSSLNLKGSPFFISENNKFTAVGCNNKAFMNVTGLQIVGCETTCGNEIRSYKGANTSCVGYKCCQMTIPPLLQLQVFDATVEKLEPNKQGCQVAFLTQFTLSGSLFTPPELMEYSEYTTIELEWRLDLSYMTSKRVLCKGNTFFEDSYQCSCHNGYEGNPYIPGGCQDIDECRDPHLNKCGKRKCVNVLGSYRCEKTWPAILSGTLSSGLLLLIFGMWLLCKANRKRKVAKQKRKFFQRNGGLLLQQQTSFLHGSVNRTKVFSSNDLENATDRFNASRILGQGGQGTVYKGMLEDGMIVAVKKSKALKEENLEEFINEIILLSQINHRNVVKILGCCLETEVPILVYEFIPNRNLFDHLHNPSEDFPMSWEVRLCIACEVADALSYLHSAVSIPIYHRDVKSTNILLDEKHRAKVSDFGISRSVAIDDTHLTTIVQGTIGYVDPEYLQSNHFTGKSDVYSFGVLLIELLTGEKPVSLLRRQEVRMLGAYFLEAMRNDRLHEILDARIKEECDREEVLAVAKLARRCLSLNSEHRPTMRDVFIELDRMQSKRKGTQSQAQNGEEHAHIQIAMPESMSLSYSSPNIVVENSSFSLDTKPLMPHKTQ

SEQ ID NO: 1173 - protein, 505 aa, Agrobacterium tumefaciens str. C58
MDEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 1174 - protein, 490 aa, Bacillus halodurans
MERDHYRMVINGERVDSDETFETFNPAKGEILATVAKASREHAEKAVQAARHAFDHGKWRKYPVGKRARVLNQIAAIMRERFQELVEIEVLNSGKAISAAQAQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYMEDKSILSYYGPKPINPFGV

SEQ ID NO: 1175 - protein, 498 aa, Bacillus halodurans
MKKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 1176 - protein, 476 aa, Arabidopsis thaliana
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQGEIHHVVNPDPYRGVFGSDGSLYAKDVHDHIEYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDADFLVDALDYSISRL

SEQ ID NO: 1177 - protein, 485 aa, Bacillus halodurans
MEAIYTRQFLAGEWIEGASTQTITNYNPYTGEKIHEIKGASLDDLDQAYRAAKNAQKEWEQTLPAQKQEVLEKAAALLAERKDEVIERLVNEAGSSIIKASIEWGATLQTIKVAATFPLRMEGKILPSNIPGKENRIYRSAKGVIGVISPFNFPLVLAMRSVAPALATGNAVVLKCSSDAPITSGLLIAELFEEAGLPKGVLNVVVGKAAEIGDAFVTHPIPKLISFTGSTEVGRHIAQLAARELKETALELGGNNVMIVLDDADIEKAAEKAAVGKFLHQGQICMALNRIIVDASIYDSFVEVFKEKVSQLQTGNPAEPATLIGPLINYKQIGRIQQLVKESVAQGAVKVLEGHVQGNLMSPTILSEVTNDMPVAKEEIFGPIAPIIKAKDEAEAIAIANDSPYGLSGSIFTGSLHRGVQVAKQIDTGMIHVNDQPVNEEAHISFGGEKDSGIGRFGGEWVLDKFTTVKWISIQEKERVYPFWG

SEQ ID NO: 1178 - protein, 436 aa, Bacillus subtilis subsp. subtilis str. 168
MGQTTASITTAQWQQKRDQFVSKGVSNGNRSLAVKGEGAELYDLDGRRFIDFAGAIGTLNVGHSHPKVVEAVKRQAEELIHPGFNVMMYPTYIELAEKLCGIAPGSHEKKAIFLNSGAEAVENAVKIARKYTKRQGVVSFTRGFHGRTNMTMSMTSKVKPYKFGFGPFAPEVYQAPFPYYYQKPAGMSDESYDDMVIQAFNDFFIASVAPETVACVVMEPVQGEGGFIIPSKRFVQHVASFCKEHGIVFVADEIQTGFARTGTYFAIEHFDVVPDLITVSKSLAAGLPLSGVIGRAEMLDAAAPGELGGTYAGSPLGCAAALAVLDIIEEEGLNERSEEIGKIIEDKAYEWKQEFPFIGDIRRLGAMAAIEIVKDPDTREPDKTKAAAIAAYANQNGLLLLTAGINGNIIRFLTPLVISDSLLNEGLSILEAGLRA

SEQ ID NO: 1179 - protein, 398 aa, Bacillus subtilis subsp. subtilis str. 168
MEFEQSHVLKELPKQFFASLVQKVNRKLAEGHDVINLGQGNPDQPTPEHIVEEMKRAVADPENHKYSSFRGSYRLKSAAAAFYKREYGIDLDPETEVAVLFGGKAGLVELPQCLLNPGDTILVPDPGYPDYWSGVTLAKAKMEMMPLVKDRAFLPDYSSITAEIREQAKLMYLNYPNNPTGAVATSEFFEDTVRFAAENGICVVHDFAYGAVGFDGCKPLSFLQTEGAKDIGIEIYTLSKTYNMAGWRVGFAVGNASVIEAINLYQDHMFVSLFRATQEAAAEALLADQTCVAEQNARYESRRNAWITACREIGWDVTAPAGSFFAWLPVPEGYTSEQFSDLLLEKANVAVAAGNGFGEYGEGYVRVGLLTSEERLKEAAYRIGKLNLFTQKSIDKTL

SEQ ID NO: 1180 - protein, 485 aa, Bacillus subtilis subsp. subtilis str. 168
MGFETLNKSFINGKWTGGESGRTEDILNPYDQSVITTASLATGKQLEDAFDIAQKAQKEWAKSTTEDRKAVLQKARGYLHENRDDIIMMIARETGGTIIKSTIELEQTIAILDEAMTYTGELGGVKEVPSDIEGKTNKIYRLPLGVISSISPFNFPMNLSMRSIAPAIALGNSVVHKPDIQTAISGGTIIAKAFEHAGLPAGVLNVMLTDVKEIGDGMLTNPIPRLISFTGSTAVGRHIGEIAGRAFKRMALELGGNNPFAVLSDADVDRAVDAAIFGKFIHQGQICMIINRIIVHQDVYDEFVEKFTARVKQLPYGDQTDPKTVVGPLINERQIEKALEIIEQAKTDGIELAVEGKRVGNVLTPYVFVGADNNSKIAQTELFAPIATIIKAGSDQEAIDMANDTEYGLSSAVFTSDLEKGEKFALQIDSGMTHVNDQSVNDSPNIAFGGNKASGVGRFGNPWVVEEFTVTKWISIQKQYRKYPF

SEQ ID NO: 1181 - protein, 332 aa, Cupriavidus metallidurans
MAIKIGINGFGRIGRMVFRAAAANFKDIEVVAINDLLEPDYLAYMLKYDSVHGRFDGEVSVEGNTLVVNGKKIRLTAVKDPSELKWGEVGADVVIESTGIFLTKEGAQKHIDAGAKKVIMSAPSKDDTPMFVFGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELENPAKYEEICAEMKAQSQGALKGVLGYTEDKVVATDFRGDARTSIFDAEAGIALDGTFIKVVSWYDNEWGYSNKCLEMARVVAK

SEQ ID NO: 1182 - protein, 311 aa, Rhodopseudomonas palustris
MGNQLLDRVVAEIADEMAQRADRGEVASYIPELARVDPKAFGLAVIGADGHIAAAGDADVPFSIQSISKVFTLTLALGKAGDRLWRRVGREPSGSAFNSIVQLEHERGIPRNPFINAGAIAVTDLILSGHQPREALGEILRFMQFLAGDSSIAIDEAVAKSEQRTGFRNAALANYMKSFGVLDNPVEYTLGVYFHHCAIAMSCRQLAMAGRFLAHNGQNPSTGLNVVSSERARRINALMLTCGHYDGSGEFAYRVGLPGKSGVGGGILAVAPGRASIAVWAPGLDAAGNSHLGRVALEGLTKRMGWSIFGV

SEQ ID NO: 1183 - protein, 211 aa, Sinorhizobium meliloti
MSGTLVLVRHGQSDWNLKNLFTGWRDPDLTELGIEEAKAGGKALADYGIKFDIAFTSVLIRAQRTCQLVLDAVGQSSLETIRDQALNERDYGDLSGLNKDDARAKWGEEQVHIWRRSYDVPPPGGESLRDTGARVWPYYLTDILPRVLSGEKVLVAAHGNSLRSLVMVLDKLTKEQILKLNLATGVPMVYKLNADSTVASKEVLGDMSGAH

SEQ ID NO: 1184 - protein, 390 aa, Sinorhizobium meliloti
MRTSHLAQMSKRSAVEPFHAMDVLAEATRRRDSGHPVISMAVGQPAHPAPKAALDAARRALDHGRLGYTDALGTHSLKRAIAAHYHSRHGITLDPQRIAVTTGSSAGFNLAFLALFDPGDRVAIARPGYPAYRNIMAALGLEVVEIEANAEAGFTLTPDSLEGAAARAGKPLKGVLLASPANPTGTVTGKAQLKALADYCRDHSIAFISDEIYHGLTFAGEETTALEVADDAVVINSFSKYYCMTGWRIGWMVLPEARVRAFERIAQSLYISPPELSQIAAEAALGAHEELDGYKRAYAANRALLLERLPQIGFSIASPMDGAFYAYADVSRFTNDSMAFARRMLAEIDVAATPGFDFDPLEGHRTMRFSYAGAATEMEEAMNRIARWLA

SEQ ID NO: 1185 - protein, 256 aa, Sinorhizobium meliloti
MAPDIRPLVAGNWKMNGTRASLDQIKAMAEGVKGDLSARVDALICPPATLLYVATALCDDSPLMIGAQDCHQKQSGAHTGEVSAEMVADCFGTHVIVGHSERRTDHGEGDALVRAKTEAAHGADLVAIVCVGETEEERKAGRTLDILKRQLSESLPDQATAENTVIAYEPVWAIGTGLTPTVSDVEEAHAFMRRELVSRFGAEGGKMRILYGGSVKPSNAKELMGVANVDGALIGGASLKADDFLAIYRAYEELTA

SEQ ID NO: 1186 - protein, 442 aa, Sinorhizobium meliloti
MANRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGMNHVLYTNSGSESVDTALKVALAYHRAKGNGSRFRLIGRERGYHGVNFGGISVGGIVANRKMFGTLLTGVDHLPHTHLPAKNAFSRGEPEHGADLAAELERIVTLHDASTVAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYREEGLLTRAAELAPYWEEALHSLKDCPHVIDIRNIGLIGAVELEPIAGEPTKRAFSAFLKAYEKGLLIRTTGDIIALSPPLIIEKRQIDELFDKLRDVLKNNI

SEQ ID NO: 1187 - protein, 480 aa, Xenorhabdus nematophila
MARRLRRTKIVTTLGPATDRDNNLEKVINAGANVVRLNFSHGTAEDHILRANKVREIAARLGCHVAILGDLQGPKIRISTFKEGKIFLNIGDKFLLDANLGKGEGDKEKVGIDYKGLPSDVTTGNILLLDDGRVQLKVLDVQGMKVFTEVTVGGPLSNNKGINKQGGGLSAEALTEKDKEDIITAAKIGVDYLAVSFPRSGEDLNYARRLARDAGCETQIVAKVERAEAVSSDEIIDEIILASDVVMVARGDLGVEIGDPELVGVQKKLIRRARQLNRVVITATQMMESMITNPMPTRAEVMDVANAVLDGTDAVMLSAETAAGQYPAETVAAMAQVCLGAEKMPGINASKHRMDITFDSIEEAISMSAMYAANHLKGVKAIIAMTESGRTARMMSRISSGLPIFSMSRHESTLNRTALYRGVTPVYCSSHIDGIAAASEAVSRLRDRGYLASGDLVLVTQGDQMGTIGSTNTCRVLEVE

SEQ ID NO: 1188 - protein, 339 aa, Xenorhabdus nematophila
MAIRIAINGFGRIGRSILRALYESGRQAEISVIAINELADAEGIAHLLKYDSSHGRFAWDVRLNNSLLQVGDDSIRLFHQPDISALPWKELDIDIVLDCTGKYGERADGEAHIASGAKKVLFSHPGGNDLDATVVYGVNHHELVAEDCIVSNASCTTNCIIPIIKLLDDAFNIESGTVTTIHASMNDQPVIDAYHSDLRRTRAASQSIIPVDTKLSAGITRIFPKFSDRFEAISVRVPTINVTAIDLSVTVSAAVDVRDVNQLLQESAVSSFRGIVDYTDLPLVSTDFNHDPHSAIVDGTQTRVSGNHLIKTLVWCDNEWGFANRMLDTTLVMAATGFK

SEQ ID NO: 1189 - protein, 149 aa, Bacillus subtilis subsp. subtilis str. 168
MMEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 1190 - protein, 176 aa, Xenorhabdus nematophila
MSLNNVPAGKELPEDIYVIIEIPANADPIKYEVDKDSGALFVDRFMSTAMFYPCNYGYINNTLSLDGDPVDVLVPTPYPLQPGSVIRCRPVGMLKMTDESGEDAKLIAVPHTKLSKEYDHIKDVNDLPELLRSQITHFFEHYKDLEKGKWVKVDGWENVEAAKAEILTSFERAAKK

SEQ ID NO: 1191 - protein, 491 aa, Saccharomyces cerevisiae
MSNPIENTENSQNTSSSRFLRNVQRLALNNVTNTTFQKSNANNPALTNFKSTLNSVKKEGSRIPQFTRESVSRSTAAQEEKRTLKENGIQLPKNNLLDDKENQDPSSQQFGALTSIKEGRAELPANISLQESSSAKEIIQHDPLKGVGSSTEVVHNSVENEKLHPARSQLQVRNTESETDSGKKRPISTIVEQELPKKFKVCDENGKEEYEWEDLDAEDVNDPFMVSEYVNDIFEYLHQLEVITLPKKEDLYQHRNIHQNRDILVNWLVKIHNKFGLLPETLYLAINIMDRFLGKELVQLDKLQLVGTSCLFIASKYEEVYSPSIKHFASETDGACTEDEIKEGEKFILKTLKFNLNYPNPMNFLRRISKADDYDIQSRTLAKFLLEISLVDFRFIGILPSLCAAAAMFMSRKMLGKGKWDGNLIHYSGGYTKEELAPVCHMIMDYLVSPIVHDEFHRKYQSRRFMKASIISVQWALKVRKNGYDIMTLHE

SEQ ID NO: 1192 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELGSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 1193 - protein, 391 aa, Saccharomyces cerevisiae
MVSLFKRGKAPPLTKEGPTSKKPPNTAFRQQRLKAWQPILSPQSVLPLLIFVACIFTPIGIGLIVSATKVQDLTIDYSHCDTKASTTAFEDIPKKYIKYHFKSKVENKPQWRLTENENGEQSCELQFEIPNDIKKSIFIYYKITNFYQNHRRYVQSFDTKQILGEPIKKDDLDTSCSPIRSREDKIIYPCGLIANSMFNDTFSQVLSGIDDTEDYNLTNKHISWSIDRHRFKTTKYNASDIVPPPNWMKKYPDGYTDENLPDIHTWEEFQVWMRTAAFPKFYKLTLKNESASLPKGKYQMNIELNYPISLFGGTKSFVLTTNGAIGGRNMSLGVLYLIVAGLCALFGIIFLVKLIFQPRAMGDHTYLNFDDEENEDYEDVHAENTTLREIL

SEQ ID NO: 1194 - protein, 484 aa, Saccharomyces cerevisiae
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 1195 - protein, 440 aa, Saccharomyces cerevisiae
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 1196 - protein, 434 aa, Saccharomyces cerevisiae
MREEGSELEMEKGFLKWKPVNLMKKILSLPMKKTKNDIGLRLDISYILVNLIVCSYPVNTYPKLLYRNSLDDLILFLTVYHGKGNFRIFNFRGEKEDSDYKDNDLIGIAAKFESKDFEIQELRSTLINDGKIPISPIDLETRTLVEEETNNVICERIGWLDHFPPPFELLEEIVDGIENYLSVSKNRVAVLHCRMGKGRSGMITVAYLMKYLQCPLGEARLIFMQARFKYGMTNGVTIPSQLRYLRYHEFFITHEKAAQEGISNEAVKFKFKFRLAKMTFLRPSSLITSESAIVTTKIQHYNDDRNALLTRKVVYSDIMAHECGGNMTFIFGRDYLTLENDCRIEFTLGTSKSKAASSIISWTSCASCWLNIYLETLMHIIKDDSSPDYFQVERLKRDEMLGTTISWQELDGFGELSTHGLKLFQALKLEWEII

SEQ ID NO: 1197 - protein, 403 aa, Saccharomyces cerevisiae
MEIYIRLNADVEHDYAFQVSNEDTINNKIKKIFPSKTGLADLMVLRPSIFHEKEPVKFYKSIHPGYLSEGGCLMFHYEADNEENLEELNDSKPLIDQLWPGQLVVPEWKLSKKNIWVYTIIMLAWLYTDLPDAISPTPGICLTNQLSRLLIPVAKHMDLPEIAAKLEQEVQANYSSLVAQWLFFVMHIFKVGIITLFLKLGIANPISFNPYKLWSLRDLTSPSANGAKNSGGNNNTTDLKTRLRSLGWIGAKRATYDDYQTNYYNYVIDKMGGAVAAYRAGAIRKAAAPGIQLVAGEGFQSPLEDRFTASTFTAIKTERKFILSEEYFVELENNLKKILEEYDGDIGKMNAEIRRFRRFGIYEPDEKLASLVKLRREIADEKEKASNNDATFGIKKNDLKKSN

SEQ ID NO: 1198 - protein, 118 aa, Arabidopsis thaliana
MAAEGEVIACHTVEDWTEKLKAANESKKLIVIDFTATWCPPCRFIAPVFADLAKKHLDVVFFKVDVDELNTVAEEFKVQAMPTFIFMKEGEIKETVVGAAKEEIIANLEKHKTVVAAA

SEQ ID NO: 1199 - protein, 574 aa, Saccharomyces cerevisiae
MSEGRTFLSQLNVFNKENYQFSSSTTKKEVSNSTVDADNGASDFEAGQQFATELDQGEKQLGILSCIGLICNRMLGTGVFAVSSTIYTLCGSVGLALIMWAVGAIIAISGLYVYMEFGTAIPKNGGEKNYLEAIFRKPKFFITCMYAAYIFFLGWAAGNSINTAIMFLTAADTEVTKWNQRGIGVAVVFFAFLINSLNVKIGLYLQNILGIFKIGIVLFISITGWVALGGGLKDGYQSHNFRNAFEGTETATAYGIVNALYSVIWSFVGYSNVNYALGEVKNPVRTLKIAGPTSMVFLAIIYIFVNIAYFAVVPKDKLISSKLILAADFFDIVFGGQAKRAAAALVGLSALGNVLSVIFSQGRIIQQLGREGVLPFSNFFASSKPFNSPMVGLFQHFIVCTVTILAPPPGDAYLLVQNLISYPMNIINFAISAGLLWIYWQRRQGKIEWNPPIKAGVFVTGFFTLSNLYLIIAPYVPPSNGESVYSSMPYWIHCVIAWGIFFFGGVYYVVWAQLLPRWGHYKLVSKDVLGEDGFWRVKIAKVYDDTIGDVDTQEDGVIETNIIEHYKSEQEKSL

SEQ ID NO: 1200 - protein, 852 aa, Saccharomyces cerevisiae
MSSVNQIYDLFPNKHNIQFTDSHSQEHDTSSSLAKNDTDGTISIPGSIDTGILKSIIEEQGWNDAELYRSSIQNQRFFLTDKYTKKKHLTMEDMLSPEEEQIYQEPIQDFQTYNKRVQREYELRERMEEFFRQNTKNDLHILNEDSLNQQYSPLGPADYVLPLDRYSRMKHIASNFFRKKLGIPRKLKRRSHYNPNAEGHTKGNSSILSSTTDVIDNASYRNIAIDENVDITHKEHAIDEINEQGASGSESVVEGGSLLHDIEKVFNRSRATRKYHIQRKLKVRHIQMLSIGACFSVGLFLTSGKAFSIAGPFGTLLGFGLTGSIILATMLSFTELSTLIPVSSGFSGLASRFVEDAFGFALGWTYWISCMLALPAQVSSSTFYLSYYNNVNISKGVTAGFITLFSAFSIVVNLLDVSIMGEIVYVAGISKVIIAILMVFTMIILNAGHGNDIHEGVGFRYWDSSKSVRNLTYGLYRPTFDLADAGEGSKKGISGPKGRFLATASVMLISTFAFSGVEMTFLASGEAINPRKTIPSATKRTFSIVLISYVFLIFSVGINIYSGDPRLLSYFPGISEKRYEAIIKGTGMDWRLRTNCRGGIDYRQISVGTGYSSPWVVALQNFGLCTFASAFNAILIFFTATAGISSLFSCSRTLYAMSVQRKAPPVFEICSKRGVPYVSVIFSSLFSVIAYIAVDQTAIENFDVLANVSSASTSIIWMGLNLSFLRFYYALKQRKDIISRNDSSYPYKSPFQPYLAIYGLVGCSLFVIFMGYPNFIHHFWSTKAFFSAYGGLMFFFISYTAYKVLGTSKIQRLDQLDMDSGRREMDRTDWTEHSQYLGTYRERAKKLVTWLI

SEQ ID NO: 1201 - protein, 687 aa, Saccharomyces cerevisiae
MKPPLNMSRSNKPLTQEANSSAHIDRAHQLAQDFNSKQDDTALTSLPHKNPDIFRFENNITAHSSRRGSLYRDSDATVVLPLSEHTPRLSMDDPYRQLLQQAEISQLRSKKKRHSSRVLRTSFISFVVLVSSLSGLDQGLISGNVMTLSFQKYFHYPLTSPLGNIVSIVNLGAFMASLFVYSGILEPCSRKKMLQISTMIYSLGAIVQVLALNQWCLLLGRFLLGVGMGFAFSMVIIYQFEFPLPCIRKRTLISIQCVSSVIAYSFGIWINCAFRYLGFAWRYPLSTHVALGIILNLMSFYLILESPSWLLKQKNDVEALVLISNVFDDGNFEENQTQLKFRVLKRDILLKSHLQKNSYPYAYILKDFSSIIKLLIGFQLLTRTNGVDAFLYYSPLILQQMGRGERKSIYLTGLNALIYSIVILAYVPLVLRKRKEKTNVLLGSIVMCALLFTISFTDWFPKSTTRYISILFAVFLFTHFISWDSIGWVMTIELLPHLSQAPVILLVSNFYWIFKWFVSLITPILIDRLSWKFYLIPSLSSFISIIFVLKIFPIETRDERLDSDDDSTGNGSGNHDDVFDDTGSEFSSSPSFSAYQINTLGSSIKQNNQAYSSIQNEQILPKNGNLSNQTHGSAQNVYFITSDSGPSRTGEFFSFHNRTDPNISDNIAANKPSSGGGQNSPGDMAVA

SEQ ID NO: 1202 - protein, 518 aa, Saccharomyces cerevisiae
MEDKDITSVNEKEVNENTNPRIIKYDAERRATRTETSKKDKWKNIVTIIASGFALISDGYVNGSMSMLNKVFVMEYGKKNYSSKVSTRVSNAALVGIIFGQFFMGIAADYYSRKSCILVATAILVIGSALCAASHGTTVPGMFWMLTVMRGLVGIGVGAEYPTSTLSANESANEYTTTKRGGILVMVTNLPLAFGGPFATIIFLIVYKICSGTKHLEAIWRTVFAIGCFWPLSVFYFRWKTATTEVYEKGRIKRNIPYFLALKFYWKRLLGTCGTWFMYDFVTFPNGIFSSTIISSVIKDQNDLVKVAEWNLLLGVLAVLGVPIGAYLSDRIGRKYTLMFGFSGYIIFGLIIGCAYDQLKKITPLFIIFYAFMNMLGNAGPGDMLGVISSEASATAVRGVFYGLSAVTGKIGSVVGVECFQPIRDNLGARWTFIIAAICGLIGIIITYFFVPHSLESDLMKQDVEFHNYLVSNGWTGKMGFDETDEESMVRTIEVEENGTNCSKKNAEIISVRQVDQS

SEQ ID NO: 1203 - protein, 592 aa, Saccharomyces cerevisiae
MTEDFISSVKRSNEELKERKSNFGFVEYKSKQLTSSSSHNSNSSHHDDDNQHGKRNIFQRCVDSFKSPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVQYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 1204 - protein, 288 aa, Arabidopsis thaliana
MSKKSTESDAGNTEKQWSLADFEIGRPLGKGKFGRVYLAREAKSKYIVALKVIFKEQIEKYKIHHQLRREMEIQTSLRHPNILRLFGWFHDNERIFLILEYAHGGELYGVLKQNGHLTEQQAATYIASLSQALAYCHGKCVIHRDIKPENLLLDHEGRLKIADFGWSVQSSNKRKTMCGTLDYLAPEMVENRDHDYAVDNWTLGILCYEFLYGNPPFEAESQKDTFKRILKIDLSFPLTPNVSEEAKNLISQLLVKDPSKRLSIEKIMQHPWIVKNADPKGVCASIDI

SEQ ID NO: 1205 - protein, 465 aa, Arabidopsis thaliana
MEPRVGNKFRLGRKIGGGSFGEIYLGTNIQTNEEVAIKLENVKTKHPQLLYESKLYKVLQGGTGVPNVKWYGVEGDYNVLVIDLLGPSLEDLFNFCSRKLSLKTVLMLADQMINRIEFVHQKSFLHRDIKPDNFLMGLGRRANQVYVIDFGLAKKYRDSNHQHIPYRENKNLTGTARYASMNTHLGIEQSRRDDLESLGFVLMYFLKGSLPWQGLKAGNKKQKYEKISEKKVSTSIEALCRGYPSEFASYFHYCRSLRFDDKPDYAYLKRLFRDLFIREGFQFDYVFDWTILKYQQSQISTPPPRHHGPVVGPSSALPPAITSAERPSGGDEARPSGWSSGIPRRNSGQIFNSGSLAKQKAPVSSDPAISKDVVLSSSSFLRATGSSRRAAVSSSREAAVLGTDSEPSNPQIVEAGSGSNSKIPVSRNSPIVSSEINKLSSPSRATTSVMKNYEANLKGIESLHF

SEQ ID NO: 1206 - protein, 265 aa, Arabidopsis thaliana
MEFERYLGEGSFGSVSLFSYKRRCDVETLYAAVKTSDDAKSLYEEFQILSKFKGCSRIVQCYGSGVEQRLNDKGYVEYTIPMEYAAGGSLSDFMDRFNDKKLPDPMIRKFTRMLLEGLATIHRHGYVHCDLKPENILVFPGSVCDLKLKISDFGLSKRDGDTTWWHPLKSYAGTPIYMSPESISHGEIGKGLDLWSLGCVVLEMYTGKRPWWHTNYELEDLMKCYEPLFPPNLPCDAKLFLMTCFAPEPDERKDALTLLRQSFFR

SEQ ID NO: 1207 - protein, 381 aa, Arabidopsis thaliana
MTCCFSCLNPRTKDIRVDIDNARCNSRYQTDSSVHGSDTTGTESISGILVNGKVNSPIPGGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 1208 - protein, 424 aa, Arabidopsis thaliana
MRDSSTTASTKSSPLWKPFASNCCSVDDQTVFGNLSRCRPSRSEFSKNHLGPLPSFRRLSFADLSRSSSARINEDLAQTLGADLVDFQMCELKMITQSFSGNYLLGEGGFGKVYKGYVDDYLRQSLKAQPVAVKLLDIEGLQGHREWLSEVIFLGQLKHPNLVKLIGYCCEEEERVLIYEFMPRGSLENHLFRRISLSLPWATRLKIAVAAAKGLAFLHDLESPIIYRDFKTSNILLDSDFTAKLSDFGLAKMGPEGSKSHVTTRVMGTYGYAAPEYVSTGHLTTKSDVYSYGVVLLELLTGRRATEKSRPKNQQNIIDWSKPYLTSSRRLRCVMDPRLAGQYSVKAAKDTALLALQCVSPNPKDRPKMLAVVEALESLIHYKDMAVSSGHWPLSPKSQGGKVSPKVRGDHRSGRKSAPGSLRS

SEQ ID NO: 1209 - protein, 442 aa, Arabidopsis thaliana
MPALHPTFPLPETGHKLRPAATPPREKPQHRTTRSVENPPREKPQEKTRSVENPPREKPQEKTRSVETPPQEKTRPVDNPPSKPVEKLGLGRKAVPPSGKIVTPNLKMFTLVELKTATKNFRPESVIGEGGFGQVFKGWVDEKTLAPSRAGVGIPVAVKKSNPDSEQGLHEWQCEVRFLGKFHHPNLVKLLGYCWEENQFLLVYEYLPKGSLENHLFSKGAEALPWDTRLKIAIEAAQGLTFLHNSEKSVIYRDFKASNILLDSNFHAKLSDFGLAKNGPINGFSHVTTRVMGTQGYAAPEYMATGHLYVRSDVYGFGVVLLELLTGLRALDPNRPSAQQNLVEWAKPGLNQKKKVQKMMDPRLEQKYPLLAVTKTAELILRCLEADPKNRPPMDDVLRELEVVRTIRDQPQEERRKRSSGPDTNRVRGNDSPYGRRTGRTG

SEQ ID NO: 1210 - protein, 571 aa, Arabidopsis thaliana
MQMEANDCQEEHKFTLDNYHVVEQVRRGKSSSDFVVLHDIEDKKYAMKKICLAKHTDKLKQTALQEMKLLSSLKNPYIVHYEDSWIDNDNNACIFTAYYEGGNMANAIKKARGKLFPEERIFKWLAQLLLAVNYLHSNRVVHMDLTCSNIFLPKDDHVQLGNYGLAKLINPEKPVSMVSGISNSMCPEVLEDQPYGYKSDIWSLGCCMYEITAHQPAFKAPDMAGLINKINRSLMSPLPIVYSSTLKQMIKLMLRKKPEYRPTACELLRNPSLQPYLLQCQNLSPIYLPVFPIKPVNSPKDKARRNSLPGKFGKERVSREKSEVSRSLENLYPFWTNTETGSSSSSQPASSTNGAEDKLETKRIDPSCDTLKISEFTSQKSDESLIDPDIAVYSTETPAEENALPKETENIFSEESQLRDVDVGVVSAQEVACSPPRAIEEAETQEALPKPKEQITVPISSVAHSSTEVAAAKDHLSGSLEGDKAKMVKLTASEMSSVLSKLTKLGPPQSKERADALECLLEKCAGLVKQEKYEELAGLLTPFGEDGVSARDTAIWFAKTLLSSDKLNQGT

SEQ ID NO: 1211 - protein, 498 aa, Arabidopsis thaliana
MVKPSSSVSSVSMFALFSLVLCILIHCLYTKKPSFFQRFLSLLLPDLRLLEVDKEKQDPKSPRGALEACLTRCSISSASSSSDDPPPNREAIDNADADTDVQCKNHRASSNWGKFFKLWKRRSMKRLSSFPPLSGAAPPIIKQNKSADPNMNGMVLHDIYDFQSSLQNFSISDIEIATDNFSPENIIGRGGYADVYQGILPEGKLIAVKRLTKGTPDEQTAEFLSELGIIAHVDHPNTAKFIGCCIEGGMHLVFRLSPLGSLGSLLHGPSKYKLTWSRRYNVALGTADGLVYLHEGCQRRIIHRDIKADNILLTEDFQPQICDFGLAKWLPKQLTHHNVSKFEGTFGYFAPEYFMHGIVDEKTDVFAFGVLLLELITGHPALDESQQSLVLWAKPLLERKAIKELVDPSLGDEYNREELIRLTSTASLCIDQSSLLRPRMSQVVELLLGHEDVVMTPREAKIKMMQRTYSEELLDSVEYNSTKYLGDLDRIREVALAS

SEQ ID NO: 1212 - protein, 470 aa, Arabidopsis thaliana
MGYLSCNGESAVAICDTYNWNPRRRSKVPEKRHPPKLRVFNYDELAVATNGFSANNFLGKGSHGRVYKAVLDDGKLLAAVKRTTITTTVGNNNNNVSQVDNEIEILSRVRHRWMVNLIGYCVDHRRKTKLLVVEYMPNGTLHDQLHSRSSLDSRLSSWNRRIKHALQIAIAVHALHTAETQVIHRDIKSCNVLIDGDGNARLADFGLALIGNVDDERLKYTPPAGTLGYLDPSYLAPADLTAKSDVFSFGILLLEIISGREAIDLNYSPSCIVDWAVPLIKRGDYDAICDLKIKNRPYYAVIRKLAVMAARCVRSTAKKRPDMLEVVECLKTVRQLSPAWNKLRRRSEERSENVLAVEEEKEEIHVRIVRGGSRKNRKVSNVTTSVDDVYERLVPEETLPFRRRNFVLRSRSVGAKVGPDPYDGFGDETVVTMRLLIEKERPVTTAAMRLSKSRSVGIVRSHKTASRKRY

SEQ ID NO: 1213 - protein, 453 aa, Arabidopsis thaliana
MENKSHSNHHRYHHLSSRSHEQNQRGLISINAIIIIGISIISIFIILAILLIIILLHRLKSARVKAQELSCKESFNNMNNGGASTNYSYTSSPDDIKRDCLYSRNPTSFRQLPPQTKSCRRSRAEGVEVYTYKELEIATNNFSEEKKIGNGDVYKGVLSDGTVAAIKKLHMFNDNASNQKHEERSFRLEVDLLSRLQCPYLVELLGYCADQNHRILIYEFMPNGTVEHHLHDHNFKNLKDRPQPLDWGARLRIALDCARALEFLHENTISTVIHRNFKCTNILLDQNNRAKVSDFGLAKTGSDKLNGEISTRVIGTTGYLAPEYASTGKLTTKSDVYSYGIVLLQLLTGRTPIDSRRPRGQDVLVSWALPRLTNREKISEMVDPTMKGQYSQKDLIQVAAIAAVCVQPEASYRPLMTDVVHSLIPLVKAFNKSTDSSRFPSRRESLSFDDIMP

SEQ ID NO: 1214 - protein, 381 aa, Arabidopsis thaliana
MEQKVFPFQVLVSATKDFHPTHKLGEGGFGPVFKGRLPDGRDIAVKKLSQVSRQGKNEFVNEAKLLAKVQHRNVVNLWGYCTHGDDKLLVYEYVVNESLDKVLFKSNRKSEIDWKQRFEIITGIARGLLYLHEDAPNCIIHRDIKAGNILLDEKWVPKIADFGMARLYQEDVTHVNTRVAGTNGYMAPEYVMHGVLSVKADVFSFGVLVLELVSGQKNSSFSMRHPDQTLLEWAFKLYKKGRTMEILDQDIAASADPDQVKLCVQIGLLCVQGDPHQRPSMRRVSLLLSRKPGHLEEPDHPGVPGSRYRRRTQRPSGAASLGTLSTTGSSTDSFGSNLNTNTGTGVRGTPASSKASTRSNATRSAGQSSSSDPHGKRHMSY

SEQ ID NO: 1215 - protein, 324 aa, Arabidopsis thaliana
MVKGIRVYEHGGPEVLKWEDVEVGEPKEGEIRVKNKAIGLNFIDVYFRKGVYKPASMPFTPGMEAVGEVVAVGSGLTGRMIGDLVAYAGNPMGAYAEEQILPADKVVPVPSSIDPIVAASIMLKGMTAQFLLRRCFKVEPGHTILVHAAAGGVGSLLCQWANALGATVIGTVSTNEKAAQAKEDGCHHVIMYKNEDFVSRVNDITSGKGVNVVYDSVGKDTFKGSLACLKSRGYMVSFGQSSGSPDPIPLSDLAPKSLFLTRPSMMHYNETRDELLECAGEVFANVTSGILKARVNHKYPLSRVADAHADLENRITSGSVVLLP

SEQ ID NO: 1216 - protein, 341 aa, Arabidopsis thaliana
MFFSKDLPSPTSVFTAYASMAGYMMMIRSMAHELIPAPLQDFIYRTLRSLFFRSSSSTLTLTIDDDNMGMNNEIYRAAQTYLSTKISPDAVRLRISKGHKDKHVNLYLSDGEIVNDVYEDVQLVWRFVTDGGDKKGGGGGVGGRGGGGGRRGGMDDDGKSEYFELSFDKKHKDLILNSYVPYIESKAKEIRDERRILMLHSLNSLRWESVILEHPSTFETMAMEDDLKRDVIEDLDRFIRRKEFYKRVGKAWKRGYLLYGPPGTGKSSLVAAMANYLKFDVYDLQLASVMRDSDLRRLLLATRNRSILVIEDIDCAVDLPNRIEQPVEGKNRGESQVRFLL

SEQ ID NO: 1217 - protein, 464 aa, Arabidopsis thaliana
MMLRAVFRRASIRGSSSASGLGKSLQSSRVAVSAQFHSVSATETLVPRGNHAHSFHHRSCPGCPDCSRTIINGYQGTALQRWVRPFSSDSGDVVEAVVPHMGESITDGTLAAFLKKPGDRVEADEAIAQIETDKVTIDIASPASGVIQEFLVKEGDTVEPGNKVARISTSADAVSHVAPSEKAPEKPAPKPSPPAEKPKVESTKVAEKPKAPSPPPPPPSKQSAKEPQLPPKDRERRVPMTRLRKRVATRLKDSQNTFALLTTFNEVDMTNLMKLRSQYKDAFLEKHGVKLGLMSGFIKAAVSALQHQPVVNAVIDGDDIIYRDYVDISIAVGTSKGLVVPVIRDADKMNFADIEKTINGLAKKATEGTISIDEMAGGSFTVSNGGVYGSLISTPIINPPQSAILGMHSIVQRPMVVGGSVVPRPMMYVALTYDHRLIDGREAVYFLRRIKDVVEDPQRLLLDI

SEQ ID NO: 1218 - protein, 414 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKLTDGSVKFPFIVQVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 1219 - protein, 192 aa, Arabidopsis thaliana
MFAVENGLQGDPRLKAISDAIRVIPHFPKTGIMFQDITTLLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQFDELTL

SEQ ID NO: 1220 - protein, 467 aa, Arabidopsis thaliana
MQSSVYRDKASSIAMILETQRNVEFPHRIVDKRPRKRPRLTWDAAPPLLPPPPPPTVFQPPLYYGPEFASGLVPNFVYPNMFYNGLPRQGSPPWRPDDKDGHYVFVVGDTLTPRYQILSKMGEGTFGQVLECFDNKNKEVVAIKVIRSINKYREAAMIEIDVLQRLTRHDVGGSRCVQIRNWFDYRNHICIVFEKLGPSLYDFLRKNSYRSFPIDLVRELGRQLLESVAYMHDLRLIHTDLKPENILLVSSEYIKIPDYKFLSRPTKDGSYFKNLPKSSAIKLIDFGSTTFEHQDHNYIVSTRHYRAPEVILGVGWNYPCDLWSIGCILVELCSGEALFQTHENLEHLAMMERVLGPLPPHMVLRADRRSEKYFRRGAKLDWPEGATSRDSLKAVWKLPRLPNLIMQHVDHSAGDLIDLLQGLLRYDPTERFKAREALNHPFFTRSREQSIPPFNPNPHPFLYNQKN

SEQ ID NO: 1221 - protein, 353 aa, Arabidopsis thaliana
MEAKKVTEEEEETWRREIVTSVMRLVSTRLPQTDLISLLLVSPWLYRTLISYPSIWLTINLREMTNAGDRLLAALSLPRYRQVKHINLEFAQGVVDSHLKLVKTECPDALLSLEWLNLNVCQKISDNGIEAITSICPKLKVFSIYWNVRVTDAGIRNLVKNCRHITDLNLSGCKSLTDKSMQLVAESYPDLESLNITRCVKITDDGLLQVLQKCFSLQTLNLYALSGFTDKAYMKISLLADLRFLDICGAQNISDEGIGHIAKCNKLESLNLTWCVRITDAGVNTIANSCTSLEFLSLFGIVGVTDRCLETLSQTCSTTLTTLDVNGCTGIKRRSREELLQMFPRLTCFKVHS

SEQ ID NO: 1222 - protein, 287 aa, Arabidopsis thaliana
MSQTSYYRSPFGDTTYTKVFVGGLAWETPTDEMRRYFEQFGEILEAVIITDKNTGKSKGYGFVTFRESDSATRAVADPNPVIDGRKANCNIASFGRPRPSPPRGRGQTGSPSQYQSGGPSTYTGMAAPLPPAAAPQLMYPSYGYTYNPDQFGYHQALYNTQLQQAQYYQQQQQLYGGGATSPSSSGATIMPSPYYYGYSLQAPRVPYQHHHHLPQPYNPQQHHHQRFSSPSFLVYPSNSSFAPPLQGVLSSSTESEAVPQQVPAAEGEATTTAPEITTSNTKEPISS

SEQ ID NO: 1223 - protein, 433 aa, Arabidopsis thaliana
MSIPCLTEETAKTVLRQVEFYFSDSNLPIDDFLKKTVTESEDGLVSLALICSFSKMRGYLKLGDSKGDDIPEDTIKAVADTLRTSSALKISDDGKKVGRSTELLKLEDLIEQLNARTVAASPFSYDVKREDVESFFSQYGKVNSVRMPRHVAESRIFSGVALVEFPTEEDAQNVMKQNLVFAGQELELKPKKEFDNEREKDEVKFANYQPQKGSANQKNGSDHKNNSAYEPDYPKGLIISFTLKRSAEEGTTEQKSSEEPTDKTMEESETKPADTPDADKENTGEVQAEGAEDEDDEKEEKGALATHKDNKDVVLREDLKAVFGKFGDVKFVDFKMGSETGYLRFDEPEASQKARAAAVLANEGGLAVKNFIAVLEPVIGEAEKEYWTLLRSKDRFDKGGRGGRGGRRGGRFGRKRGSDSPGGRWNKSQKVEA

SEQ ID NO: 1224 - protein, 516 aa, Arabidopsis thaliana
MGSGQWHMEKRSTLKNDSFVKEYNPVTETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 1225 - protein, 390 aa, Arabidopsis thaliana
MAMSILAKIFLVFAIYCAIDPFSHSSISKFPDFKTYKIDMPPLSSLPKERDRQNLLQNSEIRFLNEVQGPESIAFDPQGRGPYTGVADGRILFWNGTRWTDFAYTSNNRSELCDPKPSLLDYLKDEDICGRPLGLRFDKKNGDLYIADAYLGIMKVGPEGGLATSVTNEADGVPLRFTNDLDIDDEGNVYFTDSSSFFQRRKFMLLIVSGEDSGRVLKYNPKTKETTTLVRNLQFPNGLSLGKDGSFFIFCEGSIGRLRKYWLKGEKAGTSEVVALLHGFPDNIRTNKDGDFWVAVHCHRNIFTHLMAHYPRVRKFFLKLPISVKFQYLLQVGGWPHAVAVKYSEEGKVLKVLEDSKGKVVKAVSEVEEKDGKLWMGSVLMSFIAVYDLP

SEQ ID NO: 1226 - protein, 530 aa, Arabidopsis thaliana
MENDVKENLEEEEDRLLPPPPPSQSLPSTDSESEAAFETNEKILIVDFESPDDPTTGDTPPPFSWRKLWLFTGPGFLMSIAFLDPGNLEGDLQAGAIAGYSLLWLLMWATAMGLLIQMLSARVGVATGRHLAELCRDEYPTWARYVLWSMAELALIGADIQEVIGSAIAIQILSRGFLPLWAGVVITASDCFLFLFLENYGVRKLEAVFAVLIATMGLSFAWMFGETKPSGKELMIGILLPRLSSKTIRQAVGVVGCVIMPHNVFLHSALVQSRKIDPKRKSRVQEALNYYLIESSVALFISFMINLFVTTVFAKGFYGTEKANNIGLVNAGQYLQEKFGGGLLPILYIWGIGLLAAGQSSTITGTYAGQFIMGGFLNLRLKKWMRAVITRSCAIVPTMIVAIVFNTSEASLDVLNEWLNVLQSVQIPFALLPLLTLVSKEEIMGDFKIGPILQRIAWTVAALVMIINGYLLLDFFVSEVDGFLFGVTVCVWTTAYIAFIVYLISHSNFFPSPWSSSSIELPKRVSVSNS

SEQ ID NO: 1227 - protein, 129 aa, Arabidopsis thaliana
MERQIMASSKKVQREENTKEEYLPNKQVSDESEQLEKSCLTEEEDACLSDASHSSKKTIREDAICESKNRKKYKPSNESGFNTLFDDDWLFGNNQQKNVVTTNKAAIKNDAEMIMKLLQRSCGDSLFPS

SEQ ID NO: 1228 - protein, 260 aa, Arabidopsis thaliana
MDNLEDLKIVAEQWSKQGLEFVQKIPPPQLYTAIGVLLLATIWLLSIRLFRRTKSNTVLLSGLSGSGKTVLFYQLRDGSSHQGAVTSMEPNEGTFVLHNENNTKKGKVKPVHLIDVPGHSRLISKLEEYLPRAAAVVFVVDALEFLPNIRAASEYLYDILTNASVIKNKTPVLLCCNKTDKVTAHTKEFIRKQMEKEIDKLRVSRSAISTADIANDFTLGIEGEVFSFSHCHNKVTVAEASGLTGETDQVQEFIREHVKP

SEQ ID NO: 1229 - protein, 262 aa, Arabidopsis thaliana
MEEIADKTFFRYCLLTLIFAGPPTAVLLKFLQAPYGKHNRTGWGPTVSPPIAWFVMESPTLWLTLLLFPFGRHALNPKSLLLFSPYLIHYFHRTIIYPLRLFRSSFPAGKNGFPITIAALAFTFNLLNGYIQARWVSHYKDDYEDGNWFWWRFVIGMVVFITGMYINITSDRTLVRLKKENRGGYVIPRGGWFELVSCPNYFGEAIEWLGWAVMTWSWAGIGFFLYTCSNLFPRARASHKWYIAKFKEEYPKTRKAVIPFVY

SEQ ID NO: 1230 - protein, 92 aa, Arabidopsis thaliana
MASQQEKKQLDERAKKGETVVPGGTGGKSFEAQQHLAEGRSRGGQTRKEQLGTEGYQQMGRKGGLSTGDKPGGEHAEEEGVEIDESKFRTKT

SEQ ID NO: 1231 - protein, 122 aa, Arabidopsis thaliana
MALRNAILRHLRVPVQTLGLNQSKIGFLGTIRSFSSHDDHLSREAVVDRVLDVVKSFPKVDPSKVTPEVHFQNDLGLDSLDTVEIVMAIEEEFKLEIPDKEADKIDSCSLAIEYVYNHPMSS

SEQ ID NO: 1232 - protein, 183 aa, Arabidopsis thaliana
MASPSKRREMDMMKLMMSDYKVDTVNDDLQMFYVTFHGPTDSLYQGGVWKIKVELPEAYPYKSPSVGFVNKIYHPNVDESSGAVCLDVINQTWSPMFDLINVFESFLPQLLLYPNPSDPFNGEAASLLMRDRAAYELKVKEYCEKYAKPEEILSDDDDDDSMSEDGSDSDDDDDDEIVGKADP

SEQ ID NO: 1233 - protein, 298 aa, Arabidopsis thaliana
MGLERKVYGLVMVSLVLMAIATMCCVQATIEEEAAKDESWTDWAKEKIGLKHEDNIQPTHTTTTVQDDAWRASQKAEDAKEAAKRKAEEAVGAAKEKAGSAYETAKSKVEEGLASVKDKASQSYDSAGQVKDDVSHKSKQVKDSLSGDENDESWTGWAKEKIGIKNEDINSPNLGETVSEKAKEAKEAAKRKAGDAKEKLAETVETAKEKASDMTSAAKEKAEKLKEEAERESKSAKEKIKESYETAKSKADETLESAKDKASQSYDSAARKSEEAKDTVSHKSKRVKESLTDDDAEL

SEQ ID NO: 1234 - protein, 262 aa, Arabidopsis thaliana
MSQEEQPKRPQEPVTYGDVFEVSGELADKPIAPEDANMMQAAETRVFGHTQKGGAAAVMQSAATANKRGGFVHPGDTTDLAAERGVTVAQTDVPGARVTTEFVGGQVVGQYVEPRPVATAAAMEAEVVGLSLQSAITIGEALEATVQTAGNKPVDQSDAAAIQAAEVRACGTNVIAPGGIAASAQSAANHNATIDRDEDKIKLIDVLAGATGKLAADKAVTRQDAEGVVSAELRNNPNLSTHPGGVAASITAAARLNERADI

SEQ ID NO: 1235 - protein, 170 aa, Arabidopsis thaliana
MEDLLEERLTRTDSVGNKRVRDGLDLDSPDVKRLRDDLFDDSGLDPVSQDLDSVMKSFENELSTTTAALSSGETQPDLGYLFEASDDELGLPPPLTPPQTLLPPSCEETVTELVRASSDSSEVGELCGFEDHVTEFGPCDLGDDGLFEYFDGCLDSGDLFSWRPEFLPAE

SEQ ID NO: 1236 - protein, 234 aa, Arabidopsis thaliana
MATSLSVSRFMSSSATVISVAKPLLSPTVSFTAPLSFTRSLAPNLSLKFRNRRTNSASATTRSFATTPVTASISVGDKLPDSTLSYLDPSTGDVKTVTVSSLTAGKKTILFAVPGAFTPTCSQKHVPGFVSKAGELRSKGIDVIACISVNDAFVMEAWRKDLGINDEVMLLSDGNGEFTGKLGVELDLRDKPVGLGVRSRRYAILADDGVVKVLNLEEGGAFTNSSAEDMLKAL

SEQ ID NO: 1237 - protein, 181 aa, Arabidopsis thaliana
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 1238 - protein, 377 aa, Arabidopsis thaliana
MEPLISPQPRFRLQPIPENPSSSSSSASITIPRSISNTSFFHEISQERLLLHHQDLEQSVQDDKEDQDSDSDETNRFLSQTRPLHRSRTAPAMVIIKDLRTKPPETKKPSPVSKSIIRQAIFLLIVYLTLGVSIYSFNRDHYSGIETHPVVDALYFCIVTMCTIGYGDIAPLTPWTKIFAVVFVLFGFGFLDILLSGVVNYVLDLQESMILTGIQTRQHHQHHHHHRFSAKDYIIDFEKGRMRIRMKVCLALCVVVLCIGVGALVLHFVEELGFVDSVYLSVMSVTTVGYGDRAFKTLQGRLFAAVWLLVSTLAVARAFLYLAEARIDRRHRKAVKLALNREITVDDLLKADTYQHGFIRLTSFKNLNFVFFFRILD

SEQ ID NO: 1239 - protein, 161 aa, Arabidopsis thaliana
MTSSSESTRKGLTKIATNRLQKEFMEWQTNPPSGFKHRVSDNLQRWIIEVHGVPGTLYANETYQLQVEFPEHYPMEAPQVIFQHPAPLHPHIYSNGHICLDVLYDSWSPAMRLSSICLSILSMLSSSSVKQKPKDNDHYLKNCKHGRSPKETRWRFHDDKV

SEQ ID NO: 1240 - protein, 261 aa, Arabidopsis thaliana
MARLVFSLNLPSSHGFNLSPRNLQSFFVTQTGAPRFRAVRCKPNPESSETKQEKLVIDNGETSSASKEVESSSSVADSSSSSSSGFPESPNKDINRRVAAVTVIAALSLFVSTRLDFGISLKDLTASALPYEEALSNGKPTVVEFYADWCEVCRELAPDVYKIEQQYKDKVNFVMLNVDNTKWEQELDEFGVEGIPHFAFLDREGNEEGNVVGRLPRQYLVENVNALAAGKQSIPYARAVGQYSSSESRKVHQVTDPLSHG

SEQ ID NO: 1241 - protein, 313 aa, Arabidopsis thaliana
MAALQTLREWIGIQQFPPATQSKLLEILGKYKEEDVSSLTVLVMGKGGVGKSSTVNSVIGEKAAAVSTFQSEGLRPTLVSRTRSGFTLNIIDTPGLIEGGYVNDQAINIIKRFLLNMTIDVLLYVDRLDVYRVDDLDRQVVGAITDAFGKEIWKKSALVLTHAQFSPPDGLNYNHFVSKRSNALLKVIQTGAQLKKQDLQGFSIPVILVENSGRCHKNESDEKILPCGTSWIPNLFNKITEISFNGNKAIHVDKKLVEGPNPNERGKKLIPLMFAFQYLLVMKPLVRAIKSDVSRESKPAWELRDSGLASRRS

SEQ ID NO: 1242 - protein, 334 aa, Arabidopsis thaliana
MSWLPVESDPGIFTEIIQQMQVKGVQVEELYSLDFNSLDEIRPVYGLILLYKWRPEEKENRVVITEPNPNFFFASQIINNACATQAILSVLMNSSSIDIGSELSELKQFAKEFPPELKGLAINNNEAIRAAHNTFARPDPSSIMEDEELAAAKNLDEDDDVYHYISYLPVDGILYELDGLKEGPISLGQCLGEPEGIEWLRMVQPVVQEQIDRYSQNEIRFSLLAVVKNRKEMYVAELKEYQRKRERVLQQLGALQADKYAEKSSYEALDRELSEVNIGIETVSQKIVMEEEKSKNWKKENMRRKHNYVPFLFNFLKILADKKKLKPLIAKHHP

SEQ ID NO: 1243 - protein, 222 aa, Arabidopsis thaliana
MDSDSWSDRLASASRRYQLDFLSRSDNFLGFEEIEGEDDFREEYACPFCSDYFDIVSLCCHIDEDHPMDAKNGVCPICAVKVSSDMIAHITLQHANMFKVTRKRKSRRGGAQSMLSILKREFPDGNFQSLFEGTSRAVSSSSASIAADPLLSSFISPMADDFFISESSLCADTSSAKKTLNQSLPERNVEKQSLSAEDHREKLKQSEFVQGILSSMILEDGL

SEQ ID NO: 1244 - protein, 167 aa, Arabidopsis thaliana
MSSGIGSLVKVIFKNFDVIAGPVISLVYPLYASVRAIESRSHGDDKQWLTYWALYSLIKLFELTFFRLLEWIPLYPYAKLALTSWLVLPGMNGAAYLYEHYVRSFLLSPHTVNVWYVPAKKDDDLGATAGKFTPVNDSGAPQEKIVSSVDTSAKYVGHSAFDDAYIY

SEQ ID NO: 1245 - protein, 518 aa, Arabidopsis thaliana
MADSTRPLLSDFNSSESNLPPPRSLEETIERCIGDFGWAQFLQAALVSFAWFFDAQQTFITVFTDSQPMWHCDNSDRVDSVCNTSSSNLCTLPNQTWSWDLNPHVSIISEWGLQCAGSFLKGFPASSFFLGCLIGGLALSTLADSSLGRKNMLLLSCLIMSLSSMLTAFSTSIWVYAFLRFLNGCGRATIGTCALVLSTELVGKKWRGQVGAMGFFCFTLGFLSLPMLGYINEGNSWRNLYVWTSIPTLIYCCLVRSFVRESPRWLIVKGRKEEAVSILQSIASNAITMSFTNLCFEVENDQSKSNPDVYDALKILVRKSWSFRRLLAAMVVGFGIGMVYYGMPLALTNLNFNLYLGVVFNALSEFPAFLITFFFIDKINRRDALIGFTALSGISSALIAVLGQQLGSLQIVLELVSFFSACTAFNMTLIYTIEMFPTCVRNSAISMVRQALVFGGVFSPVMVAAGRENQFWSYGLFGLIIGLCGLFVFGLPETRGSVLCDTMDEEEYKTLAKRQFIG

SEQ ID NO: 1246 - protein, 312 aa, Arabidopsis thaliana
MPPAGELRHQSPSKEKLSSVTQSDEAEAASAAISAAAADAEAAGLWTQIKAEARRDAEAEPALASYLYSTILSHSSLERSISFHLGNKLCSSTLLSTLLYDLFLNTFSSDPSLRNATVADLRAARVRDPACISFSHCLLNYKGFLAIQAHRVSHKLWTQSRKPLALALHSRISDVFAVDIHPAAKIGKGILLDHATGVVVGETAVIGNNVSILHHVTLGGTGKACGDRHPKIGDGCLIGAGATILGNVKIGAGAKVGAGSVVLIDVPCRGTAVGNPARLVGGKEKPTIHDEECPGESMDHTSFISEWSDYII

SEQ ID NO: 1247 - protein, 462 aa, Arabidopsis thaliana
MESERLESHLLNKQEEEASSFTSGLLLSTSVVVAGSFCYGCAMSYSSPAQSKIMEELGLSVADYSFFTSVMTLGGMITAVFSGKISALVGRRQTMWISDVCCIFGWLAVAFAHDIIMLNTGRLFLGFGVGLISYVVPVYIAEITPKTFRGGFSYSNQLLQCLGISLMFFTGNFFHWRTLALLSAIPSAFQVICLFFIPESPRWLAMYGQDQELEVSLKKLRGENSDILKEAAEIRETVEISRKESQSGIRDLFHIGNAHSLIIGLGLMLLQQFCGSAAISAYAARIFDKAGFPSDIGTTILAVILIPQSIVVMLTVDRWGRRPLLMISSIGMCICSFFIGLSYYLQKNGEFQKLCSVMLIVGLVGYVSSFGIGLGGLPWVIMSEIFPVNVKITAGSLVTMSNWFFNWIIIYSFNFMIQWSASGTYFIFSGVSLVTIVFIWTLVPETKGRTLEEIQTSLVRLS

SEQ ID NO: 1248 - protein, 611 aa, Arabidopsis thaliana
MASKIIAGKPDDTEYEIIEGESESALAAGTSPWMNSSTLKLRHRIGRGPFGDVWLATHHQSTEDYDEHHEVAIKMLYPIKEDQRRVVVDKFEDLFSKCQGLENVCLLRGVSSINGKICVVMKFYEGSLGDKMARLKGGKLSLPDVLRYGVDLATGILELHSKGFLILNLKPSNFLLSDNDKAILGDVGIPYLLLSIPLPSSDMTERLGTPNYMAPEQWQPDVRGPMSFETDSWGFGCSIVEMLTGVQPWSGRSADEIYDLVVRKQEKLSIPSSIPPPLENLLRGCFMYDLRSRPSMTDILLVLKSLQNSEEEQVRRGIDSREIRKSSATLGYTEWFLSKDHLQVRDTVRSRKPANSCKHENMDVPEGMVVGLERDSTDPDGFVLVKVHGVHDPLRVHVSVLERVTNGLASGDWVRLKVRKDKRHSPVGVLHSIDREGNVAVGFIGLPTLWKGTSSQLQMAKVYSVGQFVKLKANVVIPRFKWMRKGRGIWATGRISQVLPNGCLEVDFPGMLPFGEEHGSYLADPAEVEIVNFNTCQGAVEKYQHLEDFHWAVRPLLIAMGLLTAMKLGICVRKKIGRSKDGKQRDGSTGQGDCKIPDGKGSDKSKWLVFF

SEQ ID NO: 1249 - protein, 416 aa, Arabidopsis thaliana
MGLFGTKKIGKYEIGRTIGEGNFAKVKLGYDTTNGTYVAVKIIDKALVIQKGLESQVKREIRTMKLLNHPNIVQIHEVIGTKTKICIVMEYVSGGQLSDRLGRQKMKESDARKLFQQLIDAVDYCHNRGVYHRDLKPQNLLLDSKGNLKVSDFGLSAVPKSGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKVKIQPKEIRSRSSYDLLSAEVIEVTPTNCVIEISKSAGELRLYMEFCQSLSSLLTAEVS

SEQ ID NO: 1250 - protein, 489 aa, Arabidopsis thaliana
MGCLHSKTANLPSSDDPSAPNKPESVNGDQVDQEIQNFKEFELNELRKATNGFSPSCIVSEGGEKAPNVVYRGKLEGNHLVAIKRFSRQSWPDAQQFVVEATGVGKLRNKRIVSLIGCCAEGDERLLVAEYMPNDTLSKHLFHWEKQPLPWDMRVRIADYIAEALDYCNIENRKIYHDLNAYRILFDEEGDPRLSTFGLMKNSRDGKSYSTNLAYTPPEFLRTGRVIPESVIFSYGTILLDLLSGKHIPPSHALDIIRGKNALLLMDSSLEGQYANDDATKLVDLASKCLQSEAKDRPDTKFLLSAVAPLQKQEEVASHVLMGLPKNTVILPTMLSPLGKACAKMDLATFHDILLKTGYRDEEGAENELSFQEWTQQVQEMLNTKKFGDIAFRDKDFKNSIEYYSKLVGMMPVPSATVFARRAFSYLMTDQQELALRDAMQAQVCIPEWPTAFYLQALALSKLGMETDAQDMLNDGAAYDAKRQNSWRC

SEQ ID NO: 1251 - protein, 304 aa, Arabidopsis thaliana
MRTLSSQLYSNGGLTWFQKKNQSSLFIKHLRVSKPSRVQLISAVQFRPCIDIHKGKVKQIVGSTLRDLKEDGSVLVTNFESDKSAEEYAKMYKEDGLTGGHVIMLGADPLSQAAAIGALHAYPGGLQVGGGINSENCMSYIEEGASHVIVTSYVFNNGKIDLERLKDIVSIVGKQRLILDLSCRKKDGRYAIVTDRWQKFSDVILDEKSLEFLGGFSDEFLVHGVDVEGKKLGIDEELVALLGNYSPIPVTYAGGVTVMDDVERIKDAGKGRVDVTVGSALDIFGGNLPYKDVVAWHHKQHSLH

SEQ ID NO: 1252 - protein, 586 aa, Arabidopsis thaliana
MASTRKPSGHGAEVEAQKRSSSNSSTKSAKAETFEPMQLQRSVTNPRAVGIPESKRLPESFRKRSSDPAVCKPDFSSLSTVLEHVDSLTIDEKKTSGFGSVKTSSASAKLSDGTSSLGKTSGSAKLSGRLDFMESGKSSICRGSTSSDVSDESSCSSFSSTVNKPHKANDLRWEAIQAVRVRDGLLGLSHFRLLKRLGCGDIGSVYLSELSGTKCYFAMKVMDKTSLASRKKLLRAQTEREILQSLDHPFLPTLYTHFETEKFSCLVMEFCPGGDLHTLRQRQPGKHFSEQAVKFYIAESLLALEYLHMLGIVYRDLKPENVLVREDGHIMLSDFDLSLRCLVSPTLVKSAAIESDPLRKNVYCVQPACIEPSCIQPSCTVPTTCFSPRLFSSKSKKDRKPKNDTANQVRPLPELVAEPTDARSMSFVGTHEYLAPEIIKGEGHGSAVDWWTFGIFLYELLFGRTPFKGSGNRQTLFNVVGQPLRFPETPVVSFAARDLIRGLLMKEPQQRLGFKRGATEVKQHPFFEGVNWALIRCATPPEIPKPVELEKGAVSVAEAPSSQKTAAGLVLNAQKGSDNYLEFDFF

SEQ ID NO: 1253 - protein, 419 aa, Arabidopsis thaliana
MGACISFFSSSSPSKTGLHSHATTNNHSNGTEFSSTTGATTNSSVGQQSQFSDISTGIISDSGKLLESPNLKVYNFLDLKTATKNFKPDSMLGQGGFGKVYRGWVDATTLAPSRVGSGMIVAIKRLNSESVQGFAEWRSEVNFLGMLSHRNLVKLLGYCREDKELLLVYEFMPKGSLESHLFRRNDPFPWDLRIKIVIGAARGLAFLHSLQREVIYRDFKASNILLDSNYDAKLSDFGLAKLGPADEKSHVTTRIMGTYGYAAPEYMATGHLYVKSDVFAFGVVLLEIMTGLTAHNTKRPRGQESLVDWLRPELSNKHRVKQIMDKGIKGQYTTKVATEMARITLSCIEPDPKNRPHMKEVVEVLEHIQGLNVVPNRSSTKQAVANSSRSSPHHYRYKAGALGAERKRATPGRFGSVEK

SEQ ID NO: 1254 - protein, 525 aa, Arabidopsis thaliana
MDEEATSWIRRAKFSQTVSYRLNSSKLASLPFMINQDKFSGLKAIPQRSSSSSSASSSDPKLVSSNSQTTGDTSSLEAADVYVVDSEIQTNPVTHKQRSVSPSPQMAVPDVFKEARSERKRFSTPHPRRVESEKGMKPKLSHKNSFDKRSFNLRSPSGPIRDLGTLRIQERVKSKKDTGWSKLFDNTGRRVSAVEASEEFRVDMSKLFFGLKFAHGLYSRLYHGKYEDKAVAVKLITVPDDDDNGCLGARLEKQFTKEVTLLSRLTHPNVIKFVGAYKDPPVYCVLTQYLPEGSLRSFLHKPENRSLPLKKLIEFAIDIARGMEYIHSRRIIHRDLKPENVLIDEEFHLKIADFGIACEEEYCDMLADDPGTYRWMAPEMIKRKPHGRKADVYSFGLVLWEMVAGAIPYEDMNPIQAAFAVVHKNIRPAIPGDCPVAMKALIEQCWSVAPDKRPEFWQIVKVLEQFAISLEREGNLNLSSSKICKDPRKGLKHWIQKLGPVHAGGGGGSSSSGLGGSALPKPKFA

SEQ ID NO: 1255 - protein, 187 aa, Arabidopsis thaliana
MLAPGESVLIPAEEISLSAGDVISLSVHNLIASVSSYRPWWSEFLAFGSIDRPSSFSPAVSRVKLNLHHFAVNYVLLTAASITLFLIGDPMALVTVASFVAMWLLLYFYRDHPLVLYGRHISDRVIVFGLILGSLWALWFINSLQCLILGVVTSVLLCLVHAIIRNSDDLFVQEKDVVVPSNFLHWS

SEQ ID NO: 1256 - protein, 367 aa, Arabidopsis thaliana
MSQNGKIIPNLDQNSTRLLNLTVLQRIDPYIEEILITAAHVTFYEFNIELSQWSRKDVEGSLFVVKRSTQPRFQFIVMNRRNTDNLVENLLGDFEYEVQGPYLLYRNASQEVNGIWFYNKRECEEVATLFNRILSAYSKVNQKPKASSSKSEFEELEAKPTMAVMDGPLEPSSTARDAPDDPAFVNFFSSTMNLGNTASGSASGPYQSSAIPHQPHQPHQPTIAPPVAAAAPPQIQSPPPLQSSSPLMTLFDNNPEVISSNSNIHTDLVTPSFFGPPRMMAQPHLIPGVSMPTAPPLNPNNASHQQRSYGTPVLQPFPPPTPPPSLAPAPTGPVISRDKVKEALLSLLQEDEFIDKITRTLQNALQQ

SEQ ID NO: 1257 - protein, 351 aa, Arabidopsis thaliana
MGSSVEQNILVTGGAGFIGTHTVVQLLKDGFKVSIIDNFDNSVIEAVDRVRELVGPDLSKKLDFNLGDLRNKGDIEKLFSKQRFDAVIHFAGLKAVGESVENPRRYFDNNLVGTINLYETMAKYNCKMMVFSSSATVYGQPEKIPCMEDFELKAMNPYGRTKLFLEEIARDIQKAEPEWRIILLRYFNPVGAHESGSIGEDPKGIPNNLMPYIQQVAVGRLPELNVYGHDYPTEDGSAVRDYIHVMDLADGHIAALRKLFADPKIGCTAYNLGTGQGTSVLEMVAAFEKASGKKIPIKLCPRRSGDATAVYASTEKAEKELGWKAKYGVDEMCRDQWKWANNNPWGYQNKL

SEQ ID NO: 1258 - protein, 279 aa, Arabidopsis thaliana
MPVNHRFTFSYRLLFLIFLLSFETAQRLVTGDPNDEACLTNLRQSLEDPANNLRNWTKSFFINPCSGFSSYLHGVICNNGRIYKLSLTNLSLRGSISPFLSNCTNLQSLDLSSNQISGEIPPQLQFFVNLAVLNLSSNRLSGQISPQIALCAYLNVIDLHDNQLSGQIPFQFGLLARLTAFDVSNNKLSGQIPSNLAMRNGNLPRFNASSFIGNKKLFGYPLEEMKNKGLSIMAIVGIGLGSGIASLVISFTGVCIWLKITEKKMEEEEGKISHSMPVY

SEQ ID NO: 1259 - protein, 152 aa, Arabidopsis thaliana
MTHNHHHQAVDNLLNVFSRASHDLTVVHSKLDKEFQQMYPANANPMKLIQRIKKLQEDVTLLKHQCLDLLSAKQDLIDKAQTTLVGNCNLIQKMNASLGESTNGDTDDALADFNQIIDEWTMQVRSRTVGETEDADKEDINKMLFSAICHTN

SEQ ID NO: 1260 - protein, 399 aa, Bacillus subtilis subsp. subtilis str. 168
MEITPSDVIKTLPRQEFSLVFQKVKEMEKTGAHIINLGQGNPDLPTPPHIVEALREASLNPSFHGYGPFRGYPFLKEAIAAFYKREYGVTINPETEVALFGGGKAGLYVLTQCLLNPGDIALVPNPGYPEYLSGITMARAELYEMPLYEENGYLPDFEKIDPAVLEKAKLMFLNYPNNPTGAVADAAFYAKAAAFAKEHNIHLIHDFAYGAFEFDQKPASFLEAEDAKTVGAELYSFSKTFNMAGWRMAFAVGNEKIIQAVNEFQDHVFVGMFGGLQQAASAALSGDPEHTESLKRIYKERIDFFTALCEKELGWKMEKPKGTFYVWAEIPNTFETSHQFSDYLLEHAHVVVTPGEIFGSNGKRHVRISMVSKQEDLREFVTRIQKLNLPFGSLQETSR

SEQ ID NO: 1261 - protein, 458 aa, Pseudomonas fluorescens PfO-1
MTVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKEGKNIFASEDPEQNAALRHAIGGVLETLPAQMAFLCPNVNSYRRFGAQFYVPNSPSWGLDNRTVALRVPTGSADAVRLEHRVAGADANPYLLMASVLAGVHHGLTNKIEPPAPTEGNSYEQNEQSLPNNLRDALRELDDSEVMAKYIDPKYIDIFVACKESELEEFEHSISDLEYNWYLHTV

SEQ ID NO: 1262 - protein, 389 aa, Pseudomonas syringae pv. tomato str. DC3000
MVMTVLKMTDLDLQGKRVLIREDLNVPIKDGVVSSDARILASLPTIRLALEKGAAVMVCSHLGRPTEGEFSAENSLKPVAEYLSKALGRDVPLVADYLDGVDVKAGDIVLFENVRFNKGEKKNADELAQKYAALCDVFVMDAFGTAHRAEGSTHGVAKYAKVAAAGPLLAAELEALGKALGAPAQPMAAIVAGSKVSTKLDVLNSLSAICDQLIVGGGIANTFLAAAGHKVGKSLYEPDLLDTARAIAAKVSVPLPTDVVVAKEFAESATATVKLIADVADDDMILDIGPQTAAHFAELLKSSGTILWNGPVGVFEFDQFGEGTKTLAKAIAESKAFSIAGGGDTLAAIDKYGVADQISYISTGGGAFLEFVEGKVLPAVEMLEQRARA

SEQ ID NO: 1263 - protein, 623 aa, Arabidopsis thaliana
MKLGLFTLSFLLILNLAMGRFVVEKNNLKVTSPDSIKGIYECAIGNFGVPQYGGTLVGTVVYPKSNQKACKSYSDFDISFKSKPGRLPTFVLIDRGDCYFTLKAWIAQQAGAAAILVADSKAEPLITMDTPEEDKSDADYLQNITIPSALITKTLGDSIKSALSGGDMVNMKLDWTESVPHPDERVEYELWTNSNDECGKKCDTQIEFLKNFKGAAQILEKGGHTQFTPHYITWYCPEAFTLSKQCKSQCINHGRYCAPDPEQDFTKGYDGKDVVVQNLRQACVYRVMNDTGKPWVWWDYVTDFAIRCPMKEKKYTKECADGIIKSLGIDLKKVDKCIGDPEADVENPVLKAEQESQIGKGSRGDVTILPTLVVNNRQYRGKLEKGAVLKAMCSGFQESTEPAICLTEDLETNECLENNGGCWQDKAANITACRDTFRGRLCECPTVQGVKFVGDGYTHCKASGALHCGINNGGCWRESRGGFTYSACVDDHSKDCKCPLGFKGDGVKNCEDVDECKEKTVCQCPECKCKNTWGSYECSCSNGLLYMREHDTCIGSGKVGTTKLSWSFLWILIIGVGVAGLSGYAVYKYRIRSYMDAEIRGIMAQYMPLESQPPNTSGHHMDI

SEQ ID NO: 1264 - protein, 267 aa, Desulfitobacterium hafniense
MKKISFIGAGNMAEAIIKGLMVTGSYEIRVTNRSNQAKLAQMKEDYGVIPVSFREAVKDSEIILLAVKPKDVGEALAQIREGISSNQLLISVAAGIPLALLEKHLPHCPIIRAMPNTSSAVLHSMTGLVKGQGVNEAKQRDVEDIFGAVGKYIWITEEQINPLIAMSGSGPAYFYLFTEALVKAGVDMGFSQEVAENLAKETLMGAAKMLAQSGKSPGELRVAVTSPKGTTQEALEVFREQGLEELVAQAAKACKHRAQAMEREYLG

SEQ ID NO: 1265 - protein, 437 aa, Desulfitobacterium hafniense
MEGFKIKSVKARQVFDSRANPTVEVDITLKDETVGRGIVPSGASTGLFEAVELRDGEETFDGKGVSKAIHHVNEQLAPLLLDIDVRDQKAIDSRLIEIDGTPNKSRLGANAILGCSMAACWAGANYYKVPLYRYLGGSAANKLPVPMVQIIGGGAHADNAIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEEKTLTKEEMVGMLSDWVDKYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVFAAAGIQFNQY

SEQ ID NO: 1266 - protein, 389 aa, Nostoc punctiforme PCC 73102
MKAVCWNGANDVRVQSVPDPTILNPRDAIIKITSTAICGSDLHIYGGYIPTVQQGDIIGHEFMGEVVEVGRGVNNLKIGDRVVVPSTIGCGNCHYCQHDMWSLCDNSNPKGWIEEKLFGNITSAIYGYSHMLGGYAGAQAEYIRVPFADVGVVKVPPDLPDEMLLFISDAIPTGYMGAELCDIQPGDTVAVWGCGAVGQFAMISAYMMGAEKVIAIDRFPERLEMAKKFAKAEVINYEEVNAGEALKEMTGGRGPDACIDAVGLEAHGVGLEDFYDQTKQKLRLETDRPHVLREMMVACRKGGTLSIMGVYGGFVDKIPFGAAFNKGLTFRMGQMHGQKYMHLLLQMILDGKLDPSFVVTHQLPLEQAPHAYHIFQQKKDNCIKVVLKP

SEQ ID NO: 1267 - protein, 279 aa, Pseudomonas syringae pv. tomato str. DC3000
MIKKCLFPAAGYGTRFLPATKAMPKEMLPVVNKPLIQYGVEEALAAGLTEISIVTGRGKRSLEDHFDISYELEHQIKGTDKEKYLVGIRKLIDECSFSYTRQTEMKGLGHAILSGRPLIGNEAFAVVLADDLCVNLEGDGVLAQMVKLHKHYGCSIIAIQEVDPSETNKYGVIAGEEIKPGLFRVTDMVEKPKPEDAPSNLAIIGRYILTPDIFEKIEQTEPGKGGEIQITDALMKQAAEGNVLAYKFKGTRFDCGGAEGYIEATNFCFEHFYKAGKAH

SEQ ID NO: 1268 - protein, 365 aa, Cupriavidus metallidurans
MKAAVMEKAGAPLVIHDVAIAEPGPREVRVRTAAVGLCHSDLHMMQGTYPLPLPAVLGHEVSGVVEAVGTQVSGLKAGDHVVGCLSVYCGHCSVCASGHQVLCQNPEVKLPPGKANRLRLAGNPLSQVFNLSGFAEEILVHENALVKIRDDMPLDRAALLGCAVITGTGAVFHSAKVPPGSTVVVVGCGGVGLSVINGAVIAGASRVIAVDMLPAKLELARKFGATDVVNAGDGDPVAQVMQLTGGGAEFAFECIGLKQTAEQCYAMLAPGGTATVIGLFRPDARIELPALDFLKEKRIQGSFMGSNRLSLDIPRLVELYMQGKLLLDDLISQRISLEDINEGFIAMQSGSVARSVITFPGVGGL

SEQ ID NO: 1269 - protein, 511 aa, Bacillus subtilis subsp. subtilis str. 168
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFVIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAILAKGGHAIITADHGNADILITESGEPHTAHTTNPVPVIVTKEGITLREGGILGDLAPTLLDLLGVEKPKEMTGTSLIQK

SEQ ID NO: 1270 - protein, 394 aa, Bacillus subtilis subsp. subtilis str. 168
MDKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 1271 - protein, 588 aa, Saccharomyces cerevisiae
MASSMLSSATMVASPAQATMVAPFNGLKSSAAFPATRKANNDITSITSNGGRVNCMQVWPPIGKKKFETLSYLPDLTDSGGRVNCMQAMARLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 1272 - protein, 410 aa, Sinorhizobium meliloti
MAINATVKEAGFQPASRISSIGVSEILKIGARAAAMKREGKPVIILGAGEPDFDTPEHVKQAASDAIHRGETKYTALDGTPELKKAIREKFQRENGLAYELDEITVATGAKQILFNAMMASLDPGDEVIIPTPYWTSYSDIVHICEGKPVLIACDASSGFRLTAEKLEAAITPRTRWVLLNSPSNPSGAAYSAADYRPLLEVLLRHPHVWLLVDDMYEHIVYDGFRFVTPAQLEPGLKNRTLTVNGVSKAYAMTGWRIGYAGGPRELIKAMAVVQSQATSCPSSISQAASVAALNGPQDFLKERTESFQRRRDLVVNGLNAIDGLDCRVPEGAFYTFSGCAGVLGKVTPSGKRIKTDTDFCAYLLEDAHVAVVPGSAFGLSPFFRISYATSEAELKEALERIAAACDRLS

SEQ ID NO: 1273 - protein, 366 aa, Bacillus halodurans
MKIQAAVLHNKGEPFSIEEVELAEPKADEILVKIVASGVCHTDAVAREQLIPIPLPAVLGHEGSGVVEAVGTHVTSVKPGDHVVLTFTTCGECENCQSGHPSFCTEFAPLNFFGKMSDRTNRIQQNGKDVSTFFGQASFGTYAIANARNVVKVDPDVDLALLGPLACGIQTGAGTVLNKLRPEFGSSVAIFGCGAVGLSAVMAAKIVGCQKIIAIDIHDSRLALAKELGATHVFNGNDSRLVEAIQAVTNGGTNYAVETTGISHVFHQSIKALTTLGVVAVVGVGGDVTVNMNDDILSQGKTITGVIEGDVVPQLFIPKLIDYYKAGHFPFDRLVKLYELDEINQAFEDSKNGSAVKPIIKMNHHI

SEQ ID NO: 1274 - protein, 445 aa, Bacillus halodurans
MAKDESYLIKPLLDRNYPCVSYGKGAALYDMDGKRYLDACSGAVTASIGHGVDEVVQAMYEQARKVSFVYRSQFTNEPAERLAMKLAEQLPGQLNHSFFVNSGSEATETAIKISIQYWQERGRPEKTLILSRWMSYHGITQGALSLSGHYERRQRFEGMLDRLPFLSPPYPYRQVREMSGVDYAEELDHLIEQIGPHRIAAFIAEPIVGAAGTALVPGEWYYEALKQVLDQHDILFICDEVMTGMGRTGKDLAIEHWDATPDIVTLGKGLSAGYAPLAATVVADHVLEPIQAGSNLIMSGHTFSANPLSCAAGLAVLHYVKKHDLVKRAATIGEKLIEDLQEIQTASAIVGDVRGKGLLIGLEFVKNKATKAPFPKDAQVAAVIVNEAQRQGLLLYPSAAGLKGEGAGCLIAPPFTLTKEERCELLGKLARTLERVEKQLLGAEK

SEQ ID NO: 1275 - protein, 317 aa, Bacillus halodurans
MDVVTFGETMVVFEPVEMGALRYVDRFKKGVGGAESNVAIGVAKLGHSVGWVSKVGNDELGKYVISAIRGEGVDTSQVVLDDGAPTGLYLKEKLRDDFNRVYYYRAGSAASRLGVEDINWAYMKQAKIIHITGITPLLSDSCYELCHAVLDFAKENGIFASFDPNLRMKLLANVPDGKERLLALASKADLVMPGRDEAAFLFDTDELAQMFSRLLTGRTTSVVIKDGAKGAHFMEEGKEPQFVPSCPVDKVVDPVGAGDGFAAGVLASLLEGKSMEEAVSVGTQIGALVVMAKGDMEGLPEREQLEAFSQARSDVLR

SEQ ID NO: 1276 - protein, 302 aa, Escherichia coli K12
MAAINTKVKKAVIPVAGLGTRMLPATKAIPKEMLPLVDKPLIQYVVNECIAAGITEIVLVTHSSKNSIENHFDTSFELEAMLEKRVKRQLLDEVQSICPPHVTIMQVRQGLAKGLGHAVLCAHPVVGDEPVAVILPDVILDEYESDLSQDNLAEMIRRFDETGHSQIMVEPVADVTAYGVVDCKGVELAPGESVPMVGVVEKPKADVAPSNLAIVGRYVLSADIWPLLAKTPPGAGDEIQLTDAIDMLIEKETVEAYHMKGKSHDCGNKLGYMQAFVEYGIRHNTLGTEFKAWLEEEMGIKK

SEQ ID NO: 1277 - protein, 141 aa, Pseudomonas putida
MAVQRTFSIIKPDAVAKNVIGKITTRFEEAGLKIVASKMKQLSKAEAEGFYAEHSERGFFGDLVAFMTSGPVVVQVLEGENAIAKNRELMGATNPKEAAAGTIRADFAESIDANAVHGSDSEAAAAREIAYFFAATEVTTR

SEQ ID NO: 1278 - protein, 312 aa, Pseudomonas syringae pv. tomato str. DC3000
MFLVCGEALFDIFTRADDGGSLNRLGFDAIAGGSPFNVAIGLRRLGVEAAFFAGLSTDYLGRRLRAVLEQETVNAEHLIEFDAPTTLAMVAVGSDGSPTYSFRGDGCADRQLRLEHLPELDERVRGIHVGSFSLVVQPIADTLLALVARESARRLISLDPNVRLNPAPDIQRWRTQIAAFAEHAHLIKVSDEDLHLLYPDSDPQQIAEGWLGKRTQLVIVTRGTQGASVFTRQHGTWSVPAKTVVTADTVGAGDTFQAALLTFLSERQLDTPQGLSTLSRETLDEMLNFAVGAAALTCTKVGPDLPYRHQLG

SEQ ID NO: 1279 - protein, 603 aa, Saccharomyces cerevisiae
MPRNPLKKEYWADVVDGFKPATSPAFENEKESTTFVTELTSKTDSAFPLSSKDSPGINQTTNDITSSDRFRRNEDTEQEDINNTNLSKDLSVRHLLTLAVGGAIGTGLYVNTGAALSTGGPASLVIDWVIISTCLFTVINSLGELSAAFPVVGGFNVYSMRFIEPSFAFAVNLNYLAQWLVLLPLELVAASITIKYWNDKINSDAWVAIFYATIALANMLDVKSFGETEFVLSMIKILSIIGFTILGIVLSCGGGPHGGYIGGKYWHDPGAFVGHSSGTQFKGLCSVFVTAAFSYSGIEMTAVSAAESKNPRETIPKAAKRTFWLITASYVTILTLIGCLVPSNDPRLLNGSSSVDAASSPLVIAIENGGIKGLPSLMNAIILIAVVSVANSAVYACSRCMVAMAHIGNLPKFLNRVDKRGRPMNAILLTLFFGLLSFVAASDKQAEVFTWLSALSGLSTIFCWMAINLSHIRFRQAMKVQERSLDELPFISQTGVKGSWYGFIVLFLVLIASFWTSLFPLGGSGASAESFFEGYLSFPILIVCYVGHKLYTRNWTLMVKLEDMDLDTGRKQVDLTLRREEMRIERETLAKRSFVTRFLHFWC

SEQ ID NO: 1280 - protein, 463 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMEKQRMLVLFTALLFVFTGCSHSPETKESPKEKAQTQKVSSASASEKKDLPNIRILATGGTIAGADQSKTSTTEYKAGVVGVESLIEAVPEMKDIANVSGEQIVNVGSTNIDNKILLKLAKRINHLLASDDVDGIVVTHGTDTLEETAYFLNLTVKSDKPVVIVGSMRPSTAISADGPSNLYNAVKVAGAPEAKGKGTLVVLNDRIASARYVTKTNTTTTDTFKSEEMGFVGTIADDIYFNNEITRKHTKDTDFSVSNLDELPQVDIIYGYQNDGSYLFDAAVKAGAKGIVFAGSGNGSLSDAAEKGADSAVKKGVTVVRSTRTGNGVVTPNQDYAEKDLLASNSLNPQKARMLLMLALTKTNDPQKIQAYFNEY

SEQ ID NO: 1281 - protein, 468 aa, Bacillus subtilis subsp. subtilis str. 168
MFNSIGVIGLGVMGSNIALNMANKGENVAVYNYTRDLTDQLIQKLDGQSLSPYYELEDFVQSLEKPRKIFLMVTAGKPVDSVIQSLKPLLEEGDVIMDGGNSHYEDTERRYDELKEKGIGYLGVGISGGEVGALTGPSIMPGGDRDVYEKAAPILTKIAAQVGDDPCCVYIGPKGAGHFTKMVHNGIEYADMQLIAEAYTFLRETLRLPLDEIASIFETWNQGELKSYLIEITAEILRKKDEKTGQPLIDVILDKTGQKGTGKWTSMQAIDNGIPSTIITESLFARYLSSLKEERMAAQDVLAGPEAEEKHLDKDTWIEYVRQALYMGKVCAYAQGFAQYKMSSELYGWNLPLKDIALIFRGGCIIRADFLNVISEAFSEQPNLANLLIAPYFTDKLHAYQTGLRKVVCEGISTGISFPCLTTALSYYDGYRTGRSNANLLQAQRDYFGAHTYERTDMDGVFHTNWSE

SEQ ID NO: 1282 - protein, 483 aa, Pseudomonas syringae pv. tomato str. DC3000
MTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTAHELHCTVLIGGPLSDHKGINRRGGGLTAPALTEKDKQDIKLAAEMDLDYLAVSFPRDAADMEYARQLRDESGGTAWLVAKIERAEAVANDEVLDALIRASDAVMVARGDLGVEIGDAELVGVQKRIILHARRHNKAVIVATQMMESMISSPMPTRAEVSDVANAVLDYTDAVMLSAESAAGSYPVEAVQAMARICVGAEKHPTGKTSSHRIGHSFTRCDESIALAAMYTANHFPGVKAIIALTESGYTPLIMSRIRSSVPIYAFSPHRGTQARAAMFRGVYTVPFDPGALPPGQVSQAAVDELLKRGLVEQGDWVILTKGDSYHTIGGTNGMKILHVGDPLV

SEQ ID NO: 1283 - protein, 500 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMTDTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 1284 - protein, 516 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMGMNSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYASSPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFDEAKQ

SEQ ID NO: 1285 - protein, 486 aa, Desulfitobacterium hafniense
MASSMLSSATMVASPAQATMVAPFNGLKSSAAFPATRKANNDITSITSNGGRVNCMQVWPPIGKKKFETLSYLPDLTDSGGRVNCMQAMRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSCHKQKHAEVTLSAIAVPWEEASRFGVMVTDAGGRIIRFEEKPPRPESNLASMGVYIFNWDVLKEALLEDERDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 1286 - protein, 573 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMEAIYTRQFLAGEWIEGASTQTITNYNPYTGEKIHEIKGASLDDLDQAYRAAKNAQKEWEQTLPAQKQEVLEKAAALLAERKDEVIERLVNEAGSSIIKASIEWGATLQTIKVAATFPLRMEGKILPSNIPGKENRIYRSAKGVIGVISPFNFPLVLAMRSVAPALATGNAVVLKCSSDAPITSGLLIAELFEEAGLPKGVLNVVVGKAAEIGDAFVTHPIPKLISFTGSTEVGRHIAQLAARELKETALELGGNNVMIVLDDADIEKAAEKAAVGKFLHQGQICMALNRIIVDASIYDSFVEVFKEKVSQLQTGNPAEPATLIGPLINYKQIGRIQQLVKESVAQGAVKVLEGHVQGNLMSPTILSEVTNDMPVAKEEIFGPIAPIIKAKDEAEAIAIANDSPYGLSGSIFTGSLHRGVQVAKQIDTGMIHVNDQPVNEEAHISFGGEKDSGIGRFGGEWVLDKFTTVKWISIQEKERVYPFWG

SEQ ID NO: 1287 - protein, 584 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMGIVGHFINGKVTDIHSRLQDIYNPATGEVSRQVAIASKATAEEAIAAAQAAFPEWRDTPPIKRARIMFRYKQLLEEHADEICRLIGQEHGKIIHDAAGELQRGIENVEYACGAPEILKGEFSKNVGPGINSWSDFQPLGVVAGITPFNFPAMVPLWMYPLALVCGNTFVLKPSERDPSAPLYIGQLLKKAGLPDGVFNIVNGDKEVVDTLLTDKRVKAVSFVGSTPVARYIYTTATANGKRCQALGGAKNHAIVMPDADMENVVNSLLGAAFGSSGERCMALSVAVAIGDEIADQLVTQLQERMKSLTIGVHSDKNNDFGPVITREHQQKVCGYITSAEQQGAKILVDGRNMKVSGYENGFFVGATLIDDVTTDMDSYKAEIFGPVLQVVRVKTMQEAMDIIDEHEYGNGTCIYTRDGEAANYFADRIQVGMVGINIPLPVPVSYHSFGGWKNSLFGDLYAYGPDGVRFYTRRKTITQRWPSANLREGAEFSMPT

SEQ ID NO: 1288 - protein, 572 aa, Arabidopsis thaliana
MSLVRTVTIVLFIIAFLQNAAAQKRQQSIVKSRGAVATDDGRCSVIGMRVLREGGNAIDASVAAALCLGVVSPASSGIGGGAFTVVKIAGGKEIAYDSRETAPLRATENMYGGNVDLKKKGALSVGVPGEVAGLFTAWKQHGKLPWKRLVTPAEKLAEGFKISKYLYMQMNATRSDILADKGLSDLFVSNGELKKPGTICHNPKLALTLKLIGEYGPKAFYNGTVGVNLARDIKKSGGIITLKDLQSYRVKIKEPLSADILGYRVLGMPPPSSGGAAMMLVLNILSQYGIPSGVSGPLGVHRLIEALKHAFAVRMNLGDPDFTDVTKVVSDMLSPKFAKDLKSKINDQKTFDPKYYGGMWNQIDDHGTSHLSIIDRERNAVSMTSTINGYFGALMLSPSTGIVLNNEMDDFSIPTKSNGNLDVPPPAPANFIRPGKRPLSSMSPTIVLKDGKVKAAVGASGGANIIAGTTEVYLNHFFLKMDPLSSVLAPRIYHQLIPNRASYENWTTVFNDHFEIPKATRVVLEKKGHVLSPIAGGTIAQFIVQESGENSGGRSELVAVSDPRKGGFPSGY

SEQ ID NO: 1289 - protein, 569 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMAENYDVIVVGSGPGGYVTAIRSAQLGLKTAIVEREHLGGICLNWGCIPTKALLRSAEILDHANHAKNYGLTLEGKITANVKDVVARSRGVSARLNGGVAFLMKKNKVDVIWGEAKLTKPGEIVVGAPSKPAVQPQNPVPKGVKGEGTYTAKHIIVATGARPRALPGIEPDGKLIWTYFEAMKPEEFPKSLLVMGSGAIGIEFASFYRSMGVDVTVVELLPQIMPVEDAEISAFARKQLEKRGLKIITDAKVTKVEKGANDVTAHVETKDGKVTPIKADRLISAVGVQGNIENLGLEALGVKTDRGCIVTDGYGKTNVAGIYAIGDVAGPPMLAHKAEHEGVICVEKIAGVPGVHALDKGKIPGCTYCDPQVASVGLTEAKAKELGRDIRVGRYSFGANGKAIALGEDQGLIKTIFDKKTGELIGAHMVGAEVTELIQGFVVAMNLETTEEELMHTVFPHPTLSEMMKESVLDAYGRVLNA

SEQ ID NO: 1290 - protein, 538 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMGKHYDYIAIGGGSGGIASMNRAAMYGQKCALIEAKALGGTCVNVGCVPKKVMWHAAQIAESIHQYGPDYGFDTTVNRFDWKTLIASRTAYIDRTHQSYERVLGNNKVDVIHGFARFVDAHTVEVNGEKITANHILIATGGRPVCPTIPGAEYGIDSDGFFELDEMPKRVAVVGAGYIAVEIAGVLKALGSETHLFVRKHAPLRSFDPLIVETLLEVIKNEGPTLHTEAILKAVIKHADGSLTLQLQDGREQTVDTLIWAIGREPMTDNLNLAVTGVELNEKGYIQVDKYQNTNVKGVYAVGDNTGAVELTPVAIAAGRRLSERLFNNKPEEHLDYTNVPTVVFSHPPIGTVGLTEPQAREQYGDDQVKVYTSSFTAMYTAVTQHRQPCRMKLVCTGADEKIVGIHGIGFGMDEILQGFAVALKMGATKKDFDNTVAIHPTAAEEFVTMR

SEQ ID NO: 1291 - protein, 546 aa, Nostoc punctiforme PCC 73102
MASSMLSSATMVASPAQATMVAPFNGLKSSAAFPATRKANNDITSITSNGGRVNCMQVWPPIGKKKFETLSYLPDLTDSGGRVNCMQAMETADVIVIGSGQGGIPLAADFASSGRNVVLFERDALGGSCINYGCTPSKAFLASAHAAGRARQATKLGIHAQVEVDFSAVMERVRSIRSQFNQGVKRRLDSAGVRVVCAEAAFTGERTVSGGGVTVQAPLIVINTGTSSTIPDFSGLVGTPYLTNRNFFDLQQIPPRLLVVGGGYIALELGQGMARLGSQTELIVRGERLLAQEESDVSAVLADAFEQDGIGLHFNVTVQQVAYTNRVFTLTLNNGEVLDGEALLIATGRKPNTQALNSAVTGVELDAQGFIKIDEQFQTTCAGIYAIGDAAKQPAFTHVSWEDYRRLKAILCGEHRTRNDRVLGYAVYTEPQVGRVGMTLEQAHKQGITASEVTLPMAHIARSIEWGHDLGFYRMVIDTQTNLILGATLVGYETAELVHVFLSLMEAKATWQVLEQSVHIHPTYGEALPSLARLLVGDDMPTCPNM

SEQ ID NO: 1292 - protein, 255 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMIIQPIYLPHLLKQPRCTQVLAIDQAIADLKTLTPVRGEVSVRHGGTFLEVKAEAETIVTLHCDRCAQSYNQRLALDTKEILWLDNQGENTIPVLERELSWDDLSEVLPPDGHFDVETWLYEQFNLALPLKNLCGKDCQAPQVPDDGTGNGFDRRWAALADLKQQWN

SEQ ID NO: 1293 - protein, 637 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMTLISLTPHHGIDPGSGRKNTPMGLLETQVHHLLKAQQRQQTIPPWPHSLTMGRLVSRALRLRRSALIQTGCLPPTYGPSYLLPCLLSDQPIRLVTTPKRKQDLETAILPALQMALQSNDPDLVITWPEIVTPDQWLQENLGPLPHIAPALTAIEQVEHLEDWTRDFLSHHLDWNTLQPLFAQTPQGQDQVLTHWSRLSQSLFARPINPHGFYPLDGEELKELNQAVTEQLTISQGENAIKQENIQKIQQFWQFWQEQTDNHLLWAEVDRQQGRISLHVSPVNVQPWLQPIWQSSDQGQGDFIDGGQDSDQAAFVLIGSFLDAEKTAPTYCKTLGLGNLLCLKFSPHRLQDALTIYLPDRLPLPNTPAFQTTLLTEIERILTEIMAVQPDTFVVILLDDLPLKAQLGSQLAAKLGSGVKVEPTPNFAPGILVAGWQYWCAQREKFPPPALLILGTLPIPSLENPLVAKRVQHHKRHHQDWFRDYLLPVALKDLQQAVLPLRESGGWLAILDDRVNSRSYGREVLKALAPYGKRNYFDPQDLPQVTTAQK

SEQ ID NO: 1294 - protein, 577 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMKSPQAQQILDQARRLLYEKAMVKINGQYVGTVAAIPQSDHHDLNYTEVFIRDNVPVMIFLLLQNETEIVQNFLEICLTLQSKGFPTYGIFPTSFVETENHELKADYGQRAIGRVCSVDASLWWPILAYYYVQRTGNEAWARQTHVQLGLQKFLNLILHPVFRDAPTLFVPDGAFMIDRPMDVWGAPLEIQTLLYGALKSAAGLLLIDLKAKGYCSNKDHPFDSFTMEQSHQFNLSVDWLKKLRTYLLKHYWINCNIVQALRRRPTEQYGEEASNEHNVHTETIPNWLQDWLGDRGGYLIGNIRTGRPDFRFFSLGNCLGAIFDVTSLAQQRSFFRLVLNNQRELCAQMPLRICHPPLKDDDWRSKTGFDRKNLPWCYHNAGHWPCLFWFLVVAVLRHSCHSNYGTVEYAEMGNLIRNNYEVLLRRLPKHKWAEYFDGPTGFWVGQQSRSYQTWTIVGLLLVHHFTEVNPDDALMFDLPSLKSLHQALH

SEQ ID NO: 1295 - protein, 513 aa, Agrobacterium tumefaciens
MASSMLSSATMVASPAQATMVAPFNGLKSSAAFPATRKANNDITSITSNGGRVNCMQVWPPIGKKKFETLSYLPDLTDSGGRVNCMQAMAEFVITMPDVGEGVAEAELVEWNVKPGDIVHEDMVLAAVMTDKATVEIPSPVAGIITWLAVTVGNTVPVKAPLVRIETDVAAAAPNGSAPEAEAPSRMTEEEAPADMTEAPPPVETQPAARQTEEAPSAPVAEPHHKPLASPAVRQRADDLDIDLIKVKGTGPDGHITHADLDGFLTVRARPERPEPMTPHDSAVEEVKVTGLRRKIAEKMVLSVSRIPHITYVEEIDVTELEDLRATMNGNRRSGQPKLTILPFLMRALVKAVADHPGMNAIFDDEKGVVSHYEAVHIGIATQTPAGLTVPVVRHAETLGLWDCAEEVARVAEAARTGTAHREELMGSTITISSLGALGGVVSTPIINHPEVAIIGVNKIMTRPVWDGNRFVPRKMMNLSSSFDHRVVDGWDAAVFIQAVKALLEKPALIFIE

SEQ ID NO: 1296 - protein, 563 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMVSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 1297 - protein, 312 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMEKDFLIAPSILSADFARLGEDTAKVLAAGADVVHFDVMDNHYVPNLTIGPMVCQALRDYGITAPIDVHLMVKPVDRIIPDFAKAGATYITFHPEASEHVDRTLQLIKEHGCKAGLVFNPATPLSYLDYVLDKLDVILLMSVNPGFSGQSFIPETLNKLRQVRKIIDDSGYDIRLEVDGGIKANNIREAAQAGADMFVAGSAIFSQPDYKTVIDEMRRELSKVA

SEQ ID NO: 1298 - protein, 148 aa, Arabidopsis thaliana
MASTALSSAIVGTSFIRRSPAPISLRSLPSANTQSLFGLKSGTARGGRVTAMATYKVKFITPEGELEVECDDDVYVLDAAEEAGIDLPYSCRAGSCSSCAGKVVSGSVDQSDQSFLDDEQIGEGFVLTCAAYPTSDVTIETHKEEDIV

SEQ ID NO: 1299 - protein, 673 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMGKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 1300 - protein, 431 aa, Rhodopseudomonas palustris
MASSMLSSATMVASPAQATMVAPFNGLKSSAAFPATRKANNDITSITSNGGRVNCMQVWPPIGKKKFETLSYLPDLTDSGGRVNCMQAMDQGQTLSVLLDSYAVDPQKKAVAAAVGAIAAGSIEISELIGQGALAGITGAAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFRV

SEQ ID NO: 1301 - protein, 429 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMSERLEDIAVAMVANGRGLLAADESTATIKKRFDSIGLESTETSRRDYREMLLRSDDAMREYISGVILYEETLFQKAADGTPLADVIRNAGSIPGIKVDTGAKPMAHFPNETITEGLDGLAARLARYHEAGARFAKWRGVIAISDALPTWGAIRANAHALARYAALCQEAKIVPIVEPEVLMDGAPGDHSIERSEEVTEWVLRTVFEELGELRVRLEGMILKPSMVIDGKKARKASVDEVAERTIKVLKRTVPAAVPGIAFLSGGQSTEEATAHLSAMNAAHDLPWKLTFSYGRALQQEALNAWGGKSENVAAGQRAFAHRAKMCSLAAKGSWTKDFEKAA

SEQ ID NO: 1302 - protein, 560 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMGQNVYQFIDLQRVDPPKKPLKIRKIEFVEIYEPFSEMQVEAQADRCLSCGNPYCEWKCPVHNYIPNWLKLANEGRIIEAAELSHRTNSLPEVCGRVCPQDRLCEGACTLNDDFGAVTIGNIERYINDTAIAMGWKPDMSDVIPTGKRVAVIGAGPAGLACADVLTRNGVQAVVYDRHPEIGGLLTFGIPAFKLEKDVMIRRREIFSDMGIEFRLNTEIGKDITLAELTEQFDAVFLGVGTYQSIHGGLENEGADGVYDALPFLIANTRHLMGYPALPEQPYVDMKGQRVLVLGGGDTAMDCLRTSVRQGATHVICAYRRDEGNMPGSRREVKNAKEEGVDFQFNLQPLSIEINSAGQVCGVKVAKTQLGEMDEKGRRRAEIIQGSEFRIETDAVITAFGFKPHNLHWLNAHQINLDQQGRIVAPEASNLPFQTSNPKIFAGGDAVRGSDLVVTAIAEGRKAASGILDYLEV

SEQ ID NO: 1303 - protein, 478 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMVIQENPFSSRIANRAKNINASVAVGLADIVAKLKSEGRDIIGLNEGELDFSTGATIVNETLRALIDGRTRYSWLNGEPELREKICQKVFEDNRIKATPENVIVTNGSKQVIYEILQTVINPGDEVIIPVPCWATYLEAVKLAGGKAVLIENIGVDLDVEKIKQAITDNTKLIIINTPNNPTGAVYSKSALQTLCQIVKEKQIFVLSDEAYEQIVFDDEHHSLAAIDDNEYIITVQTFSKSFAMTGYRIGYMIAHPELICRVSDLHGHMTDNVCTFAQYGAIASLEKPKDLYQERLEILKKRRDRSYQYAREFFECELPAGAFYLFPNVEKYLNDRCRDATQFCEYLLTHAGVALIPAEACLYRGHVRISFAASMDAIEQGFERIANVLR

SEQ ID NO: 1304 - protein, 118 aa, Arabidopsis thaliana
MEETLATPDATRRSLSPSCSATVKSRAAGFERRTKRRLSETNASVREDREEAEEEEDEVKEKIEALQRIIPGGAALGVDALFEETAGYILSLQCQIKTIKVLTSFLQRIDQEDMKFGG

SEQ ID NO: 1305 - protein, 507 aa, Arabidopsis thaliana
MSYLLRRNKFVALLKRQSLIFPITSTEAKTLINPDPNIPQFQNPCSIFRIAHYATQSSKFPEYEMPTVTWGVIQGKKEKLVNRVKICDYLKGLGIITDELESIELPSTIEVMCERVEFLQKLGLTIDDINEYPLMLGCSVRKNLIPVLAYLEKIGISRSKLGEFVKNYPQVLHASVVVELAPVVKFLRGLDVEKQDLGYVLMKYPELLGFKLEGTMSTSVAYLVSIGVSPRDIGPMVTQYPYLLGMRVGTMIKPLVDYLISIGLPKKIVARMLEKRSYIVGYNLEETVKPNVDCLISFGVKKELLPLLIAQYPQILGLPVKAKMSTQQYFFSLKLKIDPEGFARVVEKMPQIVSLKQNVIMKPIEFLLGRAFQVEDIAKMVVRCPQILCSRVELMKNSYYFYKTEMGRPMKELVEYPEYFTYSLESRIKPRYQKLQSKGIRSSLNWFLNCSDQRFEERLQGNFIDPDTEGPTFDMGGKLEMPGGEIVTDEEEDESDDEVLYRRTLTL

SEQ ID NO: 1306 - protein, 586 aa, Arabidopsis thaliana
MDVMKLDHDSVLKELERITSKAAEVQDNILRGILERNKDTEYLSKYMNGSKDVLEFKRAVPIIIYKDIYPYIQRIANGEDSSLITGHSITEILCSSGTSAGEPKLMPTIPEDLDRRTFLYNLIIPIVNKYITGLDKGKAMYLNFVKAETSTPCGLPIRAVLTSYYKSKHFQCRPYDPFNDLTSPIQTILCEDSNQSMYCQLLAGLIHRHKVMRLGAVFASAFLRAISYLEKKWSQLCEDIRTGSLNPMITDPGCQMAMSCLLMSPNPELASEIEEICGRSSWKGILCQLWPKAKFIEAVVTGSMAQYIPALEFFSQGKIPLVCPMYASSETYFGVNVEPLSKPSDVVFTLLPNMCYFEFIPLGKNGTLSFDLDDDEQVPCDKVVDLVNVKLGRYYELVVTTFAAGLYRYRIGDVLQVAGFYNGAPQFRFICRRNVVLSIDLDKTNEEDLHRSITLAKKKLGSNAFLAEYTSYADTSSVPGHYVLFWEIQGHLEPKLMEECCVAVEEELDYIYRQCRTKERSIGALEIRVVKPGTFEKLMDLIISQGGSFNQYKTPRCVKSNSATFKLLNGHVMASFFSPRDPTWVP

SEQ ID NO: 1307 - protein, 117 aa, Arabidopsis thaliana
MAEVHNQLEIKFRLTDGSDIGPKAFPDATTVSALKETVISEWPREKENGPKTVKEVKLISAGKVLENSKTVKDYRSPVSNLAGAVTTMHVIIQAPVTEKEKKPKGDPKMNKCVCSVM

SEQ ID NO: 1308 - protein, 110 aa, Arabidopsis thaliana
MESNRGQGSIQQLLAAEVEAQHIVNAARTAKMARLKQAKEEAEKEIAEYKAQTEQDFQRKLEETSGDSGANVKRLEQETDTKIEQLKNEASRISKDVVEMLLKHVTTVKN

SEQ ID NO: 1309 - protein, 123 aa, Arabidopsis thaliana
  misc_feature (64)..(64): Xaa can be any naturally occurring amino acid
  misc_feature (75)..(75): Xaa can be any naturally occurring amino acid
METQKTQAENPPKPATSSCRKKTKDDANFLEDVKDHIDDFINASMDDHKNCFNKTIKKVCLSSXFTKHVIDLDHXATTCDFANSKLFCLFQMFGLSKAVADKQQSEAKGGVESYLPLQTTVSD

SEQ ID NO: 1310 - protein, 77 aa, Arabidopsis thaliana
MNTIESFIVSLYLLFVCSDIPMTQFIVNMNNSMPPSQKFIIHVLDSTHLFVQPHVEQMIRSAISDFRDQNSYEKPTS

SEQ ID NO: 1311 - protein, 460 aa, Arabidopsis thaliana
MMPKAAWEPEYHRVFVDLCVEQKMLGNQPGTQHILKPFLQRTGARFTRNQLKNHWDTMIKQWKIWCRLVQCSDMQWDPQTNTFGANDQDWANYLHVNPEAGQYRLNPPSFLEKLELIFEDSNLDDEGTSGSKRKRIAKHRDEDNDNTGDEEDTQSASNFSSPQSKGYWSPSSHELFVDLLFQEALKGNRPDSHYPKETWKMILETINQNTGKSFTRPQLKNHWDCTRKSWKIWCQVIGAPVMKWDATSRTFGATDEDWKNYLKENHRAAPFRRKQLPHADKLATIFKGLIEPGKAYFRSYRRRVLDHHSESPQLHDPTPLSTLYTNEPVSGSEGGADEDDNDDDDEQPTPQHRRFNSVGFAESRLQDVEIVTPGCHRLKTELMKESPVSASVRQYEYTIGECIECLDSMEEVEQGSDLYLFALDLFVKKEYREIFLLLKNSSLRMSWLLRLRSGGLTIAA

SEQ ID NO: 1312 - protein, 234 aa, Arabidopsis thaliana
  misc_feature (154)..(154): Xaa can be any naturally occurring amino acid
MGMSLDFDVDLEKGIIDCDNVYTKSPEKPMSPDNKPVITGEESVGSLENDTSPVQCGINKPGWGRSDRKEKRKKSASKPPRPPRGPSLDAADQKLIREIAELAMLKRARIERMRALKKSRAAKAASAASSLGNVLATLFTAIFFFVLVFQGMIXFHDCVCVLVILPVLVKSYVCVFYWIFSGLSPRAAGSSGKSHLVVAGKANGGFVSVQYAGNPSASEPDGGYTGPVLAQRPK

SEQ ID NO: 1313 - protein, 485 aa, Arabidopsis thaliana
MEKKQGFFSALRHEVVRGLSPSRSRARSRSVSPARSSSPMSALTWGRKNLTGGGGGGGGGGYYLAQPEQLIGRSGSLRPVMEGPDPDEGGGGGNIGESKRLGSGLGHWVKGQLSRAPSVAATAAYRRNDLRLLLGVMGAPLAPIHVSSSDPLPHLSIKNTPIETSSAQYILQQYTAASGGQKLQNSIKNAYAMGKLKMITSELETATRTVRNRNPSKAETGGFVLWQMNPDMWYVELAVGGSKVRAGCNGKLVWRHTPWLGSHTAKGPVRPLRRGLQGLDPRTTAAMFAEAKCIGEKKVNGEDCFILKLCTDPETLKARSEGPAEIIRHVLFGYFSQKTGLLVHIEDSHLTRIQSNGGETVFWETTYNSSLDDYRQVEGIMIAHSGHSVVTLFRFGEVATSHTRTKMEESWTIEEVAFNVPGLSLDCFIPPADLKTGSLTESCEYPQEERGKNNTLALSAAHRAKVAALENGSLEDHRPVWHTDV

SEQ ID NO: 1314 - protein, 279 aa, Arabidopsis thaliana
MPPKRNFRKRSFEEEEEDNDVNKAAISEEEEKRRLALEEVKFLQKLRERKLGIPALSSTAQSSIGKVKPVEKTETEGEKEELVLQDTFAQETAVLIEDPNMVKYIEQELAKKRGRNIDDAEEVENELKRVEDELYKIPDHLKVKKRSSEESSTQWTTGIAEVQLPIEYKLKNIEETEAAKKLLQERRLMGRPKSEFSIPSSYSADYFQRGKDYAEKLRREHPELYKDRGGPQADGEAAKPSTSSSTNNNADSGKSRQAATDQIMLERFRKRERNRVMRR

SEQ ID NO: 1315 - protein, 345 aa, Arabidopsis thaliana
MLQKISQSISLCNGDQFKPLIYLAGAPTNFISSPLSGCKKKSSSLRIKRIQQLQSTLEDRINPPLVCGTVSPRLSVPDHILKPLYVESSKVPEISSELQIPDSIGIVKMKKACELAARVLDYAGTLVRPFVTTDEIDKAVHQMVIEFGAYPSPLGYGGFPKSVCTSVNECMFHGIPDSRPLQNGDIINIDVAVYLDGYHGDTSKTFLCGDVNGSLKQLVKVTEECLEKGISVCKDGASFKQIGKIISEHAAKYGYNMERFIGHGVGTVLHSEPLIYLHSNYDYELEYMIEGQTFTLEPILTIGTTEFVTWPDKWTIVTADGGPAAQFEHTILITTTGAEILTISS

SEQ ID NO: 1316 - protein, 242 aa, Arabidopsis thaliana
MALPSCLKTGALMSPATGFNFSGSLMKSDSGFAVPTKLQSTRKGDRERLRVQAIFSFPPAFLTRNGRAEKQKQLKQELLEAIEPLERGATASPDDQLRIDQLARKVEAVNPTKEPLKSDLVNGKWELIYTTSASILQAKKPRFLRSITNYQSINVDTLKVQNMETWPFYNSVTGDIKPLNSKKVAVKLQVFKILGFIPIKAPDSARGELEITYVDEELRLSRGDKGNLFILKMFDPTYRIPL

SEQ ID NO: 1317 - protein, 625 aa, Arabidopsis thaliana
MAMPPPGNVTTPSEKLQFPPPANWIPDERDGFISWLRAEFAAANAIIDSLCQHLQAVGDHNEYESVIGSIHHRRLAWSQVLTMQQFFPVADVSYNLQQIAWKRQQQMPPQRHYNSDQVGKFGARRSGPGFNKHHGGGGGYRGADSMARNGHNFNGVNSDRVEHREEAKLASDVKALSVAEEKRDGSEKPRSDSKVEKKLEESETQEEIVKNHKCNSGSKDNSLISEQKQEENDKECPASMAKTFVVQEMYDAKMVNVVEGLKLYDKMLDANEVSQLVSLVTNLRLAGRRGQLQSEAYVGYKRPNRGHGREMIQLGLPIADTPPDDDSIKGKSFKMLFTYNFCVLVNMRYGLYADRRIEPIPSALSDIIERLVSKQIIPVKPDACIIDFFSEGDHSQPHMFVPWFGRPISVLSLSECDYTFGRVIVSENPGDYKGSLKLSLTPGSVLLVEGKSANLAKYAIHATRKQRILISFIKSKPRNSNWGPPPSRSPNQHIRHPTGPPKHYPVVIPSTGVLPTPSHRPPNGAVQPIFIPPSPPLASPMPFPGGVPTGPPVWPLLPPHPRHQTAPQPRMPIPGTGVFLPPGSNQELADNSNGTEGKLDLKAKEEARNGFGEGECDGSNGKQSN

SEQ ID NO: 1318 - protein, 170 aa, Arabidopsis thaliana
MTSSDQSPSHDVFVYGSFQEPAVVNLILECAPVMVSAQLHGYHLYRLKGRLHPCISPSDNGLINGKILTGLTDSQLESLDMIEGTEYVRKTVEVVLTDTLEKKQVETIVWANKDDPNMYGEWDFEEWKRLHMEKFIEAATKFMEWKKNPNGRSREEFEKFVQDDSSPASA

SEQ ID NO: 1319 - protein, 551 aa, Arabidopsis thaliana
MPRQNKDEKFVFDDGEDEDREDPVAITEVDNGEEEDDDEANEDLSLKILEKALSRRDVGNKLDSDLSSDSGVVSTVMVNGVKSKVKKSESSKKMKRNKLEADHEIPIVWNDQDEEKVVEEIVKGEGEDDEVERSDEPKTEETASNLVLKKLLRGARYFDPPDAGWVSCYSCGEQGHTSFNCPTPTKRRKPCFICGSLEHGAKQCSKGHDCYICKKTGHRAKDCPDKYKNGSKGAVCLRCGDFGHDMILCKYEYSKEDLKDVQCYICKSFGHLCCVEPGNSLSWAVSCYRCGQLGHSGLACGRHYEESNENDSATPERLFNSREASECYRCGEEGHFARECPNSSSISTSHGRESQTLCYRCNGSGHFARECPNSSQVSKRDRETSTTSHKSRKKNKENSEHDSTPHESNGKTKKKKKKKTHKEEQPQTSPRKRKHRGGWITEEPEEESFQRGKMRRPKSPITPSGYNRSPSTHIGHNYRSPKFNSGGHYPGSQSSRHHSGPSPSRWQPSHQHHHHHQHLHHHHQNHSYEPAPPRHGRANRYSEFAGNYERW

SEQ ID NO: 1320 - protein, 539 aa, Arabidopsis thaliana
MSKDKVSSPTADLIPQLAATLVAALGAQCYRLTLPPSPPPRILTPQVPPSSATMASSFNPTRILDHRASSHRNRRGAFPASKRRRLVDEPIDYPDLSNPAYQVLSTPLFASGIGSIRELLSSSPPPTTSSQPPSVSIPPPSAPPLVLSDSKDAEPAGLTNPSAPPSPLAPKNITPVASPVADVPMPDPLISPTAETAEGASVPDAAVSYAARAAAHRQVFAERDELDRTLRRPLVPPHTKRFLSAAAAERYKHIAKRDFIFQKTLPLDPEVLTATKYFLEHSGMAQTVVAVEQFVPEVVREFYANLPEMEYRECGLDLVYVRGKMYEFSPALINHMFSIDDSALDPEAPVTLSTASRDDLALMMTGGTTRRWLRLQPADHLDTMKMLHKVCCGNWFPTTNTSTLRVDRLRLIDMGTHGKSFNLGKLVVTHTMSLARLGPLSSHRLAYPNLIYQLLTFQRDVRSRPRDTLSDEPGVFVNDPPPTQPTQAPPPMGHKLLLEDINDLLEIGKRIRRRLTGKLFSCFMWCFAYCVLALCFLEF

SEQ ID NO: 1321 - protein, 59 aa, Arabidopsis thaliana
MRLFDPWPVFFKREWKRCWPFLTGFAVTGVLITKLTAGLTEEDAKNSKFVQQHRRYHQS

SEQ ID NO: 1322 - protein, 476 aa, Arabidopsis thaliana
MLDLQPSDRRHGAPSSSGGVSGGDELIRTYKGWKGNNVFFLGGRLVFGPDARSILITVFLITAPVIVFCIFVGRKFIDDFPHHRGVSVLAVAVGLILLDLVFLLLTSARDPGIIPRNLYPPEPESNEGNGEPRLAHTPQSRLPRTKDMIVNGITVKIKYCDTCMLYRPPRASHCSICNNCVEKFDHHCPWLGQCIGLRNYRFYFMFVLCSTLLCIYVHVFCWIYVKRIMDSENINIWKSFLKTPASIALIIYTFICVWFVGGLTCFHLYLMSTNQSTYENFRYRYDRHENPFNKGIVGNFMEVFCTNVAVSQNSFREKVSKEPAIPPRTVNGGMSSPSLQKVSNDIEMGRKPVWHETVEEELGDIEKDMEAGVASRDLSRMLPPEESEGRGIMHSRESSRGRGIMHSRESSRGRRGGSWELSSRVNEDLRTRDESVSRVGEDSSESSDNDASRDLHVEIYDAVTSRGRTGTGIGRL

SEQ ID NO: 1323 - protein, 323 aa, Arabidopsis thaliana
MEIDSATNGNSDTVMTESAATITPSPVVVSSSRSNQFTESLKLEHQLLRVPFEHYKKTIRTNHRSFEKEVSTIVNGVGELADSDWSKDDTVSRLTCLVTRLQGLKRKLEEGSNVENLQAQRCRARIDHLDSVDVENITEWNNTKLKRILVDYMLRMSYFETATKLSESSNIMDLVDIDIFREAKKVIDALKNREVASALTWCADNKTRLKKSKSKFEFQLRLQEFIELVRVDTAESYKKAIQYARKHLASWGTTHMKELQHVLATLAFKSTTECSKYKVLFELRQWDVLVDQFKQEFCKLYGMTMEPLLNIYLQAGLSALKTP

SEQ ID NO: 1324 - protein, 222 aa, Arabidopsis thaliana
MEVKGKETASVLCLSKYVDLSSEESHRYYLARRNGLQMLRDRGYEVSDEDINLSLHDFRTVYGERPDVDRLRISALHRSDSTKKVKIVFFGTSMVKVNAIRSVVADILSQETITGLILVLQNHVTNQALKAIELFSFKVEIFQITDLLVNITKHSLKPQHQVLNDEEKTTLLKKFSIEEKQLPRISKKDAIVRYYGLEKGQVVKVNYRGELTESHVAFRCVW

SEQ ID NO: 1325 - protein, 325 aa, Arabidopsis thaliana
MGDDQLDFELPEEVLSVIPMDPFEQLDLARKITSMAIASRVSNLDSEVVELRQKLLGKESVVRELEEKASRLERDCREADSRLKVVLEDNMNLTKEKDSLAMTVTKLTRDLAKLETFKRQLIKSLSDESGPQTEPVDIRTCDQPGSYPGKDGRINAHSIKQAYSGSTDTNNPVVEASKYTGNKFSMTSYISPRLTPTATPKIISTSVSPRGYSAAGSPKRTSGAVSPTKATLWYPSSQQSSAANSPPRNRTLPARTPRMDGKEFFRQARSRLSYEQFSSFLANIKELNAQKQTREETLRKADEIFGEENKDLYLSFQGLLNRNMR

SEQ ID NO: 1326 - protein, 144 aa, Arabidopsis thaliana
MKQPATPNAAEETKSEQKQKSKKFPTPTELISHYQKRGLEPAEASIKVIEDLQNALVRVVSSSRNASSKDKLVTDARKIDAINGRLAVVDAKLETKPGYVETFALGLASGATLNGISAVWPHVTRGIGQIWSAVRIGTDPSSTS

SEQ ID NO: 1327 - protein, 375 aa, Arabidopsis thaliana
  misc_feature (100)..(100): Xaa can be any naturally occurring amino acid
MEAKEETPWSSILVPSVQEMVKDKMITTVPPRYVRYDQDKTEVVVHDSGLISEIPIIDMNRLCSSTAVDSEVEKLDFACKEYGFFQAKSQTSLFLQNYLXLVNHGIDPSFLDKIKSEIQDFFNLPMEEKKKLWQTPAVMEGFGQAFVVSEDQKLDWADLFFLIMQPVQLRKRHLFPKLPLPFRDTLDMYSTRVKSIAKILLAKMAKALQIKPEEVEEIFGDDMMQSMRMNYYPPCPQPNLVTGLIPHSDAVGLTILLQVNEVDGLQIKKNGKWFFVKPLQNAFIVNVGDVLEIITNGTYRSIEHRAMVNLEKERLSIATFHNTGMDKEIGPARSLVQRQEAAKFRSLKTKDYLNGLFSRELKGKAYLDAMRIEGK

SEQ ID NO: 1328 - protein, 387 aa, Arabidopsis thaliana
MDAEKKSAHFRQISSYKPQLLVLSSIQENPSSKISEKANIKADNDAEIGVFGAEKYFSMKLDHVDSTADITKQHEKENTHDHPNANPNPNPNPHPHPHPQLTKTTSSRSKTSRHGTPSVRSESSCNSQTFLMRINNHNENKQRKMNDTSISFGGFRCYGPCSGVKTVHTDPKNSCKSRNSDRDFVAYDARKHNDKPRLHFEAKKADFHAQEKISLPIQRSDIAMNLERKLSLLTWDAIPNQLSTKNNNHNNNGNNSSMSSNTQEEETASVASSDLFEIENITSSVYEPSEASIGWSVVTGSMADQSVISDFDMMKRVTRNGPVVKTKPVIGEKVRSAGFLSGCKSHKAVSVVDSSRKVKETAKVDHHEMSHQKKFKTEIRIQDLSFL

SEQ ID NO: 1329 - protein, 176 aa, Arabidopsis thaliana
MEEDRENAKRVVFVTVGTTSFDALVKAVVSQNVKDELQKRGFTHLLIQMGRGIFFPTKCDGADGSLVVDYFTFSSSIADYIRSASLVISHAGSGSIFETLKLGKPLIVVVNEDLMDNHQCELAEALEERKHLYYTRPHSLHQTLTKMELGSLVQYTPGDGTPVARIIDRFLGFPDD

SEQ ID NO: 1330 - protein, 118 aa, Arabidopsis thaliana
MPEEESIDIKFRLYDGSDIGPFRYSAASTVDFLKQRVVSDWPKGKTVVPKGINEVKLISSGKILENNKTVGQCKTPFGDIAGGVIVMHVVVQPSLAKSKTEKKVDKAPKAVICTCTIL

SEQ ID NO: 1331 - protein, 193 aa, Arabidopsis thaliana
METIAVQNAPGKQVSGLRPFKNPKRRSSRGSLSRSGGSLALPLNPTSSWGSSPAYPPPHSYSQPPLLPLPRVNSSTVPLQRVNSSRPRVNNNSSLNRVAQTKAISETHMKKAEFIESARLTRTGSVPIQANQLRDFPEGFDGYPGPAIMLLSPPPSSLPMPRFSIKPKLRCNVEAAGKSDVATNNIRRVLQLR

SEQ ID NO: 1332 - protein, 419 aa, Arabidopsis thaliana
MSASTVSITANTAAATRRTPILAGEKKSNFDYPQSESLANGGVGEAGGTSRDLSRGEATLDRSQGQDLGPVTRRSVSAATGTNTTATQRRTRKVATPKSEKARWKTVVRIFAKQLGALLIIVGLIQLTRKMILKASSPSSPISSYETEMAFSGLESRIAEVDGLVKATTNSMQVQVELLDKKMEREAKVLRQEIERKASAFQSELKKIESRTESLEKSVDEVNAKPWVTKDELERIYEELKKGNVDDSAFSEISIDELRAYARDIMEKEIEKHAADGLGRVDYALASGGAFVMEHSDPYLVGKGSSWFATTMRRAHTNAVKMLSPSFGEPGQCFPLKGSEGYVQIRLRGPIIPEAFTLEHVAKVMILLYCKLFVLVSVFFLVCSYYYLWCLHLQWFDIEMPGKNDAIFFVTVDGMKLFE

SEQ ID NO: 1333 - protein, 236 aa, Arabidopsis thaliana
MTSNLFQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSVHYRFLDVFRFFRFLEKSRFDGIAFVCL

SEQ ID NO: 1334 - protein, 348 aa, Arabidopsis thaliana
MAGLLAWAADVVGKNGKEGDDEKDRIPLVFTEEQQKYVDELGRKATNLSRSIQDLRLRLPPPDISQRLPDLHAHSLASNAALTLQLDSHSATREQAHMREQTLLEENSAYENAISTCETKIEEKRNEADSLLRKLKELEAVEENLKTEQDNAQASLDARQSKSSSETVIQPDGNGKDGADTEAMKSFMLEKLESKKNDMSLMEEKVQDLERSWAVIQERALKQPSPAQREKTLDKQLHSLIEQLAAKQAQAEGIVGEIHLNEMELERLNNLWRRYESFNVEGNAARNRFKRTNSDREFTSDHEVDGHSYLPYSSATRNGTQTRLMYLRSAFVVYILALQVLVFIRISF

SEQ ID NO: 1335 - protein, 249 aa, Arabidopsis thaliana
MAQDHDETENKTFADVVGGDDVGEIVNGGTKNGYRKPDSVEKEDDEDLKSLYSLICLTIGSILFPDSKTGDASSFLERVRNSVAENGPKLREASERTGREILLWTRRGSSLRALLVITMGTIVLLTTMALVVFTLFFVAATANAIIISLLISLAVAGGFLALFFLCLTGVYIGALSVAAFVISTATVSAVVSVLIASGWIGFFYAVWLGTRGSLRLAKQSVSVVGSAISGNTISRHQHQDREVNIESTN

SEQ ID NO: 1336 - protein, 175 aa, Arabidopsis thaliana
MDKMNQAIEKMKMLVGMEVEDEQQAADEESSLSFMEDLNRNCALTTKQRFYGFAICLSAGLTCTLLSMLVFFNPVKFGITFTLGNLMALGSTAFLIGPQRQVTMMLDPARIYATALYLASIIIALFCALYVRNKLLTLLAIILEFTGLIWYSLSYIPFARTMVSKIFMTCFDTEF

SEQ ID NO: 1337 - protein, 68 aa, Arabidopsis thaliana
MHDWAAPLIASALFAFLSPGLILQFPGKESPVGFMNMKTTVASIFVHTVLYGLFLILFLVVLNVHVYA

SEQ ID NO: 1338 - protein, 67 aa, Arabidopsis thaliana
MTEWLPVVVATVLFVVLSPGLLFQVPGNNNFVDFGKMETSGYSILLHAFLYFGLVTVFTVVIHFPGT

SEQ ID NO: 1339 - protein, 79 aa, Arabidopsis thaliana
MSDKGRPLPKFGEWDVNDPASAEGFTVIFNKARDEKKTGGKPGSPGKSSEGHVKSGGGDPSKPQPKKWLCCMQAPAVDS

SEQ ID NO: 1340 - protein, 68 aa, Arabidopsis thaliana
MTTSKRLADRKIEKFDKNILKRGFVPETTTKKGKDYPVGPILLGFFVFVVIGSSLFQIIRTATSGGMA

SEQ ID NO: 1341 - protein, 327 aa, Arabidopsis thaliana
MITDSITNASATSAPRDSGKKKRNNKSAKMKQNKLGLRREQWLSQVAVSNKEVKEERSVNRSQKPHHESSDKVRREEDNNGGNNLLHHESFMESPSNSSVGGTYSSTNFSGRSSRSSSSSSGFCSGNITEEENVDDDDDGCVDDWEAVADALAAEEEIEKKSRPLESVKEQVSVGQSASNVCDSSISDASDVVGVEDPKQECLRVSSRKQTSNRAWRLDDDLRPQGLPNLAKQLSFPELDKRFSSVAIPSSCPICYEDLDLTDSNFLPCPCGFRLCLFCHKTICDGDGRCPGCRKPYERNMVKAETSIQGGGLTIRLARSSSMFCKF

SEQ ID NO: 1342 - protein, 421 aa, Arabidopsis thaliana
MTKGGLGIAAMSYVVIDYMRYVSPVWHSRLMPVLWSVLAIAVVTRVLFYKHWSKELRAAIPFLGSIVFLLCALLFEALCVRSVTAVLGLDWHRETPPLPDTGQWFLLALNESLPGTLVEILRAHIIGLHHFLMLFIMLGFSVVFDSVKAPGLGLGARYIFTMGVGRLLRAITFVSTILPSARPWCASARFNNVPSQPHRWAQKYYVPYANDPAAIRKLLHWDAAYADPGSYIGDYRADWGSMSFLSEFLRPSYSEGSSWFALLKKAGGGCNDLMYSGHMLVAVLTAMAWTEAYGGFSSAMIWLFVAHSAQREIRERHHYTVDCIVAIYVGILLWKMTGFIWSAERKTKQTKLEKIQNSLIHAAKDGDIETVRRLVEEIEVSSRVEKQSKVISNRTMTVFACATVITTLTIVILALTLTSDG

SEQ ID NO: 1343 - protein, 395 aa, Arabidopsis thaliana
MGAEKKWLFTLFSVVFLSVFLLLLYSISAFTSKPFPSSIRHGAHYPPAFAYYITGGRGDNDRISRLLLAVYHPRNRYLIHLGAEATDAERLALLSDLKSVPAVNAFGNVDVLGKVDRLSENGASKIASTLHAVSILLKLDPTWNWFIELSALDYPLITQDDLSHVFASVNRSLNFIDHTSDLAWKESQRIKPIVVDPALYLARRTQLFTATEKRPTPDAFKVFTGSPWIVLSRPFLEYCIFGWDNLPRILLMYFNNVILSEECYFHTVICNAPEFSNTTVNGDLRYMIWDSPPKMEPHFLTISDFDQMAQSGAAFARQFKKDDPVLDMVDREILKRGRYRVTPGAWCSSHSSWWTDPCSEWDEVNIVKAGPQAKKLDETITNFLDDLNSQSNQCK

SEQ ID NO: 1344 - protein, 176 aa, Arabidopsis thaliana
MAGLGLRLKAAKWTLRSGSGAVSREWSSEMGKGVRRFSTETENDVPTSGISRPLAEILKELNKKVPDSVIRTRVEDGCSIKYIPWHIVNRIMNMHAPEWSGEVRSVTYSPDGNTVTVAYRVTLYGTDAEIFRESTGTTSVDDKGYGDAVQKAEAMAFRRACARFGLGLHLYHEDAL

SEQ ID NO: 1345 - protein, 513 aa, Arabidopsis thaliana
MSSSPSLEILVREAEGFTVWNGPPFTNGQPTLKLERVSCSNTKFSVDGSKLMAMKSDGVISIYDATSLTEVRSFTIANVTAAELSPCGTYLQTFQKPTTPQEKNVSIWNTETGDLAHSHYQKSITKASWPSIRFCPDESSACRLATNEVQFFDPKDFSKGITSRIRVPGIAAFELSKTPASHVAVFVPESKGSPGSVQIFGCGEELQSQPSARRSFFRCSSVQFSWNHGSTGLLVVVQSDVDKTNQSYYGETKLHYLTIDGTHEGLVPLRKEGPVHDVQWSFSGSEFAVVYGFMPACVTIFDKNCKPLMELGEGPYNTLRWNPKGRVLCVAGFGNLPGDMAFWDVVNKKQLGSNKAEWSVTSEWSPDGRYFLTASTAPRRQIDNGMKIFNYDGKRYYKKMFERLYQAEWKPESPERFGDISELIKSVESLKLGEGKSQGQGSAQKKTIAPNPIAQKPAAYRPPHAKHAAAVQAELLGISTTGEMSKNALKNKKKRENKKAAAAAAAASGSNNA

SEQ ID NO: 1346 - protein, 93 aa, Arabidopsis thaliana
MATGGKVSFKVTLTSDPKLPFKVFSVPEGAPFTAVLKFAAEEFKVPPQTSAIITNDGIGINPQQSAGNVFLKHGSELRLIPRDRVGAVFVMDP

SEQ ID NO: 1347 - protein, 119 aa, Arabidopsis thaliana
MSNYAAGLGKPGSGKRRIRDLLNQPDNRVCADCGASVPKWAKYQSIHLLKSCGVHRSLGTHILKVLSVTLDEWSDEEVDSMIETGGNASANSIYEAFVPDTCSKPGPDVNHDQRMRFIR

SEQ ID NO: 1348 - protein, 205 aa, Arabidopsis thaliana
MGARFSRIAKRFLPKSKVRILMVGLDGSGKTTILYKLKLGEVVTTVPTIGFNLETVEYKGINFTVWDIGGQEKIRKLWRHYFQNAQGLIFVVDSSDSERLSEARNELHRILTDNELEGACVLVFANKQDSRNALPVAEVANKLGLHSLSKRCWLIQGTSAISGQGLYEGLEWLSTTIPNKPERSTSVSSFRSDSYERKLVRGPRY

SEQ ID NO: 1349 - protein, 345 aa, Arabidopsis thaliana
MEDIENIEEDEYGFSRNYFLAKELGGASKRSAHKLSDIHIVDEQELRETASTIEMKHSKEISELMSDYKTMYSKWVFELRCGFGLLMYGFGSKKALVEDFASASLTDYSVVVINGYLPSVNLKQSSGSLSKGQETFPSRSMDDILSFLHGPQSGDKDCFICVVVHNIDGPALRDPESQQTLARLSSCSHIRLVASIDHVNAPLLWDKKMVHKQFNWLWHHVPTFAPYNVEGVFFPLVLAQGSTAQTAKTAAIVLQSLTPNGQNVFKILAEYQLSHPDEDGMPTDDLYSASRERFFVSSQVTLNSHLTEFKDHELVKTKRNSDGQECLNIPLTSDAIRQLLLDLNQ

SEQ ID NO: 1350 - protein, 269 aa, Arabidopsis thaliana
MAKLFIKQAEQYAAARPSYPTKLFEYIASKTPCHDLAWDVGAGSGQASRSLAGIYKNVIATDTSSKQLEFAAKLPNVRYEITPPTMSSSEIEKLVAPESSVDLVTVAQALHWFDLTNFYSNVKHVLKKPNGVIAAWCYTNPEVNDAVDKVFQRFYDEKLGPHWDLARRLVEDGYRGIEFPFEKVDNDESTESQSFPVRFVTEKEMVFEEYMTYLRSSSAYQTAKEKGLELLTAEMEGEFAGSWKEDGKEKKVVRYPIYLLIGRVAEERV

SEQ ID NO: 1351 - protein, 447 aa, Escherichia coli K12
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 1352 - protein, 412 aa, Escherichia coli K12
MAQQNYLDELTPAFTSLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEVGNTLTLEQLKAENRAVLVTVGLSSGSGLPLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLSGELTMAADKIILAVGQHARLDAFAELEPQRNTIKTQNYQTRDPQVFAAGDIVEGDKTVVYAVKTGKEAAEAIHHYLEGACSC

SEQ ID NO: 1353 - protein, 347 aa, Escherichia coli K12
KKAGSCRFMTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 1354 - protein, 166 aa, Saccharomyces cerevisiae
FITSLYKKAGSCRTMWFPQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWISPLLGAFLAWSVWQLLQILDYTTYVNAEKAAGQKKED

SEQ ID NO: 1355 - protein, 426 aa, Saccharomyces cerevisiae
MSHQNQLIPQAYISNFHNRLTNEDDGIPIFTMAQQTRQHKRAKVVNYAEYDNDLFDEFNMNGSNFNNADTHYKDNAVSHENTPALTNGVTMDGSEYNVLENMNGADSIISNNKYDAGSNMVVESLSGLNSNNNASNGPSNKAQAQDIGNAVLPDLQDQHHNPFNILRYPKIRDTFINGKVVSPYRLNTDQETKANANSGEAIMIPITLDIEHMGHTIKDQFLWNYNDDSISPEEFASIYCKDLDMTSATLQTQIANIIKEQLKDLENIAATEIMSDLHVIINLTCNLQDRFFEDNFQWNLNDKSLTPERFATSIVQDLGLTREFIPLISQSLHETILKIKKDWVDGHLIQDHVPNDAAFGYLSGIRLDIDELGSNWCPRVEILTKEEIQKREIEKERNLRRLKRETDRLSRRGRRRLDDLETTMRM

SEQ ID NO: 1356 - protein, 344 aa, Zea mays
MEQRRWLAVAVLMCLLVLCSGRELKTKHVPIYDPVLARTLAEYTSAVYTADLTQLFTWTCERCCDLTEGFEVIELIVDVKNCLQAYVGFARDMNAVIVVFRGTQENSIQNWIEDLFWKQLDLDYPGMPEAKVHSGFYSAYHNTTMRDRVMRGIKNTRKLYGDIPIMVTGHSMGGAMASFCALDLIVNVGFKDVSLMTFGQPRIGNAIFASNFKRYLPNAIRLINAHDIVPHLPPYYHYFPQKTYHHFPREVWIHNVGLGSLVYSIEEICDDSGEDPTCSRSVSGNSVHDHVHYLGISMHAESWGHCRIVTDNSTLPQQYKMDPDGNIILSKQPGLSVNELHSAQ

SEQ ID NO: 1357 - protein, 762 aa, Glycine max
METQSDGNEDNIAAIKNMRQQLETRIESQHKAHMEMLASMQTVIPNLVSSLDLSLKVVSSFNRRPFAPTPSLPQPDPKLSPKKPVELTHRFNAETCADGSIEANLTNPKNQKPKTSMHSNSAFQVESEKVSPLAVVRSMVTVCLLGRVPFSPIDSSTVSRKLENDQMVTPTEKAALQELGGDSGATLAVEIALRAMADDNGGVEVEEFVVSGKARIMVLNVDRTRLLRELPESVQYQQLESSSGDGNANQNQVQHITHSGSNVNGSLPGMGRLVPRPMSDMWPPHGDPHMSALQPMFSGGPRGAPPRVMAMMGAHRGISIPSMHRLPLGPNAPGGSPNAMPQKPRTYEDDMKDLEALLNKKSFREMQKSKTGEELLDLIHRPTAKETAVAAKFKTKGGSQVRQYCDLLTKEDCRRQSGSFIACEKVHFRRIIAPHTDINLGDCSFLDTCRHMKTCKYVHYEYDPTPDVSPTMMGAPPPPKPLKPQRAEYCSEVELGEPQWINCDIRNFRMDILGQFGVIMADPPWDIHMELPYGTMADDEMRSLNVPALQTDGLIFLWVTGRAMELGRECLDLWGYKRVEEIIWVKTNQLQRIIRTGRTGHWLNHSKEHCLVGIKGNPEVNRNIDTDVIVAEVRETSRKPDEMYPLLERISPRTRKLELFARMHNTHAGWMSLGNQLSGVRLVDEGLRARFKAAYPDVEVQPLSPPRASAMEVDTSIAPHTRSPFAATESESTSAQFAEPAAAPESNFVSEEKSMAIDVDIG

SEQ ID NO: 1358 - protein, 320 aa, Glycine max
MSTAAAAGGDMEAGFAKLQGEDFEYYMQTYSIVLGRNSKKSTVDVDLSSLGGGMNISRHHARIFYDFARRRFALEVLGKNGCLVEGVLHLPGNPPVKLDSQDLLQIGDKEFYFLLPVRSILGGPVGPRHYPNHATPGPVVPHYNNYHLGPGPVKKAPRREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTHEFVSLVSLLS

SEQ ID NO: 1359 - protein, 113 aa, Zea mays
MASIGSSNIGFQLLKKSGWKEGTGLGAQEQGRLEPVETRVKNNKRGIGSKEPKPQPKVGDDIETHPQKPKEMQSKKRAKLAAKRIRKMQEEEKRLKEKEFEMAFFREFWPDNV

SEQ ID NO: 1360 - protein, 225 aa, Zea mays
MPPVKWLMHWHPSPGATLNSQILAEACGCAESLGGSKDGRWKTSIFFYRAMTRDGAGGPAVQQHPDLPRELLGVALHERPGLYFSIVRAQRLVLQADAAFPQVMEKLQSYRIRVALNFEGFQYQLGDFCLRIGKCVPNNSEALRGIMMEVEYYPLTSIEKSKAVMEDFFDIWQETVAKKSLPGQFIHVDSNFSEYGLSDQYSFQHTAVQYATCLQQLMAAVTVRG

SEQ ID NO: 1361 - protein, 315 aa, Zea mays
MKIIIDTDPGIDDSVAILMAFQMPGVQVLGLTTIFGNCTTEHATRNALILCEKASHLEVPVAEGSHEPLKGGKPHVADFVHGPDGLGNVDLPDPTIKKVEESATDFLVDKVSRFPGEVSVLALGPLTNIALAIKKDPSFVKNVKKIVVLGGAFFAAGNATPSAEANIHSDPEAADMVFTSGADIYVVGLNITTQVSFTDKDLLELRNSQGKYAQFLCDVCKFYLDWHTESYGAPVIFLHDPVSFAALVRPELFTFKKGVVRVETQGICVGHTSMDMLLKKWNSENPWTGYSPISVAWTVDVPKVVAFVKELVTKP

SEQ ID NO: 1362 - protein, 235 aa, Zea mays
MLGFRQMPWSSAQEQEQAPSEQLCEGVSAVVAARQGMEKPLTAVAEAFEELARGMEADGGELRLAPFSDSCALVSVLFSSLGMAFRFAEIEYVTKVNDLIGAGKSYRTLSDILDKDIQNDCVKKQGSHSRNLRRVRLGLGLIKALFEQFLDTEGTLYDAATIAYGQVCAPFHSWAIRKAVGAGMYTLPTREQLIVRLNETDFSVQKEMRRYIDASSPIIEYIDNLFLSRNISLDW

SEQ ID NO: 1363 - protein, 377 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMAAKHPVIAVTGSSGAGTTTTSLAFRKIFAQLNLHAAEVEGDSFHRYTRPEMDMAIRKARDAGRHISYFGPEANDFGLLEQTFIEYGQSGKGKSRKYLHTYDEAVPWNQVPGTFTPWQPLPEPTDVLFYEGLHGGVVTPQHNVAQHVDLLVGVVPIVNLEWIQKLIRDTSERGHSREAVMDSVVRSMEDYINYITPQFSRTHLNFQRVPTVDTSNPFAAKGIPSLDESFVVIHFRNLEGIDFPWLLAMLQGSFISHINTLVVPGGKMGLAMELIMLPLVQRLMEGKKIE

SEQ ID NO: 1364 - protein, 282 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMAAYLFNQENEPDESDSITLYDEAGRPLDCYVENSLEQEDAQYLLLMPVDIPVVIIAWEEDDDETEDAEAILLEDQEEISGIFADAKAVLAELDLSLKYTAYTLTVSGELPPIEDEDILTLEIEGNDPAGEMEEEELQFLASFYHEEERYSIYTPLAPLLFLAKAISETQIELVHPDNDELKHILEELLFEDAD

SEQ ID NO: 1365 - protein, 428 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMVGLIGHLTSLEHAQAVAEDLGYPEYANQGLDFWCSAPPQVVDNFQVKSVTGQVIEGKYVESCFLPEMLTQRRIKAAIRKILNAMALAQKVGLDITALGGFSSIVFEEFNLKQNNQVRNVELDFQRFTTGNTHTAYVICRQVESGAKQLGIDLSQATVAVCGATGDIGSAVCRWLDSKHQVKELLLIARNRQRLENLQEELGRGKIMDLETALPQADIIVWVASMPKGVEIAGEMLKKPCLIVDGGYPKNLDTRVKADGVHILKGGIVEHSLDITWEIMKIVEMDIPSRQMFACFAEAILLEFEGWRTNFSWGRNQISVNKMEAIGEASVKHGFCPLVAL

SEQ ID NO: 1366 - protein, 405 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMAIDNIRLRNEFINTEVITRSSGKKLGVVKEVLVDVDQREIVALGLRDNFLSLTGMPQYLYLNSIVQTGDVVLVENDDVFELVEVDLYSPLVNSEVVTETGEPLGRVRDFQFDLATGKVSSIIIASLGLPQIPDQLISTYELSIDEVVSSGPNRLIVFEGAEERLNQLSVGLLERLGIGRPSWERMEEDLYYPPTTRPENQLGSGIPVRPPVQVRQPEPVLEERWNEDDWQDTRPAPPPRREVAPLRYPEPEYEDDYEVDNWGEASSRSSAPEPDYDYEDGVAGDVWDDDEAPAPYSPPRVNIPETRREKMPEYYEE

SEQ ID NO: 1367 - protein, 578 aa, Pseudomonas fluorescens
MASSMLSSATMVASPAQATMVAPFNGLKSSAAFPATRKANNDITSITSNGGRVNCMQVWPPIGKKKFETLSYLPDLTDSGGRVNCMQAMTRFELQKLYIDGAYSDAGSDATFEAINPANGEVLAHVQRATKEDVERAVVSAEKGQKIWAAMTAMERSRILRRAVDILRERNDELAALETLDTGKAFSETKYVDIVTGADVLEYYAGLVPAIEGEQIPLRDTSFVYTRREPLGVVAGIGAWNYPIQIALWKSAPALAAGNAMIFKPSEVTSLTTLKLAEIYTEAGVPNGVFNVLTGSGREVGTWLTEHPRIEKISFTGGTDTGKKVMASASASSLKDVTMELGGKSPLIICDDADLDRAADTAMMANFYSSGQVCTNGTRVFVPSHLKAAFEAKIVERVARIRVGNPEDENTNFGPLVSFPHMESVLGYIAKGKEEGARVLCGGERLTDGEFAKGAFVAPTVFTDCTDDMTIVREEIFGPVMAILSYETEEEVIRRANDTDFGLAAGIVTRDLNRAHRVIHQLEAGICWINAWGESDAKMPVGGYKQSGVGRENGISSLNNFTRIKSVQVELGDYVSVF

SEQ ID NO: 1368 - protein, 779 aa, Saccharomyces cerevisiae
MGSFPLAEFPLRDIPVPYSYRVSGGIASSGSVTALVTAAGTHRNSSTAKTVETEDGEEDIDEYQRKRAAGSGESTPERSDFKRVKHDNHKTLHPVNLQNTGAASVDNDGLHNLTDISNDAEKLLMSVDDGSAAPSTLSVNMGVASHNVAAPTTVNAATITGSDVSNNVNSATINNPMEEGALPLSPTASSPGTTTPLAKTTKTINNNNNIADLIESKDSIISPEYLSDEIFSAINNNLPHAYFKNLLFRLVANMDRSELSDLGTLIKDNLKRDLITSLPFEISLKIFNYLQFEDIINSLGVSQNWNKIIRKSTSLWKKLLISENFVSPKGFNSLNLKLSQKYPKLSQQDRLRLSFLENIFILKNWYNPKFVPQRTTLRGHMTSVITCLQFEDNYVITGADDKMIRVYDSINKKFLLQLSGHDGGVWALKYAHGGILVSGSTDRTVRVWDIKKGCCTHVFKGHNSTVRCLDIVEYKNIKYIVTGSRDNTLHVWKLPKESSVPDHGEEHDYPLVFHTPEENPYFVGVLRGHMASVRTVSGHGNIVVSGSYDNTLIVWDVAQMKCLYILSGHTDRIYSTIYDHERKRCISASMDTTIRIWDLENIWNNGECSYATNSASPCAKILGAMYTLQGHTALVGLLRLSDKFLVSAAADGSIRGWDANDYSRKFSYHHTNLSAITTFYVSDNILVSGSENQFNIYNLRSGKLVHANILKDADQIWSVNFKGKTLVAAVEKDGQSFLEILDFSKASKINYVSNPVNSSSSSLESISTSLGLTRTTIIP

SEQ ID NO: 1369 - protein, 520 aa, Zea mays
MERTINSLMYKGSIPDAINQSRREKKLFVVYISGEDEASSSLEQSSLIDENVVEVIGRCCILLHLKQGNVDASQFSAIYPQKSVPSISVIGLNGVLLWNHDGYINSENLKESIEKAWADLHLQETAATLLTASLATRNSEPVNSATTVLPAQGGSSTLENPSDLSSQSPDVSGASEVAHSTDLISQVPNSTALYEPLEINEKEGSKSNSDDKTVEKLGSTSTEFDCDLLDISRKSNTVSSADSKGEDITPSAKRKNKDDGSHTSIPLEDTPSTLTNKGVSSQSRVEQDKATSFVSVKSDDIQLSIRMPSGNRLEIKLTKQDVLRKVKNFVDENQGNGLGSYDLSLVYPKRVFSEQDMEATLSELGIQNRHAMIVVPHRQSGQVSRRHSSASYDMGVNSGADDVGGNSGAGGYFGYLRTVLSYVNPLSYLRGNTNSSNTELQSNEGLRQLRHGSGPWSEPRPLGNRGHEVTDADSANTLRRRPRPFGANIHTLGSEDHGPSDERNVFWNGNSTEFGGDDRK

SEQ ID NO: 1370 - protein, 604 aa, Oryza sativa
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRLSHEWQAYISRTHSLRKTFISVKGIYYQAEVQGQKITWLTPHALQQVLTDDVDFNVMLTFLEFYETLLGFINFKLYHSINVNYPPVLDPRLEALASELYALCRYMSSGRVPGNSEPAGLIEDKEGEDNKESSKTDESELRLAQLQHQLPTNEPGALMHLVQESTAADADDADAKECRSLFKNLKFYLSREVPRESLLFIIPAFGGTVSWEGEGAPFDETDEDITHQIVDRPTQSHVFLSREYVQPQWIYDCVNARIILPTEGYIVGRVPPPHLSPFVDNDAEGYIPEYAETIKRLQAAAQSQVLPLPSLGDEDMENSLVEAIIDRSESNEIADKKRKLEMLEKQYHDELRMEYEGKTFSNRTADNQPDVVDKSDTKEADDHMEDSHKQAEKDAADISKTLMSRKQRGLLQAIEINQERKKDKVNLLKKRKKNADSSASAKGR

SEQ ID NO: 1371 - protein, 861 aa, Glycine max
MDQNRDESWRKLVKKMLPPGASIPADASNLDYSIAMEYVGPPVSYEVPRVEPFDTNSRAIPTAQPLSGSQRSNTHGGHMVIEPIPLPVSRIAVGVTSSPNQSPRVSGSSDSVVSVLQNPDLSSASPSASPASVHNLPSNPPKPANEAKRAPVVTFNTVDRPQRKEVEVVKPVYAEYVGVLNERKKKKIRVCYRCGKGKWETKESCIVCNAKYCSNCVLRAMGSMPEGRKCVTCICQPIDESRRLKLGKYSRVLSRLLSPLEVKQIMKAEKECSANQLRPEQLIVNGLPLKPDEMAELLGCPLPPRKLKPGRYWYDKESGLWGKEGEQPDRIISSNLNFTGKLSLDASNGNTEVYMNGREITKLELRVLKLANVQCPRDTHFWVYDDGRYEEEGQNNIRGNIWEKASTRFVCALFSLPFPHGQPHGQKDETSHYTTVPKYLEQKKTQKLLLLGIQGSGTSTIFKQAKFLYGNKFSAEELQDVKLMIQSSMYKYLSILLDGRERFEEEAVSRMNGQGSPGQTMETGSNGEASNTSECIYSLNPRLKHFSDWLLDIIATGDLDAFFPAATREYAPLVEEVWRDPAIQETFKRKDELHFLPDVAEYFLSRAVEISSNEYEPSERDIVYAEGVTQGNGLAFMEFSLDDRIPKSDTYSENLDAQLPPLAKYQLIRVNAKGLNEGCKWVEMFEDVRAVVFCVSLSDYDQLLLSPDSSGSGTLVQNKMVQSKELFETMVRHPCFKDTPLVLVLNKYDIFEEKISRVSLNTCEWFSDFCPVHAHHNNQSLAHQAYFYVAMKFKDLYASLTGKKLFVAQARARDRVTVDEAFKYIREVLKWDEEKEENFYGPPEDSFYSTDISSSPFVRQE

SEQ ID NO: 1372 - protein, 511 aa, Zea mays
MVQLFLQVPAECGSVNTVVVEGRRSLFHNVESIIKSLTKSAGRYEARLWLCATVSLVHSLSDCGQRDLFLDLLERKNSRRDVAARLLRMIFDKKPRMVGSILARKGHILEDFFRGNPNRIMQWFGHFAVTGESTHRKGAKALSQFAFVNRDRCWEELEWKGKHGQSPAVVATKPHYFRDLDVLETVENFLEYVPDFWSSDELANSIKDGEILQIDEEYFVDQFLYLMYEENSKDAWHVVEDFLMDEQFSSLCQHLLIHLDEERLLGFLNSLGKLINPTMQCKELTFPCCWLEVLLSGHYDHISLDDLVFLNCVIAKGRQLWRLMNDEEQHEEWGQMEELLKGGNHLTDADHFALMKELVETELPGVLKWVGIQSWIIFCELSKECKSGDSCESFFSHNKIEFHKADDYSLVRNYGFSISHMPDIDVEDLTRSSHKRRKRNRRKRHRYESDEDKFDELLELGSSDGKNGVESQRGSWRLSTDGFSASWDISDIPDHLSTCYFTIWVKWACFR

SEQ ID NO: 1373 - protein, 467 aa, Zea mays
MAREPSPEIDDELYNEVYGKAYSGPVASATNSVTPKGNAEKRPLTRDKSDDEDGAPDPNAVPTDFTSREAKVWEAKAKATERNWKKRKEEEMICKICGDPGHFTQGCPSTLGANKRNADFFERVPARDKQVRDLFNERVISQIEKDVGCKIRMDEKFLFVSGKDRLILSKGVSAVHKIIQEGKGKHSPSSPKHDRSRSPVRNTTEFRSKHSDSHRSPSPRNFDSQWSHSPRNASLSQSKGYYNERHRDGRLHNNMPKFSKGSPQAHANFGAKGRPAQSKSPCHTSYLDELPRTHGENNQFAASRVPNDWGIERHGADASSSLRFDMPSHQQTLEELEMEFKKEATQLARARDQEEDEENYRHRESLRVIRENYMERVITLRNVHAKKWEEFLDTFKSQQQAQPSYIQTGYLGFEQRTAHISATHQPMDSKSTYPYASDSYSAPKAHAAYGEFQHERHDDLGRAYRRY

SEQ ID NO: 1374 - protein, 499 aa, Zea mays
MKDPAHRTKVVLRRLPPAIAQQDVVDQVDARFAGRYDWACFRPGNASQKNHRYSRLYLNFKRPEDVVEFAEVFNGHIFVNEKGAQFKAFVEYAPSQQVPKSNVKKDGREGTVTKDPEYLEFLEFISKPTEHLPSAEIQLERKEAERAAAGKEAPVVTPLMMYVRQQRAAKSMAQRPGSRLSRKVAGVVTSSSSPKRSFEKRRSSTYVVRDSIKEKPTYIMVPKREEHTQRGKIVSGNSDATSGGASGSGQSSDKIVILKGRGRVDSNTPDGAAQQSSTPVKNIPPSSSRLDKRSEANGRIIKTVLSNKEVRSSNPSQHEQEGHMFNTEKDKRPPRALNPRTIVKDQVVENAERSHFDEKNNYVHSSAPIGEKVERHARNRDRPDRSVWAPRRYDKSPPGGVSHALSSDFSQMQSHSGDNVSQLTDGHGDRKTDTRGHGGSRGVPVENGHRHANRRGTPCDPKETKISASVPDGKNSKRGSASYGAHERQVWVQKSSSGS

SEQ ID NO: 1375 - protein, 206 aa, Zea mays
MTGVSTGLLTGLRRVMEQQRISTAFCRQSRVSSSTVSFSDLDEKGDMEYDDNSPNSKRELRPQGVDPNKGWEFRGVHRAIICGKVGQVPVQKILRNGHTVTVFTVGTGGMFDQRVIGPKDLPKPAQWHRIAVHNDYLSAYAVQKLVKNSAVYVEGDIETRVYNDSVNDQVKNIPEICVRRDGKIQLVKSGDSAANISLDELREGLF

SEQ ID NO: 1376 - protein, 142 aa, Zea mays
MASEAVVVHTGGCHCRRLRWQVEAPASVVAWICNCSDCSMRANTHFIVPAAKFKLQAGADEFITTYTFGTHTAKHTFCKTCSITSFYTPRSNPDGVAITVACVDPGTLKHVEYRKFDGRNWEDFFRTSDIAGFSKDDAEAAE

SEQ ID NO: 1377 - protein, 346 aa, Zea mays
MRQPRSGPGKRRGRGPRIPAATLQKQKTALANVDQITGAKIPKSFVFSRGKLPSTLRHLQQDLRKVMLPYTALNLKEKKRNNLKDFVNVAGPMGVTHFLILSNPQSLPHLRFAKSPQGPTFTFQIEEYSLAADIANSQKRPRCPPGIFKNSPLVVLGGLTGLGNPFRSLVEYFQHMFPSVDPTTVKLATCQRILLLKHDKEKDVIEFRHYSIKLQPVGVSRRIRKLMQNNQVPDLGEFEDVSEFVKKAGYGSESEADDEAAMVSLPSDIDKLNRASRKSAVRLQEIGPRMTMRLVKVEAGLCSGDVLYPWPVEKEVVGKKGTETGEVEGQEDDSEATDESEDEMEV

SEQ ID NO: 1378 - protein, 390 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKIFKLIDESMRRSREGT

SEQ ID NO: 1379 - protein, 92 aa, Zea mays
MGYLQEARENHVKKKVEEALRSKMKQKALQECDFYCSKYAECARGRTFSVVWQCRKQAKELNECLHQYTNDAILEEMKKAYMIEQKSKEINQ

SEQ ID NO: 1380 - protein, 372 aa, Zea mays
MVKVIQGRPAEMGFRMPAEWEPHEQCWMGWPERPDNWRENAGPAQEVFARTAIAISKFEPVTLCASAKQYPKVHELMEHQTNIRVVEMSMNDSWFRDMGPTFVTCKGDSGIAEQTIAGIDWQFNAWGGIYDDWSLDSDVAKKIVEIERIPRFPQKIILEGGSIHVDGEGTCITTEECLLNPNRNPNMTKLEIENELKDFLGVSKVIWIPRGLYGDEDTNGHVDNMCCFIKPGVILLSWTDDEKDYQYERSVEALSVLSQSVDAKGRQLQVVKIHVPGPLYMTEEEAQGVVSSGHSVPGPAGTRLAASYVNFYIANGGIIAPSFGDRWDEEAYAVLQKAFPDHEVVMVEGGREIALGGGNIHCITQQQPVRPS

SEQ ID NO: 1381 - protein, 224 aa, Zea mays
MSFIFGKKKTPAELLRENKRMLDKSIREIERERQGLQAQEKKLINEIKKVAKQGQMGAVKIMAKDLIRTRHQITKFYALKSQLQGVSLRIQTLKSTQAMGEAMKGVTKAMGQMNRQMNLPALQKIMREFEMQNEKMEMVSEVMNDAIDDALEGDEEEEETEELVSQVLDEIGIDINSELVKAPATAVAKPVAAGKVPAQAEAAGGPDGGIDDDLQARLDNLRKM

SEQ ID NO: 1382 - protein, 143 aa, Zea mays
MALAAIYNLFIINKSGGLIYYKDYGSAGRMDTNDSLRLASLWHSMHAISQQLSPTPGCTGIDLLQAHNFDLHCFQSLTGTKFFVVCETGAPNMEMLLKVIYELYTDFVLKNPFYEMEMPIRCELFDHNLAQMIQKDRVALLGR

SEQ ID NO: 1383 - protein, 281 aa, Zea mays
FITSLYKKAGSCRTMAAMTAYKYQAQALMRDYLLADPLVPYTSVLIGIVLCKMAYDFTRILSSFYFKGYTLLTKIQRIEWNNRGMSSAHAIFITAVSLYLVMSTDLFSDRVKGPITFRYSIISTSALGVSVGYFITDLAMIFWLYPSLGGMEYVLHHTVSLVAIAYTMLSGEGQFYTYMVLISETTTPEINLRWFLDTAGLKKSSAYLVNGILMFVAWLVARIFLFMYVFYHIYLHYGQIMQMHAFGYYLTFVVPSVLFVMNTMWFMKILKGVMKTLAKWP

SEQ ID NO: 1384 - protein, 475 aa, Zea mays
MATVAPVVSDLVDFLNASPTAFHAVDEAKRRLKAAGFVQLSEREEWAGLEPGRKYFFTRNHSTIVAFAIGAKYVAGNGFHIIGAHTDSPCLKLKPVSKVTKGGYLEVGVQTYGGGLWYTWFDRDLTVAGRVIIREKKDGVVSYAHKLVRVQEPIMRIPTLAIHLDRTISSEGLKVNNQSHLVPVLATCIKNEMQKFVADNGPKQASENANTKHHPLLLQLIAKEANCEPGEICDFELQLCDTQPSVVAGATKEFIFSGRLDNLCMSFCSLKALIDSSSVEHSLDHESGVRMVALFDHEEVGSDSAQGAGSPAMLDALSRITGSFNSSGSKLLEKAIQRSFLVSADMAHALHPNYMDKHEENHQPKLHGGLVIKHNANQRYATNAVTAFIFREIAERHQLPIQDFVVRNDMACGSTIGPILASGVGIRTVDIGAPQLSMHSIREMCAADDISYSYEHFKAYFEEFTELDGKVKVDY

SEQ ID NO: 1385 - protein, 336 aa, Zea mays
MEEEKAAAYYDELNRKGEGARRFKQGLGFSSSSATAFPSKPTASSFLSGFVRAGAAPGPAKQPLPHSRTPSSPHHRSSSPPLSRPRIRSRSRSRSPSRSSRRQSRSRSRSRERRRRSRSRERDRRASCRRSRSRGSRSPSRRSGRSLHLEARRERHGDQRRRHDDGHQSSKGRSDRDGGKMDYSRLIKGYDKMTPAERVKAKMKFQLSETAAKDSTLGTATVGWERFQFNKDAPLDEDNDDVEVANDDASLVKNIGKSFRLSAVESKREDKIRDAHDEAIFGVPTTSFVDVEIGGDELKTNHEDGKVEDTESDEPSSSLISDKVPGGIGLRSCGRI

SEQ ID NO: 1386 - protein, 79 aa, Zea mays
MTRDPAFLYKKKAGSCRTMVRVATYFAMTFGAFLFWQSMDRVHVWIALHQDEKKERMERELEIKRMQAELLAQAKENES

SEQ ID NO: 1387 - protein, 372 aa, Zea mays
MAKDGGPDWNGLLKWSLAHGDSTNPPRALSEEDRKWFMDAMQANTVDVVKRMKEITQVMKTPEDVLQSQGVTPENIEDMLDELQEHVESIDMANDLHSIGGLDPLLSYLKNSNAGIRAKAAEVVSTIVQNNPKSQQLVMESNGLEPLLTNFKSDPSTNARTKALGAISSLIRHNQPGVSAFRLGNGYAGLKDALGSDDARLQRKALNLIQYLLHNYKADRSVATELGLPKLMMHLVSSDDSLVREAALGGLLELARDKTSGNALPDQEKLKDMLKSRIEGISAMDTDDLHAAREERQLVDSLWKECYNEPSSLREKGLVVLPGEDAPQQPPPDVAGKMFEPPLRAWAAARPAQEDDSDSGSGKKDPPLLLKF

SEQ ID NO: 1388 - protein, 669 aa, Zea mays
MASLIERATSTTAHAVDPVLLRAIKSSARASDAAIRDAFRLILSLMSKPHSHVRLLAFSIADELFMRSKLFRSLLADSLDGFLPLAVGFRRANPLPPPTTSAALLRKAAVQALERWHHLFGAHYRQLRLAVEYLKESARVQFSGLRATVDARAAREARMQEIYAGKVEQLRENLASIKAEIRSTIDEIRNGLEIIRAEHKKFEGYYVDDEEEIASLSMRSIRTASLMAGEWVPETQENEAVFDALREAHRLLVSKHLVTVQEWITVLVRVNLPDNRFRDSALKDFIDVKNEIRAVRDHCSELGLDLDNFHRRKGDQEEEDNEFWVEGNIEAPNRARVQSSLDVASTSKDTEKGKWVVGGVSHIGKAPVAANGTRNLDPEKSKLLAEAPVLPWSSVLDRWGSSGDVHVNQRGLEVESHWGRVDNDATIPAAKIAELNVHCSIYREDPVEILPCHAPLKKGGLCQRRDLRVCPFHGPIVPRDAEGNPIEQNSGSSDAEVNPVEHLDIGGHSNELNGISDDDCMEGTSSRMAGVNNDYGDIAGTCDLGKITAEQLARQSVKNVRKREMDRKAQERAQRARIRQHNEDVLRNAALASTSYSAAAYEQPTEAHGRRGRRGKAKAPTLASMLKKKVTTKDRIAERLLNARATDATVRDVSHNEDMSYREAFPNQW

SEQ ID NO: 1389 - protein, 135 aa, Glycine max
MAQKAEKNDTDFKVPETIITPCTTTTATSITEPSRFFDATTPATSSRSPKRSLPLDDESQTDQTASSEPKRVVSRCSCCRRRVGLTGFRCRCGDLFCAEHRYSDRHDCSYDYKAAGREAIARENPVVKAAKIVKV

SEQ ID NO: 1390 - protein, 239 aa, Glycine max
MANVSIPLPRNGFSKPNYSTKRPCFTPSASTLRISCSGVAEFDGSHQKKGGLFNFNGIKGVACGILAACAVTSAAFPVTAATQRLPPLSTEPNRCERAFVGNTIGQANGVYDKPLDLRQCDFTNEKTNLKGKSLSAALMSDAKFDGADMTEVVMSKAYAAGASFKGVDFSNAVLDRVNFEKADLEGAIFKNTVLSGSTFDDAKLDNAVFEDTIIGYIDLQKLCTNKTIGDEWRVELGCR

SEQ ID NO: 1391 - protein, 148 aa, Glycine max
MVSRVHKRTAMYRNLHLLRSIRYSHSVSDYIQGLKQKLEELNQLTVATARKIVDYDPMPKLEVETQEEGFVIKVLSESSCQGLLVFILEAFEELGLDVLQARVSCAHSFSLEALGNKENNEDTRPLDAQLVEQVVSQAIQNWREVSQI

SEQ ID NO: 1392 - protein, 112 aa, Zea mays
MPSASLKDIVHTLLKGYQTETPILQKIIDVFLIYILITGIVQFIYVVLVGTFPFNSFLSGFISTVGCFVLTVSLRMQVDPKNEIKGVSVERAFADYVLCNLILFLVVLNFMG

SEQ ID NO: 1393 - protein, 227 aa, Glycine max
MAASSFTTSSILFPFTTSSKSPPSQLFPSFPCKHHTLRLRPVSVSAASTPTPSIQADKSPVSATPSKLLPFRIGHGFDLHRLEPGYPLIIGGINIPHDRGCEAHSDGDVLLHCVVDAILGALGLPDIGQIFPDSDPKWKGCASSVFIHESVRLMHEAGYEIGNLDATLILQRPKLSPHKDAIKANLSALLGVDSSVVNIKAKTHEKVDSLGENRSIAAHTVVLLMKK

SEQ ID NO: 1394 - protein, 270 aa, Zea mays
MGGALIVALLLATVPLSLGGGAHPGYSDADESACTVDAGAELLRRLEERGPGGRSIIDITHAVVPDLPAFATGAVAGPMLRLRESMADGSEYNLSELRMECHTGTHVDAPGHINQAHFAAGLDVDTLDLHVLNGPALLVDVPRNTNITAEAMEFLNIPRGVRRVLFRTLNTDRKLMWRKGGDMSYVGFTEDGAQWLVDNTDIKLVGVDGLSVASFDHLISAHVVFFKTPDIIPVESLNLDDIEAGIYMLHCLPLRLVGAEGAPTRCILIK

SEQ ID NO: 1395 - protein, 468 aa, Bacillus halodurans
MDLYINGEWMRSGKTLDVTNPATGEVIDTVPFAGKKEAELAVSAAYEAFPQWSSQTASERSRYLMRWFQLIDEQQDEIGEIMTKEQGKPLREAIGEVQYANSFIQWYAEEAKRIYGDTIPASAINKRILVQKQPVGVIAAITPWNFPAAMITRKVAPALAAGCTAIVKPAEQTPLTALKLAQLAEEAGIPAGVLNVITGNAQDIGEAWLEDSRVRKITFTGSTEVGKLLMRGAAQTVKKISLELGGHAPFIIMDDANLEEAVDQVIASKFRNAGQTCVCANRIYVAREIAEAFTEKFAAKVNELKVGNGLEEGVTIGPLIDKAAVEKVEAHIHDALKKGGQVTVGGRWTNHFFEPTIITGATDEMLCMNEETFGPLAPVATFDTEEEVIERANHTPYGLAAYVFTENIGRAIRLSEKLEYGIVGVNDGMPSVAQAPFGGWKESGLGREGGKYGIEEYLEVKYVSVAFK

SEQ ID NO: 1396 - protein, 396 aa, Escherichia coli K12
MIENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVV

SEQ ID NO: 1397 - protein, 747 aa, Zea mays
MSESESSNTGFAAALELWQENQLRILVLISLATQCFLFVFAPLRQHRIPGPLRLSIWLAYLGSDAVAIYALATLFNSHRCDTGTGTGTARAGVELLWAPIMLVHLGGQDSIPAYNIEDNELWRRHVVTAVSQVAAAIYVFVKSWPKSMAATAAHLVVDQDTRNRINAFMAHKSEMAAYGRILGPALLLFFSGITKCVCKPWDLKRVSVNSLVDSSSSGSSEEKADAGESEMDSLQEYVGAAAQYFESVGHEEEEDDGGGGDDDDDDTCKAEEVWKPYNLCVDLAPPYSGRLSCLKHLARSPADEAHRLVKSSLSATFHQLYTKESLKLHDMSHIVLTDNRALNRLKLVTSARGLRTVAATTLLGAIAAFYGEGDVDQDPTDVTITYALLWSAFVMECVLPTVIHHTFGWIERLFTGHRTWPDQVAQYSLMGYVARGRSHSWLMKAVACLGCGDLVDQLWTMKPRMGASSREITGLVHAHVAGAWMEGHIAGADSFRAFNDYRGQWTLGNCREIGVGVSSMVVLMSSVSRPFDESVLVWHLATDFCFHLLQVQGDPSRATATATATARRCIEMSNYMAYLLFVKPEMLMPGARRKLFRDACRELVGLLEEDRPGAPRARGKRDLAHKVVQLLKRDGGDVLGSAGVGVGVGVVRRAWCVAEKLVDSHSGDEEKMWTVIQGVWVEMLCFSASRCKGYLHAKGLGTGGEYLSYVWLLLLYMGMETLAEKMQRTELYEGSTAAALSISGQNV

SEQ ID NO: 1398 - protein, 501 aa, Glycine max
MISFAGLIGDGAPLISLSSGKSTNVSAVHSIKSVNMVHTGARKNGFSHWIKSGNPFQQKLPTSNEGRGYSQPNGSVCGEFDGSSTNNFHDDKTPRKNDINQMNGANSVSEDENEDLLADFIDEDSQLPSRSSKPHHSRALSSHVNDEENTTQTGSSLCLLKSMDKYARLMQKLEVVNVEFFKGVCQLFGFFFYFIYETFGQQNASSTGKGTSSSLNYRLRTALSRVNQDCEEWIKSQSSSPTSLSSPFVHAELTPTHPPNTNYGHSSGTSLGLKERCVAVDTISLVARILNRSKAHLQSMLLQSNSTILEDFYVHLVDAVPDLTEHVHRTTVRLLLHINGYVERVANCKWEVKELGMEHNGYVDLMLGEFKHYKTRLAHGGIRKEVQDLLLDYGLEIVAETLVEGLSRVKRCSDEGRALMSLDLQVLINGLHHFVSLNVKPKLQMVETFIKAYYLPETEYVHWARAHPEYSKSQVVGLVNLVATMKGWKRKTRLDILEKIE

SEQ ID NO: 1399 - protein, 165 aa, Glycine max
MSPALTTLSPPLSLSVTSAARRPRLTAMVKTEKKQSLGFGSDKKETKWHCVEGCGSCCKLQKGPSFPSPEEIFDDPSDVQLYKSLIGPDGWCIHYEKSTRKCSIYPERPYFCRVEPEVFKSLFGVKEKNFHKEACSFCRDTIKSIYGPNSKELHNFNSSIRNSSS

SEQ ID NO: 1400 - protein, 433 aa, Glycine max
MGGKSSKGSGRRYDFGASSSSRDNNYGGYHPQSPYPSYQTPQHPRASAPFYDYAQPKRKLDKKYSRIADNYRSLDEVTAALANAGLESSNLIVGIDFTKSNEWTGKRSFNRKSLHDIRSGQNPYEQAISIIGKTLSAFDEDNLIPCFGFGDASTHDQDVFSFYSEERFCNGFEEVLTRYRQIIPSLKLAGPTSFAPIIEMAMTIVEQSGGQYHVLLIIADGQVTRSVDTQNGNLSPQEQNTIDAIVKASEYPLSIVLVGVGDGPWEMMREFDDNIPSRAFDNFQFVNFTEIMTRNVDSTRKETDFALSALMEIPSQYKATLELGILGSRRGHSPDRVALPPPLYSRTSSSISTKSTRSNSFQQRTPTHTSYDSSVHTETSSSSLYDNKVCPICLTNAKDMAFGCGHQTCCECGEDLQFCPICRSTIHTRIRLY

SEQ ID NO: 1401 - protein, 406 aa, Glycine max
MDTDATGDPVDKLKAIQNDDVEYQDEDDDFDDEEEEEDDPITLGFVDKPKNEWSLRRQYFPSKTGGVPAWLDPLNIPSGRSSVCDICGDPLQLLLQVYAPTDKETTFHRMLFVFMCPSMKCLLRDQHEQWKRHPEKPSRSVKVFRCQLPRINPFYSPECPQYNESHEPAGSGAALCDWCGTWKGDKLCSSCRQARYCSEKHQAMSWRTGHKTACQQTKVSSPVFGPNKSGTTSLESHKVGSKNLWPEFEISIEDESEYNRDISEENSLANSLISRNRNDDTMNSLMDNFKGDDDKKSWASFQERIAEAPEQVLRYYRNTNAKPIWPVSSGRPSNADIPKCSYCSGPMSCEFQILPQLLYYFGVDNEVDSLDWASIVVYACEASCEASLPYKNEFAWVQIYSLSTTL

SEQ ID NO: 1402 - protein, 577 aa, Zea mays
MPDWRVREFEGKFTDEFAHSNNNKHESGVEAPGVTSSKKLKHTVAGEKIQGVIPGINSSDPQKCNSENIQHENRIVSQNINSAGDCIGDCKDSSNAFSSREENTIAETRCPTDDWNSCQFALSNGSSILNNHSAPQDSLTYGDNDLNYIDWPGIDNFEDVDTLFRRSDFTYDPQQLENTDGLSWLPSSDAVYSSDVALQQGFDSSYSDYDILDDLSAFQCAEDKSLPSVGPSSDLCDNQFNDTYLFSEQKNANAYGEQIYQEDVMELLPTDQICSGHENIDMLQGGNQYSSEHTIQGIEDKKFSIASTSQLSSSQNLLKQRHHLDSNSPSNITYEAYEEKFGPSSGSFAQRNLKVQKKTMNMQPTQPINDNVMNRHPQTLTRSASYPCENNESERRGLGKRTLGDPQVTMGTSMVVDGSFVSSMSSDISVEESSFRQLQNAVSQLDVQTKLCIRDGLYRLARSAQHRQVIPNMMSSNEDNPDIKDLQNAETLRKFVDPRSIETQTNPIDRSIALLLFHQSSDHAAVAVDDASSLKPPAGSKHHQGPAANQNQGLIPDSSVYSPGDGAPKDVQSLDKF

SEQ ID NO: 1403 - protein, 450 aa, Zea mays
MVAMVTTHIILLLQHLYQMLLVEGDTIMPIDPTQGAFIADTLSPNSFLFGPRPEWFRSSEGTGSFPSPAASPQPSRGVPGSYDQNNFPMASRMSSPHQKPFYGLRSTTDSYGRGFSHGGMFPQASNYGGSVTSFGLNGRSLISTEKGRRRGRGNALICSCNGPLDFLNEQSRGPRATKPKKQPEVDSKDEVPTTGVGRELYNKPDFVMEYTNARFFIIKSYSEDNVHKSVKYGVWASTTNGNKKLDSAYREAKEKGEHCPIFLLFSVNASAQFCGVAEMIGPVDFEKSVDYWQQDKWTGQFPVKWHIVKDVPNNLFRHIILENNDNKPVTNSRDTQEVKLEQGMEMLKIFKNHDDDASILDDFEFYEEREKALQENKARLHQQHLPSSIVIEPKKPLTAPSDLVGHITKSFAEAVRLGEAKTVSHLTEKVSGGDPSIPVKHVEVKQSGLS

SEQ ID NO: 1404 - protein, 171 aa, Zea mays
MAMKRPARSDPHLPPEEAARVEAEVRSYFDSVAPRRPAKPPRSDPSVDTFAEPAAVDAGDHDLPELRKLRDLEAKPQKLVLDGGGGDVDGGEDYVETRYYDGLIGIDKQHHTTGTGFIKVERSNGSSFSVMTNGYPPASSVRCTSNPATNDWIPSSESIIPASNKPSRSDS

SEQ ID NO: 1405 - protein, 156 aa, Zea mays
MGGFSLSGATGLAAYREEDDEELFETSSSISGDSDDEGHQLSDGEGGAYDLSSVMAQLPVKKGLSRYYDGKSQSFACMSEVRCLEDLRKKETPYKKIKTSRSSVALDEEQDCHTPGRTNSSRAPGSCCANLVARNNGKNMLYRPPPVPVNKSGYRQ

SEQ ID NO: 1406 - protein, 305 aa, Zea mays
MAMQAARRLASLKLQRPLLLPSQAESPSISIPTAAAAAAFLHSHATSFGYKQVREEDKSKLVGNVFSSVASSYDLMNDLMSVGLHRLWKDRLISKLNPFSGMKHLDVAGGTGDVAFRVLERVKSVGHRAMQGTLTETEEGTHIYVCDINPNMLNVGKKRAAERGYSEEHCLSWIQGDAEALSFEDGSMDGYTIAFGIRNVTHIEKALSEAYRVLKQGGRFLCLELSHVDVPIFKEIYDVYSFSMVPAIGELVAGDRQSYQYLVESIRRFPNQEKFAQMIQEAGFQRVEYENLVGGVVAIHSGLKL

SEQ ID NO: 1407 - protein, 220 aa, Zea mays
MASATGVSSSEMAVDHATGPGAVDKPRFDALTPNEMSGGRPQFRKVPVPQHRFAPLKRCWMEIYTPVYEHMKIDIRMNLKARRVELKTRQDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 1408 - protein, 267 aa, Zea mays
MYSNYGNPSGMQMPPQNSQPVQFDNPLYGASSGLIRSGIGVYGEKFLGSSSEFMQSNINRYFSNPQYYFHVNDQYVRNKLKVILFPFFHRGHWTRISEPVGGRLSYKPPIYDINAPDLYIPFMAFGSFIILSGFTLGFMGKFTPAAINLQFTRALIGWGFQLMVLKGLLYSMGGGEVPLLDLVAYGGYLFAGLSLAVVARLVWAYSYYVMMPWMSLCMGVFLVRTMKRVLFTEMRSSERHSSRQHYFLLFMAIAQFPLFFWLGSIGA

SEQ ID NO: 1409 - protein, 425 aa, Zea mays
MPSITHYVLDRLLETRSPVHVQKVVPKPPPPPPDKATPVPVSTARTRSSLASLYATPENTTLPDLPSSFPGTWSPYLINHKRRGASLARTFSQGDAGREVSQPNLPVMLPALPRGCEPTQVQEPEFVFQQAGNGQAEGESAVEEALNGKSVMLQKGKGSVIAEIEQEQPEFEFCQSLEALVKPVNVRRPLNGEAPKICESDTFEWRKPSSPLGTSVGTPGAEFYDAFEEISSDGGTRSSRGMDDDLREMRLSLLMEIERRTQTEEALEIWQQEWKNLSHHLSLVALSLPSPSIAEDSDCLKVDPGAELCQQITVSQLVAAAIARGFARAEVESEMETMIATKNFEIGRLSDRVQYYEAANREMSQRNQEAIEMSRQQRKGRKKRQKWFWASVGLAVTLGATAIAWSYVTPSQPQASADPSSAASQ

SEQ ID NO: 1410 - protein, 156 aa, Arabidopsis thaliana
MDALIAQLQRQFRDYTISLYQQGFLDDQFTELKKLQDDGSPDFVSEVLSLFFEDCVKLISNMARALDTTGTVDFSQVGASVHQLKGSSSSVGAKRVKTLCVSFKECCEAKNYEGCVRCLQQVDIEYKALKTKLQDMFNLEKQIIQAGGIVPQVDIN

SEQ ID NO: 1411 - protein, 846 aa, Arabidopsis thaliana
MVSSIIAVAEGKKMELEPNKSLSADMPSLLSRSSEAFNGGTGYRSSSDLSMFSSSLPTLFHEKLNMTDSDSWLSFDESSPNLNKLVIGNSEKDSLEDVEPDALEILLPEDENELLPGVIDELNFTGLPDELDDLEECDVFCTGGGMELDVESQDNHAVDASGMQISDRGAANAFVPRKRPNTAGRVSVEHPNGEHPSRTLFVRNINSSVEDSELSALLSRLGRSEVCTLHVKSRGFVMISYYDIPSCSMPANAVALTRNTLLRKRTLDIHFSIPKENPSEKDMNQGTLVIFNVDTTVSNDELLQLFGAYGEIREIRETPNRRFHRFIEYYDVRDEETALKALNRSEIGGKCIKLELSRPGGARRLSVPSQSQDLERTEVTNFYNQVGSHVANSPPGNWPIGSPVKGSPSHAFTRPHGLGMVRPVNSDNMPGLASILPAHPSSFHGFSPVSNDQGLLNHSNQTILNKGLMHNISYGQPHSLPEHITGGISNSMRFIAPHSSGFGTSSDHRYRWGSPPQHMNYPGYTGVSSSSSSTERPFTVRHGFPFAERQASLLGKYQHHVGSAPSSIHFNTQMNCYTGSPEIPLGFSDMGINRNYNSAHGKANLGVSLPGNSSEQDFTGFGMSSMPTVPFGGSRGLQSVRPEPFAEQGRIHNHESHNQNQFIDGGRYHIDLDRIASGDEIRTTLIIKNIPNKYTYKMLVAEIDEKHKGDYDFLCLPTDFKNKCNMGHAFINMVSPLHIVPFQQTFNGKIWEKFNSGKVASLAYAEIQGKSALASYMQTPSSMKEQKQLFPEVSYHDDGQDANDHEQLFSSIWNITAPDSDWSYTMDLIENPRENGNSKNAAEESS

SEQ ID NO: 1412 - protein, 719 aa, Zea mays
MAPPALDSLPAPLRSLRLKTKQQELLLRVSALALIYVLAFAVRLFSVLRYESMIHEFDPYFNYRTTLFLTENGFSEFWNWFDFESWYPLGRVVGGTLYPGLMVTAALLHRLLRALYLTVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLVPLYVLVLLVTGRYSQRLYVAYNCMYVLGMLLAMQIRFVGFQHVQSGEHMAAMGVFFLLQVFFFLDWVKYLLNDARLFKSFLRITLTCVITIGTLALGLGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRTKSKSPQTTGKTTGSKAGAKGAVDQSLPFQHNAAIALLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 1413 - protein, 721 aa, Arabidopsis thaliana
MAKKIGVTMEVGNDGVAVITISNPPVNSLASPIISGLKEKFRDANQRNDVKAIVLIGNNGRFSGGFDINVFQQVHKTGDLSLMPEVSVELVCNLMEDSRKPVVAAVEGLALGGGLELAMACHARVAAPKAQLGLPELTLGVIPGFGGTQRLPRLVGLAKATDMILLSKSISSEEGHKLGLIDALVPPGDVLSTSRKWALDIAEGRKPFLQSLHRTDKIGSLSEARAILKNSRQLAKKIAPNMPQHHACIEVIEEGIIHGGYSGVLKEAEVFKQLVLSDTAKGLVHVFFAQRATSKVPNVTDVGLKPRPIKKVAVIGGGLMGSGIATALLLSNIRVVLKEINSEFLMKGIKSVEANMKSLVSRGKLTQDKAGKALSLFKGVLDYTEFNDVDMVIEAVIENIQLKQNIFKEIEKVCSPHCILASNTSTIDLDVIGEKTNSKDRIVGAHFFSPAHLMPLLEIVRSKNTSAQVILDLMAVGKAIKKVPVVVGNCIGFAVNRTFFPYSQAAHMLANLGVDLFRIDSVITSFGLPLGPFQLGDLAGHGIGLAVGPIYAKVYGDRMFRSPMTELLLKSGRNGKINGRGYYIYEKGSKPKPDPSVLSIVEKSRKLTNIMPGGKPISVTDKEIVEMILFPVVNEACRVLDEGVVIRASDLDIASVLGMSFPSYRGGIVFWADTVGPKYIYERLKKLSETYGSFFKPSRYLEERAMNGMLLSESKSSRSKL

SEQ ID NO: 1414 - protein, 719 aa, Arabidopsis thaliana
MILLSLLLHLLLHLLNTSPSLSLSPDGIALLSLKSAVDHSSSSAFSDWNDNDTDPCHWSGISCMNISDSSTSRVVGISLAGKHLRGYIPSELGSLIYLRRLNLHNNELYGSIPTQLFNATSLHSIFLYGNNLSGTLPPSICKLPKLQNLDLSMNSLSGTLSPDLNKCKQLQRLILSANNFSGEIPGDIWPELTNLAQLDLSANEFSGEIPKDIGELKSLSGTLNLSFNHLSGQIPNSLGNLPVTVSLDLRNNDFSGEIPQSGSFSNQGPTAFLNNPKLCGFPLQKTCKDTDENSPGTRKSPENNADSRRGLSTGLIVLISVADAASVAFIGLVLVYLYWKKKDSEGGCSCTGNAKLGGGSVKGKSCCCITGFPKEDDSEAEGNERGEGKGDGELVAIDKGFSFELDELLRASAYVLGKSGLGIVYKVVLGNGVPVAVRRLGEGGEQRYKEFVTEVQAMGKVKHPNVVKLRAYYWAPDEKLLISDFVNNGSLADALRGRNGQPSPSLTWSTRIKIAKGAARGLAYLHECSPRKLVHGDVKPSNILLDSSFTPYISDFGLTRLITITAASASSNEPSSSSAAGGFLGGALPYTSIKPSDRSNGYKAPEARLPGGRPTQKWDVYSFGVVLMELLTGKSPDSSPLSSSSTSTVVVEVPDLVKWVRKGFEEETPLSDMVDPMLLQEVHAKQQVLSVFHLALACTEGDPEVRPRMKNVSENIDKI

SEQ ID NO: 1415 - protein, 228 aa, Glycine max
MRKSKADEKILSYNDVVLRRSDLHILSGPYFLNDRIIEFYFSYLSSCHPSQDILLVPPSIAFWIIQCPVAEALGDFIEPLHLPDKTLVIFPVNDNDDVDRAEGGSHWSLLAYYRNANLFVHHDSCRSMNAAPAKQLYKGIAGYMGSSGSASEASFLECTNSPMQDNGYDCGLYATAIARVICNWHVNHKNADTNDLWFSAVKEQVSPSAVASMRGEILALIRDLMARH

SEQ ID NO: 1416 - protein, 181 aa, Zea mays
MGDYTIQISTKLIDQLARDDEKVKRKARKPKPKKKPTVQPHEEPLEFPREPKTTSLATAPGWPLQPPPMFLPVTPAPPPPPATMPEVEAIRSVLKESEALLKKLENQETGARQELSKRAKELHDKEFKLPYQKPMPCTQERAGCLECYKTNTKDPLKCAEAVKRFEACALMAIKSTAAKAD

SEQ ID NO: 1417 - protein, 775 aa, Arabidopsis thaliana
MEQLKVLPLLFLSWVMFLQSTHQLPNSQTQVLYQLRKHLEFPKALESWGNYYGDLCQIPATAHMSITCQGNSITELKVMGDKLFKPFGMFDGSSLPNHTLSEAFIIDSFVTTLTRLTSLRVLSLVSLGIYGEFPGKIHRLNSLEYLDLSSNFLFGSVPPDISRLVMLQSLMLDGNYFNGSVPDTLDSLTNLTVLSLKNNRFKGPFPSSICRIGRLTNLALSHNEISGKLPDLSKLSHLHMLDLRENHLDSELPVMPIRLVTVLLSKNSFSGEIPRRFGGLSQLQHLDLSFNHLTGTPSRFLFSLPNISYLDLASNKLSGKLPLNLTCGGKLGFVDLSNNRLIGTPPRCLAGASGERVVKLGGNCLSIIGSHDQHQEFLCEEAETEGKQFQGRKVGILIAVIGGAVLVLVFFVLVILLLLCTNRCSSCCSREKSVPQTRLKVVTDNSHTSLSSEVLASARLISQTAKLGAQGVPSCRSFSFEDLKEATDDFDSSRFLGEGSLGKLYRGTLENGSSIAIRCLVLSRKFSSQSIRGHLDWMAKLNHPHLLGFLGHCTQTSGEHDPVATILYLVYEYMPNGSYRTHLSESFSEKILTWPDRLAILIEIAKAVHFLHTGVMPGSFNNQLKTNNILLDEHKIAKLSDYGVSAIIEENEKLETKSETHKSKKKAKREDDVYNFGFILLESLIGPVPTTKGEAFLLNEMTSFGSQDGRQKIVSPTVLTTSSQESLSIAISIANKCVLLEPSARPSFEDVLWNLQYAAQMQSAADAERKSDTSS

SEQ ID NO: 1418 - protein, 747 aa, Glycine max
MSVDGDSKELKELNQRLRDGKKIAGGEHGLCEEVKCNGIAEEVKVEQGGTVESSSVQQHIPQPQGAIICWERFLHIRSLKVLLVEIDDSTRHVVTALLRNCSYEVIEAANGLQAWKILEDLTNHIDLVLTEVAMPGLSGIGLLYKIMGHKTRKNIPVVMMSSHDSMGLVFKCLSKGAVDFLVKPIRKNELKNLWQHVWRRCHSSSGSGSESGTQTQKSIKSKSLEKSDNNSGSNDEDDNESIGLNNVDGSDNGSGTQSSWTKRAVEVDSHKPVSQWDQIAECPDSTCAQVVHSNAEMGGNKVVPLAAKDCAEQNEQLVKTAGSQHSNAPDVGPSKFSEQINRGQLDLNCENQSSKLRCKGLSLSDAITSTCDSQMHSGEFEALNKKPKSSDIENKGTNNDEELPSLELSLKRLRGVEDADITIQDDRNVLRRSDQSAFSRYNAASNTKKSPTGCVGSNSPYNNSLEVTKKDSSRDIQSHSCGNPPNQNSNGASNNIDMGSTTNNAYAKSAVMSEPAGASTTKCLYQTSAFQPVKNSLVCTSQQVVLNNTEDMSATILAPPKLDRHKDSAALDFHLHCENHNCIADNMKHQLPPDHDAESIKKMATAAPHCGSSNVEEVLVEGNVGNHSINRSVSGSNNGSNGQNGSSTAVNAGGTNTESNNGLTGNSGSGDASGSGSANRVDQNKTSQREVALTKFRQKRKERRERCFHKKVRYQSRKRLAEQRPRFRGQFVRQTSNENASEATTDS

SEQ ID NO: 1419 - protein, 316 aa, Glycine max
MGGGGAMRSAAKIAGIGVSKAALRPSALPTEQTVRNASRPTAVSGVSSQSAKSAEVAPLHTAAAWDDWDFAEDGELVVPRMVFGSVPTLDEAKEATAELKDAIDQVYLCPETSQYSSPGGQVSALSPTLYGPVNRSCVIDAISDPTAPKHAIQAFHLLSTSREAQAVVASLACDPNVWNAVMENSAVSSFFQSQQSVAGFGAAENSEEVDKLSSCASETVESPEKLEGSAESHPGNMFDDFMGLLQNVKLTVIELVSRLSGFLQNIFPTPDAMREKMSFDADGNTKASFMDSKISMGGTFIGLAVLVIMVIVTKRA

SEQ ID NO: 1420 - protein, 468 aa, Glycine max
MPLLDRGDVWKSKARSLQLQLRDRFRVAVDRHWRRRHNHHTFIPSADGYFSSTIQRWLSRFRDFRRDSLPSSTSFYRKRVIKDFSSEEDSTLVRMMQAVAVPVLGNVCHVFMNGLNSVQVYGLEKLHSALLQRPKGKPLLTVSNHVASMDDPLVIASLLPPSVLLDARNLRWTLCATDRCFKNPVTSAFFRSVKVLPVSRGDGIYQEGMDLAISKLNHGGWVHIFPEGSRSRDGGKTMGSSKRGVGRLVLDGDSMPLVVPFVHTGMQEIMPVGANFPRIGKMVTVLIGDPINFDDIIEFDKDKGSNVPRRRLYDAVASRIGDRLHEMKVQVDTIAIDQEMQLQDKSSHSTERTSKILQQVDWELFGMDSFMSVEDDSKQRQETVALSNVSVSQHHQQSHSDQSWRAGFSYRMRGYIDQMELVSFAARGIFLNNDTKNSARPSREMGPLKAWKQFLEANLLRQWNYVHY

SEQ ID NO: 1421 - protein, 465 aa, Arabidopsis thaliana
MATSHPDPTTSRHVAVIGAGAAGLVAARELRREGHSVVVLERGSQIGGVWAYTSQVEPDPLSLDPTRPVVHSSLYRSLRTNIPRECMGFTDFPFATRPHDGSRDPRRHPAHTEVLAYLRDFAKEFDIEEMVRFETEVVKAEQVAAEGEERGKWRVESRSSDGVVDEIYDAVVVCNGHYTEPRHALITGIDSWPGKQIHSHNYRVPDQFKDQVVIVIGSSASGVDICRDIAQVAKEVHVSSRSTSPDTYEKLTGYENLWLHSTIQIAREDGSVVFENGKTIYADTIMHCTGYKYYFPFLDTKGEVTVDDNRVGPLYKHVFPPALAPSLSFIGLPWQITPFPMFELQSKWVAAVLSGRVSLPSQDEMMEDTKAFYDKLEASGIPKRYTHLMPDDSQFEYDNWLADQCEYPRIEKWREQMFYIGFKRIYAQSSTYRDNWDDDHLIVEAYDDFVKFMSSYQELLPMLKT

SEQ ID NO: 1422 - protein, 468 aa, Arabidopsis thaliana
MTSVITSRARHVAVIGLGAAGLVAVRELRREGHTVIGFEREKHVGGLWVYTDRVDSDSVSVDPDRTIVHSSIYQSLRTNLPRECMGYSDFPFVTRSSDGDPRRYPDHREVLMYLQDFAKEFKIEDMIRFETEVLCVEPSPENNRKWRVQFKSSNGVSGEEIFDAVVVCNGHFTEPRLAHIPGIESWPGKQIHSHNYRIPDPFKDEVVIVIGSQASGNDISTDIATIAKEVHISSKMVASDSYGCYDNLRIHPTIYRAREDGSVVFRNGKVVFADAIVHCTGYKYHFPFLKTSGYVTVEDNRVGPLYKHVFPPALAPGISFIGLPFMGLQFFMFEIQSKWVASVLSGRVKLPAEDKMMEEAVAFYSKLEDLGIPKRYTHFLTDPRGNPMLGTFKPEDAVVISQSDYFNWIAKQCGCTSIERWRERLYNVAIKKVFFGGDSYRDRWDDDQLIEEVYREFAKLKPNQDCSS

SEQ ID NO: 1423 - protein, 153 aa, Arabidopsis thaliana
MSTKKIILKSSDGHSFEVEEEAARQCQIIIAHMSENDCTDNGIPLPNVTGKILAMVIEYCNKHHVDAANPCSDDDLKKWDKEFMEKDTSTIFDLIKAANYLNIKSLFDLACQTVAEIIKGNTPEQIREFFNIENDLTPEEEAAIRRENKWAFE

SEQ ID NO: 1424 - protein, 480 aa, Arabidopsis thaliana
MSSSSESHLATAKTALTAVASVAAAAILARSVVQDYMPNEVHEYISHGFRRFFSYFSYQMTAVIEEFGGFEHNQVFEAAEAYLSTKISNSTRRIKVNKLEKQSNYSVTVERDEEVVDIFDGVKLSWILVCRHVDKKDFRNPRDLNSTLKSEVRSYELSFRKKFKNMVLESYLPFVVEQAASIKQKFKTLKIFTVDSYSVEWTSVTLDHPSTFRTLALDPEVKKNLVEDLDRFVQRKGFYGRVGKAWKRGYLLYGPPGTGKSSLIAAIANHLNFDIYDLDLTSLNNNAELRRLLMSTANRSILVVEDIDCSIELKDRSTDQENNDPLHKTVMHFDSLSVMLLCDLLLISITNVLVSHFQVTLSGLLNFVDGLWSSCGNERIIVFTTNYREKLDPALLRPGRMDMHIHMSYCTPAAFKVLASNYLEIQDHILFEQIEEFIREIEVTPAEVAEQLMRSDSVDKVLQGLVEFLKAKKQIDNSKA

SEQ ID NO: 1425 - protein, 192 aa, Arabidopsis thaliana
MGCVCSKQLEGRRQEDISLLASQTFFSEAEVEVLHGLFIKLTSCLSNDNLLTKEKFQFILIKNTKKRSLSAERIFGLFDMRNDGAIDFGEFVHTLNIFHPNSSPRDKAIFAFRLYDTRETGFIEPEEVKEMIIDVLEESELMLSESIIDSIVSKTFEEADWKKDGIIDLEEWENFVATYPLTLKNMTIPFLK

SEQ ID NO: 1426 - protein, 269 aa, Arabidopsis thaliana
MIQTGEEDEEKATSLEVEFASGNGVDDEEELRLQWATVERLPTFKRVTTALLARDEVSGKGRVIDVTRLEGAERRLLIEMLVKQIEDDNLRLLRKIRKRIDKVGIELPTVEVRFNNLSVEAECQVIHGKPIPTLWNTIKGLLSEFICSKKETKIGILKGVSGIVRPGRMTLLLGPPGCGKTTLLQALSGKFSDSVKVGGEVCYNGCSLSEFIPEKTSSYISQNDLHIPELSVRETLDFSACCQGIGSRMEIMKEISRMEKLQEIIPDPA

SEQ ID NO: 1427 - protein, 345 aa, Arabidopsis thaliana
MAKVVVYTILTATIIFLILLAHKKQNQTQSIEGLITRRIGRRLEMPVFDPLVTRIERLSHEKEAGTKTVEAAKEEKDDMFEEYFAQERRLNTTMRIKFLFPLLDASPRDGFVSLKELQTWMMQQTEDNMVYRTAKELELQDKDKDGVITFEEYLPQFSKQDIEKNEKGHGEAGWWMEQFKNSDFDHNGSLDIEEFNNFLHPEDSRNGDTQRWVLKERMTGMDTNGDGKLEYKEFVKNAYEMYKEFAKFEKEEDENVPTPQLLFAEMDRDKDRFLVADELRPILQYLQPGEMSYAKFYSTFLCHEADEDKDGKLSLEEMLHHEDVFYKAVHHEDLDDEDYFDHDEL

SEQ ID NO: 1428 - protein, 404 aa, Arabidopsis thaliana
MAKRRSWFGWMKRLFICEAKARAEKKPRRLRWVFKRLKLRPQLATCGQETRTLNEATQDQRKHAMNVAIATAAAAEAAVAAAKAAAEVVRMAGNAFTSQHFVKKLAPNVAAIKIQSAFRASLARKALRALKALVRLQAIVRGRAVRRKVSALLKSSHSNKASTSNIIQRQTERKHWSNTKSEIKEELQVSNHSLCNSKVKCNGWDSSALTKEDIKAIWLRKQEGVIKRDRMLKYSRSQRERRSPHMLVESLYAKDMGMRSCRLEHWGESKSAKSINSFLIPSEMLVPTKVKLRSLQRQDSGDGQDSPFSFPRRSFSRLEQSILEDESWFQRSNGFQPYMSVTESAREKMRSLSTPRQRVGIMDSLFDNYKKDGDKVSLWSTFVCENSKINNAKKSSLTTYQHNC

SEQ ID NO: 1429 - protein, 460 aa, Arabidopsis thaliana
MVTFTSEASRSRSKKVCVIGAGPAGLVSARELRKEGHKVVVLEQNEDVGGQWFYQPNVEEEDPLGRSSGSINGELKVHSSIYSSLRLTSPREIMGYSDFPFLAKKGRDMRRFPGHKELWLYLKDFSEAFGLREMIRFNVRVEFVGEKEEEDDVKKWIVRSREKFSGKVMEEIFDAVVVATGHYSHPRLPSIKGMDSWKRKQIHSHVYRVPDPFRNEVVVVVGNSMSGQDISMELVEVAKEVHLSAKTLDISSGLSKVISKHPNLLIHPQIESLEDDGKVIFVDGSWVVADTILYCTGYSYKFPFLESKGRIEVDDDRVGPLFEHTFPPCLSPSLSFVGIPRKLIGFPFFEAQAKWIAQVLSGKSSLPSPDQMLQSVDEFYRSRDLAGVPKHNTHDIADFTYCDKYADYVGFPHLEDWRKLLCLSALNNSQENLETYRDSWDDHELLQEALQSSHFTNFNS

SEQ ID NO: 1430 - protein, 391 aa, Arabidopsis thaliana
MSKASVILYITVGILVLFLVSYSPKKKGDHDHHHGGHNQHHRLKLRSSFNFKPTRHDPVPFDPLVADMERRREDKEWERQYIEHSHPELVSHSQKETTGGGHEHAPGHESQPEWEEFMDAEDYLNDEEKFNVTDRLILLFPKIDVSPADGFMTESELTEWTMQSSAKEVVHRTQRDLDVHDRNKDGFISFSEYEPPSWVRKSDNNSFGYDMGWWKEEHFNASDANGDGLLNLTEFNDFLHPADTKNPKLLLWLCKEEVRERDSDKDGKISFEEFFHGLFDTVRNYEEDNHNSTHPYHDLPEGPAKQLFSQLDKNDDGYLSDVELLPIISKIHPTEHYYAKQQADYIISQADSDKDRRLTLAEMIEHPYVFYSAIFDEDDTDDDYGFHDEFR

SEQ ID NO: 1431 - protein, 408 aa, Arabidopsis thaliana
MGKKKGKAIIVGGSIAGLSCAHSLTLACWDVLVLEKSSEPPVGSPTGAGLGLDPQARQIIKSWLTTPQLLDEITLPLSIDQNQTTDSEKKVTRILTRDEDFDFRAAYWSDIQSLLYNALPQTMFLWGHKFLSFTMSQDESNVKVKTLVVETQETVEIEGDLLIAADGCLSSIRKTFLPDFKLRYSGYCAWRGVFDFSGNENSETVSGIKKVYPDLGKCLYFDLGEQTHSVFYELFNKKLNWIWYVNQPEPDLKSNSVTLKVSQEMINKMHQEAETIWIPELARLMSETKDPFLNVIYDSDPLERIFWGNIVLVGDAAHPTTPHGLRSTNMSILDAEVLGKCLENCGPENVSLGLEEYQRIRLPVVSEQVLYARRLGRIKQGLDHDGIGDGVFGLEQRNMPFFSCAPLI

SEQ ID NO: 1432 - protein, 264 aa, Arabidopsis thaliana
MLRLSNAAVITTNAILALIGLAALSFSVYVYVQGPSQCQRFVQNPLIVTAALLFFISSLGLIAALYGSHIIITLYLFFLFLSILLLLVLSVFIFLVTNPTAGKALSGRGIGNVKTGDYQNWIGNHFLRGKNWEGITKCLSDSRVCKRFGPRDIDFDSKHLSNVQFGCCRPPVECGFESKNATWWTVPATATTAIIGDCKAWSNTQRQLCYACESCKIGVLKGIRKRWRILIVVNLLLILLVVFLYSCGCCVRKNNRVPWKRRFF

SEQ ID NO: 1433 - protein, 499 aa, Arabidopsis thaliana
MVVEEQSLENGGSVHVVKGESNFRNVVCGPVRWLKMLSSELHWSFVFGVVSLYGINQGLGGSLGRVATEYYMKDVQKVQPSESQALTAITKIPWIIKPLWGILTDVLPIFGFHRRPYFILAGVLGVVSLLFISLHSNLHLYLALFWMTISSAAMAIADVTIDACTAYNSIKHPSLASDMQSLCSLSSSIGALLGFFMSGILVHLVGSKGVFGLLTFPFALVSVVGIVFSEPHVPGFSYKQVNQKFTDAGKAMWRTMKCSDVWRPSLYMYISLTLGLNIHEGLFYWFTDSKDGPLFAQETVGFILSIGSIGSILAATLYQLVLKDHPFRGLCLWTQLLFALSGMLDLILVFRLNLKFGLPDYLFIVVDEIVSQMIGRLKWMPLLVLTSKLCPHGIEGTFFALLMSIDNAGLMTSSWLGGIMLHVLKVTRTEFGNLWLAVLVRNVMRLLPLCFLFLVPKGDQNTFKLPDEIMGEDSDEEKDEKEGTRNLELASLVHSVDRR

SEQ ID NO: 1434 - protein, 446 aa, Arabidopsis thaliana
MSEFDKHVQNHIKNEKPFNSIKPSEIDSTLSLSDSLLLKIIEKLPESQSNDVSLVCKRWLNLQGQRLRSLKLLDFDFLLSERLTTRFPNLTHVDLVNACMNPRVNSGILFCHKSISFHLSSDSSNWEFLEENLLHSDVIDRGLRILSRESFDLLNLKVINASELGLLSLAGDCSDLQELELHKCNDNLLHGIAACKNLKGLRLVGSVDGLYSSSVSDIGLTFLAQGCRSLVKLELSGCEGSFDGIKAIGQCCEVLEELSICDHRMDDGWIAALSYFESLKILRISSCRKIDASPGPEKLLRSCPAMESLQLKRCCLNDKEGIKALFKVCDGATEVNIQDCWGLSDDCFSLAKAFRRVRFLSLEGCSVLTSGGLESVILHWEELESMRVVSCKSIKDSEISPALSSLFSLLKELTWRPDTRSHLSSSLEGAGIGIRGSKFFKKSVLH

SEQ ID NO: 1435 - protein, 513 aa, Arabidopsis thaliana
MDIISGQALLLLFCFILSCFLIFTTTRSGRISRGATALPPGPPRLPIIGNIHLVGKHPHRSFAELSKTYGPVMSLKLGSLNTVVIASPEAAREVLRTHDQILSARSPTNAVRSINHQDASLVWLPSSSARWRLLRRLSVTQLLSPQRIEATKALRMNKVKELVSFISESSDREESVDISRVAFITTLNIISNILFSVDLGSYNAKASINGVQDTVISVMDAAGTPDAANYFPFLRFLDLQGNVKTFKVCTERLVRVFRGFIDAKIAEKSSQNNPKDVSKNDFVDNLLDYKGDESELSISDIEHLLLDMFTAGTDTSSSTLEWAMTELLKNPKTMAKAQAEIDCVIGQNGIVEESDISKLPYLQAVVKETFRLHTPVPLLIPRKAESDAEILGFMVLKDTQVLVNVWAIGRDPSVWDNPSQFEPERFLGKDMDVRGRDYELTPFGAGRRICPGMPLAMKTVSLMLASLLYSFDWKLPKGVLSEDLDMDETFGLTLHKTNPLHAVPVKKRANNLN

SEQ ID NO: 1436 - protein, 354 aa, Arabidopsis thaliana
MNRGSLCPNPICLPPLEQSISKFLTQSGTFKDGDLRVNKDGIQTVSLSEPGAPPPIEPLDNQLSLADLEVIKVIGKGSSGNVQLVKHKLTQQFFALKVIQLNTEESTCRAISQELRINLSSQCPYLVSCYQSFYHNGLVSIILEFMDGGSLADLLKKVGKVPENMLSAICKRVLRGLCYIHHERRIIHRDLKPSNLLINHRGEVKITDFGVSKILTSTSSLANSFVGTYPYMSPERISGSLYSNKSDIWSLGLVLLECATGKFPYTPPEHKKGWSSVYELVDAIVENPPPCAPSNLFSPEFCSFISQCVQKDPRDRKSAKELLEHKFVKMFEDSDTNLSAYFTDAGSLIPPLAN

SEQ ID NO: 1437 - protein, 461 aa, Arabidopsis thaliana
MVLVITEPIKSQSKTVCVIGAGPSGLVSARELKKEGHKVVVMEQNHDVGGQWLYQPNVDEEDTLGKTKTLKVHSSVYSSLRLASPREVMGFSDFPFIAKEGRDSRRFPGHEELLLYLKDFCQVFGLREMIRFNVRVEFVGMVNEDDDDDDDVKKWMVKSVKKSGEVMEEVFDAVVVASGHYSYPRLPTIKGMDLWKRKQLHSHIYRVPEPFCDEVVVVVGCSMSGQDISIELVEVAKEVHLSTKSLDIPPGLSKVIEKHQNLHLHPQIESLEEDGRVIFEDGSCIVADTILYCTGYEYKFPFLESKGRVEIDDNRVGPLFEHTFSPSLSPFLSFVGIPRKLIGFPFFESQAKWIAKLLSGKTSLPSSDQMMQSISDFYLAREADGIPKRNTHDIADFNYSDKYADYIGFPHLEEWRKVLCLSAILNSIENLETYRDSWDDDDLLQETLQDPYFTQLSIPSV

SEQ ID NO: 1438 - protein, 538 aa, Arabidopsis thaliana
MINPLLSIQNSPTKFLKPPLSSIHRQQQQQERQSNNNTLFMGEARPRRATTFACLSIRRRRNNNGVSEFEETARFEQVGGKGISVLCGLGYWVQGSRCFPWLALNFHMVHSLALQPSTLQLVQYSCSLPMVAKPLYGVLSDVLYIGSGRRVPYIAIGVFLQVLAWGSMGIFQGAREVLPSLVACVLLSNLGASITEVAKDALVAEYGLRYRINGLQSYALMASAAGGVLGNLLGGYLLLTTPPKISFLVFSALLSLQLVVSLSSKEESFGLPRIAETSSVLESVKKQISNLKEAIQADEISQPLIWAVVSIAMVPLLSGSVFCYQTQVLNLDPSVIGMSKVIGQLMLLCLTVVYDRYLKTLPMRPLIHIIQLLYGLSILLDYILVKQINLGFGISNEVYVLCFSSLAEILAQFKILPFAVRLASMCPQGCEGSVTSFLASTLCLSQIVSAFLGVGLANLIGITSSNYSNLSSGILIQSLAALAPLCFMHLVPMSEPVIEKEGKRGISKRSRRNRRVGRVVDKESVTYRRERESEEAQR

SEQ ID NO: 1439 - protein, 306 aa, Arabidopsis thaliana
MRGMVSFAVWALFAALLSQQLFASVASVRFEDAKTYYLSPPSGSHGTPPSHTPPSSNCGSPPYDPSPSTPSHPSPPSHTPTPSTPSHTPTPHTPSHTPTPHTPPCNCGSPPSHPSTPSHPSTPSHPTPSHPPSGGYYSSPPPRTPVVVTPPSPIVDPGTPIIGGSPPTPIIDPGTPGTPFIPAPFPPITGTCDYWRNHPTLIWGLLGWWGTVGGAFGTVSIPSSIPGFDPHMNLLQALSNTRSDPIGALYREGTASWLNSMVNHKFPFTTPQVRDHFVAGLSSNKAATKQAHTFKLANEGRLKPRV

SEQ ID NO: 1440 - protein, 458 aa, Arabidopsis thaliana
  misc_feature (52)..(52): Xaa can be any naturally occurring amino acid
MAHCLNLKPSTLQLVQYTASLPMVAKPLYGVLSDVLYIGGARRVPYISVGGXFSFSNCPGKNGLFRIMLQMVQYSVVSVLLQGLAWGSLAIFPGAREVLPSLMAFILLSNLGASITEVSQDALVAEYGLRYQINGLQSYALMASAVGGILGNLLGGYCLLKTPPRILFLAFTALLSLQLIVSLSSKEESVNLPRIGEVTPEISSVLGIVKKQFLDLKGIVQVDEISQPLIWIVSSIALVPLLSGSVFCYQTQVLNLDPSVIGMSKVIGQLMLLCLTVVYDRYWKKLPMRALIHIVQLLYAFSLLFDYILVKQINLAFGISNTAFVLCFSSVAEILAQFKILPFSVLLANMCPGGCEGSITSFLASTLCLSSVVSGFTGVGMANMIGITSKNYSNLPAGILIQSLAALVPLWFIHYVPMLEPGFEREGKRAMSKKSRRNRRVGRVIGQESFAYRRERET

SEQ ID NO: 1441 - protein, 221 aa, Arabidopsis thaliana
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 1442 - protein, 434 aa, Arabidopsis thaliana
MGSLSGIIQRPLVAAAAVITASVSADVSERFSSLRSLVRGSESEQIAPSVSGLVQEERSLWVSQVSASKLADLSFVSRICVPVPNVDLLASNPSCSLATSVTSLSALRSVYQSAELAKASKPVAFTIGASLVVPDISYRWHLPEPSAVDMSGSSSCVSEKNRTVVVLLGWLGSKQKHLKKYADWYTSKGYHVITFTLPMNEIMSYQVGGKAEKNIESLVNHLADWLDEEQKKNLVFHTFSNTGWLTYGAILEKFQKQDSSLMGRVKGCIVDSAPVAAADPTVWASGFSAAFLKKSSVATKGSASSSYESNGINISQPKPAATETALLLVLEKFFAVILNLPKVNRRLADVLDTLSTAQPSCPQLYIYSSADRVIPVEQVESFIVEQRKAGHEVRACNFISSPHVDHFRSNPELYTAELNHFMNNFVLSCCHHSS

SEQ ID NO: 1443 - protein, 330 aa, Arabidopsis thaliana
MEFSSQDDDFGGDDSAANATRASGNRRSFGDLEDDEDDIFGSTTVAPGVRTGMILSLRGSLKNCKDDLASCQNELESAKTEIQKWKSAFQNESFVPAGKSPEPRFLIDYIQNLKSSEKSLKEQLEIAKRKEASCIVQYAKREQEMAELKSAVRDLKSQLKPASMQARRLLLDPAIHEEFSRLKNLVEEKDKKIKELQDNIAAVTFTPQSKNGKMLMAKCRTLQEENEEIGHQAAEGKIHELAIKLAMQKSQNAELRSQFEGLYKHMEELTNDVERSNETVIILQEKLEEKEKEIERVKKGLEIVSELVGDKKDEVDEIDEDAKEEIAGGE

SEQ ID NO: 1444 - protein, 605 aa, Arabidopsis thaliana
MADPLNGKSFFICFSLLFSFTLLFISPLYATESPVIEDVSTDVAVSVSETNREAVLLHNLEELVKNLTELVANLDAKLSATPLKEKNEISVDDDIGEEKERGRAKAFSVTKYSPFWSERFQFTSAVKLNSDATCINVLPFRDFEGSSKYFAIGDSKGRVYVFLRNGDVLIEFFTTVDSPVTAMVSYSSVFKNSSFVVTGHQNGAVLLHRIHEGSNGEDWNSNSVSMEHVGKFDVDDSADPVTLLEVHHVGRVRYILATDLSGKLTVLTENRTVYGSVIPSSRPLVFLKQRLLFLTESGAGSLDLRSMKIRETECEGLNHSLARTYVFDAAERSKAYGFTSEGEIIHVLLHGDIMNFKCRVRSKKKFQMEEPVALQSIKGYLLVINEEKVFAFNVSTQHYVRTAGPRLLFSAGLEEIRSAFLSHRESSSRTTTVVKTRPLIASDRENLLVIGLENGYFAVYKSKLPTLKGDFNTMLWSSPVFFFILFLFGAWHFFAKKKESLTAWGPDDPFTPTGAQNSSAKEPTFTEPSRRNDDLMDLRRRYAGGSYRSVGANDPSSRAPVDGNYRTTAQDHNNYRGGGSGLDSNGFGNRRDHLFGNNKVLDNES

SEQ ID NO: 1445 - protein, 116 aa, Arabidopsis thaliana
MASSAPQGSVDPLTGKDPAKALTAVASGFFENVKKNKQSFFQFAAMTGILLLSFRSVSQKYRIHDLEEDTAVLKKEQDSLTDRMSKIKSDLLHQASIDSSGVFASRLRLLFGEDKK

SEQ ID NO: 1446 - protein, 363 aa, Arabidopsis thaliana
MKKGGFSNNLKLAIPVAGEQSITKFLTQSGTFKDGDLRVNKDGVRIISQLEPEVLSPIKPADDQLSLSDLDMVKVIGKGSSGVVQLVQHKWTGQFFALKVIQLNIDEAIRKAIAQELKINQSSQCPNLVTSYQSFYDNGAISLILEYMDGGSLADFLKSVKAIPDSYLSAIFRQVLQGLIYLHHDRHIIHRDLKPSNLLINHRGEVKITDFGVSTVMTNTAGLANTFVGTYNYMSPERIVGNKYGNKSDIWSLGLVVLECATGKFPYAPPNQEETWTSVFELMEAIVDQPPPALPSGNFSPELSSFISTCLQKDPNSRSSAKELMEHPFLNKYDYSGINLASYFTDAGSPLATLGNLSGTFSV

SEQ ID NO: 1447 - protein, 123 aa, Arabidopsis thaliana
MGFVLICTCPPSSGVVVSQLHHHQFSAGVKSNELWFRPTRRTLISKSSCFNLPQEPILSEALKEPIAFLGGMFAGLLRLDLNEEPLKDWVTRTVEASGITEEEVDADGVVSNDEDSPQQIEIE

SEQ ID NO: 1448 - protein, 103 aa, Arabidopsis thaliana
MAEKSQIPDNNNNTSSSAKKPTPEIGSGSGKRYYNPPESVNPDQATLREQWKFAIRQYSKWYSHAWGTAILAGGFFFGLGWIIKGSNPLPSLQSSSKPRDEEK

SEQ ID NO: 1449 - protein, 96 aa, Arabidopsis thaliana
MEIESHVSVPGKNLVKVEFKLGTESYTIDSIKGDTVLDQLVSMKEESMKILKDFITKHNVPDDDVPDQILSDDEEGDDDDASPVICPVKPPKKTKI

SEQ ID NO: 1450 - protein, 267 aa, Arabidopsis thaliana
MLVAYPAGTINKFQIPISCYAALRRFKTSPFGPLISCSVSPRSIVPCSNVECYHSSFSTKYQIQPRRRWMFCNSRNNSISSDDEYRSSPNIAISLLRRYRTVIGRGEGETLKEFISAGVNAYALGCTDEDLRKELMAMKDSGLEIERMENYGGSTQTKSKITLSEVDECILWLRIVFITILCTPQPTVIRWSSTPSVSDEILSKWRGFCAVIANAYYIRGMAWLPVKTLQLEQMAVTGQSEEPSVVASRMRLVFSTLEVVSPQWPRV

SEQ ID NO: 1451 - protein, 319 aa, Arabidopsis thaliana
MASAWKKDKNQKLLSPKTLISLLVLSIIFLSSLFFFFSNSSLQYSNPNLSINSPYPIPPFDCFKCPQSKPIIANVVENLKYPFVYSLADLGNLPEKPHKNIVRLLKGKPFRKPDISATIQEVLDSMRASGKNGIVVDVGANVGMASFAAAVMGFKVLAFEPVFENLQRICDGIWFNRVASLVTVFEAAASDRTGDITFHKLVGRLDNSAVSEVGARLAFKSNKEIAVQVKSIPLDKLIPPSQPVLLIKIDVQGWEYHVLKGAKKLLSGKPAEAPYLIYEEDERLLTASNSSSKEIRDFLKSVGYSKCSQHGTDAHCTKE

SEQ ID NO: 1452 - protein, 376 aa, Arabidopsis thaliana
MSNFTYTSAFNLSDNSPFNPAIGSSSSSSSALVVASDDDNNTDDACSICLEPFTLQDPSTVTSCKHEYHLQCIIEWSQRSKECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQVSDFSRFLVF

SEQ ID NO: 1453 - protein, 385 aa, Arabidopsis thaliana
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPISSTAISSTVTLSEPLGKFFGTGETEMADEEIIRRVWEYIKLNNLEDPVNPMAIQCDEKLRDLLGCESISAVGINEMLRRHMYKQS

SEQ ID NO: 1454 - protein, 180 aa, Arabidopsis thaliana
MQPTSSMNEEFLKKWQMGLQIFRPSIDNTSVHERKKAIKLSADVAMASLRKGTTCWSRALIEKTATEDNFLVRQMLSGIKAETLINKKLPKKTVCHRKIVRRSKKILRRKSKSASEEAAAKAKRLVKRRTQGLRNVVPGGELMSNDVLLLQETLDYIVSLQTQVNVMRSIVDAAEAEIER

SEQ ID NO: 1455 - protein, 459 aa, Arabidopsis thaliana
MIGAVNSVEAVITSIQGLSGSPEDLSALHDLLRGAQDSLRAEPGVNFSTLDQLDASKHSLGYLYFLEVLTCGPVSKEKAAYEIPIIARFINSCDAGQIRLASYKFVSLCKILKDHVIALGDPLRGVGPLLNAVQKLQVSSKRLTALHPDVLQLCLQAKSYKSGFSILSDDIVEIDQPRDFFLYSYYGGMICIGLKRFQKALELLYNVVTAPMHQVNAIALEAYKKYILVSLIHNGQFTNTLPKCASTAAQRSFKNYTGPYIELGNCYNDGKIGELEALVVARNAEFEEDKNLGLVKQAVSSLYKRNILRLTQKYLTLSLQDIANMVQLGNAKEAEMHVLQMIQDGQIHALINQKDGMVRFLEDPEQYKSSEMIEIMDSVIQSTWNQVDMEMTVLPKESSSIKQVMCFDKNFRTIGLSKNLLAMDESLSCDPLYLGKVGRERQRYDFGDDFDTVPQKFSM

SEQ ID NO: 1456 - protein, 477 aa, Arabidopsis thaliana
MAATTTATSLFSSRLHFQNQNQGYGFPAKTPNSLQVNQIIDGRKMRNATVLSAASTDKAITTAQSVAPTACDRVRRHTISVFVGDESGIINRIAGVFARRGYNIESLAVGLNEDKALFTIVVLGTDKVLQQVVEQLNKLVNVIKVEDLSKEPHVERELMLIKLNADPSTRSEIMWLVDIFRAKIVDTSEQSLTIEVTGDPGKMVALTTNLEKFGIKEIARTGKIALRREKMGETAPFWRFSAASYPHLVKESSHETVAEKTKLALTGNGNASSGGDVYPVEPYNDFKPVLDAHWGMVYDEDSSGLRSHTLSLLVANVPGVLNLITGAISRRGYNIQSLAVGPAEKEGLSRITTVIPGTDENIDKLVRQLQKLIDLQEIQNITHMPFAERELMLIKVAADTSARRDVLDIAQVFRAKAIDVSDHTITLEVTGDLRKMSALQTQLEAYGICEVARTGRVALVRESGVDSTYLRGYSLPL

SEQ ID NO: 1457 - protein, 271 aa, Arabidopsis thaliana
MTWHHLNHNIRIPSLSPFLSELLSLTLSRATMAATASSLTIASSFSEPRTQIHSSRRLNLPLQYSIPYKVLRSRSRRLGLVVSSVSAPNVELRTGPDDLISTLLSKVVANSDGGVTLSPEQHKEVAQVAGELQKYCVKEPVKNPLIFGDWEVVYCSRPTSPGGGYRSVIGRLFFKTKEMIQAIDAPDIVRNKVSINAFGFLDGDVSLTGKLKALDSEWVQVIFEPPEIKVGSLEFKYGFESEVKLRITYVDEKLRLGLGSKGSLFVFRRRQ

SEQ ID NO: 1458 - protein, 360 aa, Arabidopsis thaliana
MATAMEEPRKLRGHKSTATCCIASRDRPGIVLTSGEDGCICWFDLRCKDVQFIIDVGTEPVSSLCFKTGNENILYASCGNEIKSFDVHTLSATSWKPLESYNYNKDEVNQVVCNGRSSFLASADDSGDVKIIDLGQKCLYKTLRAGHTSICSSVQFIPWRPWEVITGGLDSKLVLWDFSKGRSQKIIDFGSDTNNNSGQCLNPAFVHSIAIPEMDMVDKLDKICAVARGDGIVNLINIESELSRKGTSSKGSSSSSSNNVVKRVCLDYSVGGHNSAVSCVAFSLFQEKGRFLISGGNDKTVKIWDCFKCLDPNNNNNNSDLLHLNINLSKKVNWLCTNQSDSENLVVCDTTRVVKVYSIS

SEQ ID NO: 1459 - protein, 346 aa, Arabidopsis thaliana
MRFFYCFSICNASFALFCPAMEEADQLCLAAKSGDLKKVQTLIYSGADVTHFDNDGLTPLMHAAKIGNAEIVTALLESGAPWNALSPSNLSAGDFAMEAGHQETFDLLLKTGIQSELILGTIARNQTKNEYSNQEYLQDRVSFSEDKLMDSESKGVMMAWEKPLMEAHAKAICLNGGHILNVGFGMGLVDTAIQRYNPVKHTIIEAHPEVYKRMIESGWGEKENVKIVFGRWQDVLDKLDDNSFDGIFFDTYGEYYEDLREFHQHLPRLLKPDGVYSYFNGFCGSNAFFHVVYCNLVTLEIENLGFSTQLIPLPVKDCLGDEVWEGVKQKYWQLDTYYLPVCQFSD

SEQ ID NO: 1460 - protein, 228 aa, Arabidopsis thaliana
MDEEAAIDRLPLDLLAYIFSLATSFTVLAQASGVCKKWRKAVNQSMARRETLSFAGWKMDDDSTSRLVHLAFNLKELDISRSRWGCHITDNGLYQIASARCVSNLNSVSLWGMTAITDSGVVQLISRTSSLQHLNIGGTFITDESLFAIAERCHQLKTIGMWCCRHVTERGLLVLVNKCRKLESINLWGTRVPVDCFIALLTISPALQIKPMELLLNAQNPPPLLHAV

SEQ ID NO: 1461 - protein, 435 aa, Arabidopsis thaliana
FDICMAPTPLLTFPSHSLHFTPPLSLFNNSKKKQKQKKREMEKKLKRRESMSTTAAESPPAKRRRTVTGNENSALIEGLPDHISEICLSLVHRPSLLSAVCTRWRRLLYSPEFPSFPSLYALFVDSTSDTGRVNPSVRFMCFNPVSSKWYPLPPPPPDPPLHRILYRHPSFISFNLPIQCVSAAGKLILIAGSNQQLSPAISHPLIFDPISSSWSSGPRIGSPRRWCATGACDGAIYIASGISSQFSSTVAKSVEKLDLTEQNRNNHRFNWEKLRDMRDLRFSREAIDAVGYRRKLLMVNVKGDAVKEGAIYDVVKDDWEPMPEEMLVGWRGPVAAMEEEILYSVDERRGTVRKYDDEKREWREVVVVEGGEEMLKGATQVTADSGKLCVVTGDGKIVVVDVAAEPAKIWNVEIPDGLEPVSVHVLPRMSQPNFC

SEQ ID NO: 1462 - protein, 307 aa, Arabidopsis thaliana
MNNDTSKKLGTLVSDDGPVNVYVWDMDETLILLRSLLNGTYAESFNGSKDVKRGVEIGRMWEKHILKICDDFFFYEQVEECNEPFLDSLRQYDDGKDLSRYEFKQDDFSTPTDDLNKRKLAYRHRAVAERYEKGLCPFIDSESMSGLDELYNVTDEYTDRWLSSARAFLEQCSCVEESSDGTSAIEQSSQDIHILVTSGALIPSLVKCLLFRLDTFLRHENVYSSIDVGKLQCFKWIKERFNHPKFRFCAIGDGWEECAAAQALQWPFVKIDLQPDSSHRFPGLTPKTVSYYFAAVYGNSDADSSKE

SEQ ID NO: 1463 - protein, 640 aa, Saccharomyces cerevisiae
MRRERQRMMSFEDKDKDDLDNSNSNNSSEMTDTAMMPPLKRLLITGSSDDLAQGSSGKKKMTMATRSPSSSPDLATNDSGTRVQPLPEYNFTKFCYRHNPDIQFSPTHTACYKQDLKRTQEINANIAKLPLQEQSDIHHIISKYSNSNDKIRKLILDGILSTSCFPQLSYISSLVTHMIKIDFISILPQELSLKILSYLDCQSLCNATRVCRKWQKLADDDRVWYHMCEQHIDRKCPNCGWGLPLLHMKRARIQQNSTGSSSNADIQTQTTRPWKVIYRERFKVESNWRKGHCRIQEFKGHMDGVLTLQFNYRLLFTGSYDSTIGIWDLFTGKLIRRLSGHSDGVKTLYFDDRKLITGSLDKTIRVWNYITGECISTYRGHSDSVLSVDSYQKVIVSGSADKTVKVWHVESRTCYTLRGHTEWVNCVKLHPKSFSCFSCSDDTTIRMWDIRTNSCLKVFRGHVGQVQKIIPLTIKDVENLATDNTSDGSSPQDDPTMTDGADESDTPSNEQETVLDENIPYPTHLLSCGLDNTIKLWDVKTGKCIRTQFGHVEGVWDIAADNFRIISGSHDGSIKVWDLQSGKCMHTFNGRRLQRETQHTQTQSLGDKVAPIACVCIGDSECFSGDEFGCVKMYKFDLND

SEQ ID NO: 1464 - protein, 249 aa, Arabidopsis thaliana
MKFNVANPTTGCQKKLEIDDDQKLRAFFDKRLSQEVSGDALGEEFKGYVFKIMGGCDKQGFPMKQGVLTPGRVRLLLHRGTPCFRGHGRRTGERRRKSVRGCIVSPDLSVLNLVIVKKGVSDLPGLTDTEKPRMRGPKRASKIRKLFNLGKEDDVRKYVNTYRRTFTNKKGKKVSKAPKIQRLVTPLTLQRKRARIADKKKRIAKANSDAADYQKLLASRLKEQRDRRSESLAKKRSRLSSAPAKPVAA

SEQ ID NO: 1465 - protein, 203 aa, Zea mays
MARQQSVQALCVLAALLFAASLPSPAAAGVHLSSLPKALDVTTSAKPGQVLHAGVDSLTVTWSLNATEPAGADAGYKGVKVKLCYAPASQKDRGWRKSEDDISKDKACQFKVTEQAYAAAAPGSFQYAVARDVPSGSYYLRAFATDASGAEVAYGQTAPTAAFDVAGITGIHASLKIAAGVFSAFSVVALAFFFVIETRKKNK

SEQ ID NO: 1466 - protein, 544 aa, Nitrosomonas europaea
MSTLTRSPAWLALSAHQTEIANRPLRTLFDEDPQRFDKFSLQFKDLLLDYSKQPVDATTIRLLLALAEQQKLVDWLGRMANGEKINFTESRAALHIALRANSPVFMDGVDVTQEVRRVLRQIEQFVQKIHNQSHRGYSGLPITDVVNIGIGGSDLGPVMVTEALKPYHLPQLRTHFVSNLDGAHLSDTLQHINPATTLFVIASKTFTTQETLANAHSARKWFLAGGGSKQDIAAHFVAVSTNREAVSQFGIDPDNMFEFWDWVGGRYSLWSAIGLPIALAVGMEHFHSLLAGAQAMDDHFLTAPFEQNLPVILGLIGIWQINFFHITSQAILPYDQSMHRFPAYLQQLEMESNGKRVTRNGEAVDYSTGIIIWGEPGTNGQHAFYQLLHQGTQKFTADFLAPCRCHHPLSEHHPMLLANFFAQTEALMRGKTEQEVRSELANQNLSADLVEHLLPHRVFPGNHATTSILFKKLDPATLGMLIALYEHKVFVQSVIWEINPFDQWGVELGKQLAGKILAELALDKPVTGHDASTNGLINFYRAQQ

SEQ ID NO: 1467 - protein, 335 aa, Xylella fastidiosa
MTQTITVIRGDGIGPEIMDATLSVLNALQANLNYEFADAGLSALEKHGDLLPESTLNSISKNKIALKSPLTTPVGEGFSSINVALRRKFDLYANVRPAKSFPNTESRFSDNVDLITVRENTEGAYLSEGQTISPDGEVATSSARVTRKGSERIVRYAFDLARTTGRKKVTAVHKANIIKSTSGLFLKTARDVASQCPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 1468 - protein, 467 aa, Synechocystis sp. PCC 6803
MMHKKIDLNQLSEAESLLTPTYAARGLANSVSKYEMPETEMLPAIAYNLIHDELGLDGNSRLNLATFVTTWMEPEARQLMADTFDKNMIDKDEYPQTAEIELRCVNILSRLWNAPASAEATGCSTIGSSEAAMLGGMAMKWKWRQRRQAAGKPGDRPNLVMGINVQVCWEKFCRYWEVEPRFVPMEGDRYHISPEEAVKLIDENTIGVIGILGSTFDGSYEPIEALNDALETLNQRTGWQVPLHIDAASGGFIAPFLDPDLRWDFRLPWVKSINTSGHKYGLVYPGVGWIIWRDKEELPEELIFHCNYLGGDLPNFALNFSRPGNQVVAQYYNFLRLGKEGYRKIQQTCRDTALYLSGKIAQLGPFELLTDGGDIPVFAWRLKDEVLANTCYTLYDMADKLRERGWLVPAYRMPKNREDLVVQRIVVKEGFSRDMADLLLADMERAIAYFASQPDHKPKQEGSHFSH

SEQ ID NO: 1469 - protein, 635 aa, Synechocystis sp. PCC 6803
MVTTPTAAPRKPSKVEGIKERSNYLREPLATELLNDANYFTDDAVQILKFHGSYQQDNRDNRVKGQEKDYQFMLRTRNPGGLIPAQLYTALDDLSKTHGNQTLRVTTRQGLQIHGIVKKDLKMAIATVVNNLGSTLGACGDINRNVMAPAAPFRDKPEYGYAWDYANKVADLLSPQSGAYYEIWLDGEKVISGEEAPEVKAARQKDLNGTNLNDPKEPIYGQQFMPRKFKISVTVPGDNSIDVYTHDISLVVITDRHGELRGFNVLAGGGLGRTHNKEETFARAADPIGYVSKDDVYDLVKAIVATQRDYGDRHNRRHARMKYLLADWGVEKFRKQVETYMGKPFQSFKPLPAWRYQDYLGWHEQGDGKLFFGLSVENGRIKDEGDFQLKTALRKVVDQFQLPLRLTANHNILLYDINAQDKAAIEQIFQQHGVVTDPEAIDTLVRYSMACPALPTCGLAVTESERIMPSVNARLRDLLNSLDLPNESIVTRMTGCPNGCARPYMAEIGFVGSAPNSYQVWLGGSPNQERLAAAYTEKMPLEQLESLFEPLFVYFKQSRKGKESFGDFCHRVGFTALREFSHGYTAPAKGGKNRKNQRRVSLSDEMYAQLKARSERDNCPMNQIVQQALTAYLGK

SEQ ID NO: 1470 - protein, 478 aa, Chloroflexus aurantiacus
MGRYMRRTKIVATLGPATSTPERIAGLIRAGMNVARLNFSHGTHAEHAARIAMVRRAAAEAGRHVAILQDLQGPKIRTGPLENGQPVELVAGQRFVITTEPIVGDAHRVSTTYRALPLDVRPRDRILLSDGLIELVVTGHTDTEVETEVVHGGRLREHQGINLPGVRVSAPAATEKDLADLAFGLEQGVDYVALSFVRRASDVREVKEFIRRAGKQTPVIAKIERPEALDVLPEILAEADGIMVARGDLGVEMPPERVPIVQKQIIAAANQALLPVITATQMLESMIHNPRPTRAEASDVANAIIDGTDAVMLSGETAAGAYPIEAVQMMALIADAVEASYTGGQHSTTPRWSIAPAQSTPRAIAAAACTIANSLPVRFIVVLTQSGASARLVSHYRPEVPILAFCPSEETARRTSLYWGVTPIVIEARDRLDELEQQIVRMMRETGMVRKGDLIVLSGGHPVYRYGPTNFLKVITIE

SEQ ID NO: 1471 - protein, 235 aa, Synechocystis sp. PCC 6803
MAELDAANLMKQAVGKAAADRVKSNTIVGLGTGSTTAYALEFIGDRLKKGELENVVGIPTSFQAEVLARKYGIPLTTLDVADRIDIAIDGADEVDPQKNLIKGGGAAHTREKIVDALAETFLVVVDSGKLVDKLGSTFLLPVEVIPMALTPVMRALAKLGGKPELRMGVKKAGPVVTDQGNLVIDVKFDAITNPAELEKTINNLPGVLENGLFVGVADVILVGEIIDGQPTVREF

SEQ ID NO: 1472 - protein, 372 aa, Arabidopsis thaliana
MSNADEPPQKTNQPPSSSLTPPSLFSLPVDIVLNILALVPKRYYPILCCVSKSLRSLIRSPEIHKTRSLHGKDSLYLCFSTRTTYPNRNRTTFHWFTLRRNDNKMNTTENVFVSIDVPYRPGHASYPLSNIAIDTEIYCIPGYNFPSSSIVWIFDTQSGQWRQGPSMQVERLSATVGLVGGKIYVIGGNRGEEILAEVFDLKTQTWEAAPIPKAKDRNEWFTHASVSLDRKVYALNSREYMNSYDTRDGSYQRYTIPEDNWWKTGKCVIDNVLFVYFLRFGLMWYDSELMLWRVVYGLDLDKARCIGIGEYYGKLAFIWGKPSNVSESKEIWCRMIGLLRSEVGIHGTEEPSQLLRIVPNNYSLRHCLSLSG

SEQ ID NO: 1473 - protein, 361 aa, Arabidopsis thaliana
MGGVTSSVAAKFAFFPPSPPSYKVVTDELTGLLLLSPFPHRENVEIVKLRTRRGTEIVGMYVRHPMATSTLLYSHGNAADLGQMYELFIELSIHLKVNLMGYDYSGYGQSTGKPSEHNTYADIEAVYKCLEETFGSKQEGVILYGQSVGSGPTLDLASRLPQLRAVVLHSPILSGLRVMYSVKKTYWFDIYKNIDKIPYVDCPVLIIHGTSDEVVDCSHGKQLWELCKDKYEPLWVKGGNHCDLEHYPEYIRHLKKFIATVERLPCPRMSSDQSERVRDAPPRRSMDRRVKPRQSTERREKEKPPKSQSKMSSSSSKLKISFDQLDRSRRSVDCHEKTRKSVDQIERGRKSVDRLDRVRSE

SEQ ID NO: 1474 - protein, 399 aa, Arabidopsis thaliana
MGAVTSSMAAKFAFFPPNPPSYGVEVVEGKLRLIGVENVKENVEVLKLKTKRGNQVVAAYIKNPTASLTLLYSHGNAADLGQMFELFSELSLHLRVNLIGYDYSGYGRSSGKPSEQNTYSDIEAVYRCLEEKYGVKEQDVILYGQSVGSGPTLELASRLPNLRAVVLHSAIASGLRVMYPVKRTYWFDIYKNVEKISFVKCPVLVIHGTSDDVVNWSHGKQLFELCKEKYEPLWIKGGNHCDLELYPQYIKHLRKFVSAIEKSPILRNGPVPLTEKARSSTDIREPARPSTDQRDKSRTSTDQREMPKLSTDIARASVDKRERTRRSVDGTEKPSNSAEQQLVQPEKGRNSIDRYISQSFYDVLMIMLLMIMYDNRFGEMIRSVGFCNIDCFKPTATAK

SEQ ID NO: 1475 - protein, 457 aa, Arabidopsis thaliana
MDLQMETVRPMVVAPKGNKLRRKFAKVLNIHKLTGVAPEGEMKKIKFDSKTAKLSESFYKLEEEYERSQGLEALLAKLFATVSSIKAAYAQLQHSQSPYDSIGIQKADNLVVAELKTLSELKQCFMKKQVDPNPERTLVLAEIQELRSLLKTYEIMGKKLESQYKLKDSEIIFLREKLDESMKQNKLTEKRLNQSGQLCNPLDNLHLSALNPTHFVTYLHHTVKSTRGFVKLMIEQMKLAGWDISSAANSIHPGVFYYKQDHKCFTFEHFVSNVMFEAFHLPYFSTSSESRSYKKKKQSNADREMFFERFKELRSMKAKDYLTARPKSRFARFCRAKYLQLIHPKMEQAFFGHLHLRNQVSAGEFPETSLFSGFLEMAKRIWLLHCLALSFEREAEIFRVPKGCRFSEVYMKSVAEEAFFPAAESSPESEPRVAFTVVPGFRIGKTSIQCEVYLSLS

SEQ ID NO: 1476 - protein, 162 aa, Arabidopsis thaliana
MAPITVGDVVPDGTISFFDENDQLQTVSVHSIAAGKKVILFGVPGAFTPTCSMSHVPGFIGKAEELKSKGIDEIICFSVNDPFVMKAWGKTYPENKHVKFVADGSGEYTHLLGLELDLKDKGLGIRSRRFALLLDNLKVTVANVESGGEFTVSSAEDILKAL

SEQ ID NO: 1477 - protein, 511 aa, Arabidopsis thaliana
MVSVSLTLFSSLFQLLAIVFSVYCNRIATLEDSFLADLDELSDNEAELDENDGDVGKEEEDVDMDMADLETLNYDDLDNVSKLQKSQRYADIMHKVEEALGKDSDGAEKGTVLEDDPEYKLIVDCNQLSVDIENEIVIVHNFIKDKYKLKFQELESLVHHPIDYACVVKKIGNETDLALVDLADLLPSAIIMVVSVTALTTKGSALPEDVLQKVLEACDRALDLDSARKKVLEFVESKMGSIAPNLSAIVGSAVAAKLMGTAGGLSALAKMPACNVQVLGHKRKNLAGFSSATSQSRVGYLEQTEIYQSTPPGLQARAGRLVAAKSTLAARVDATRGDPLGISGKAFREEIRKKIEKWQEPPPARQPKPLPVPDSEPKKRRGGRRLRKMKERYQVTDMRKLANRMAFGTPEESSLGDGLGEGYGMLGQAGSNRLRVSSVPSKLKINAKVAKKLKERQYAGGATTSGLTSSLAFTPVQGIELCNPQQALGLGSGTQSTYFSESGTFSKLKKI

SEQ ID NO: 1478 - protein, 493 aa, Arabidopsis thaliana
MGRDFLVLSILILLLSGIVSSAPSANSPATIATRSMVKFENGYSVETVFDGSKLGIEPYSIEVLPNGELLILDSENSNIYKISSSLSLYSRPRLVTGSPEGYPGHVDGRLRDAKLNHPKGLTVDDRGNIYVADTVNNAIRKISEGGVTTIAGGKTVRNGGHVDGPSEDAKFSNDFDVVYVGSSCSLLVIDRGNKAIREIQLHFDDCAYQYGSGFPLGKLTKVPNFFLWIAVLVAAGFFGYMLALLQRRVGSIVSSHNDQEMFEADPDQKPMKHSRPSLIPAGDEQLEKQEETFVVSLGKLVSNAWESVMEILRKKQTGTSFQQYHGTTKQSAAFSTSTPWPIQESFVIRDEDGPPPVEPRNPTPRKTYAFMSKDAEKMQQLRQSRAFYSSWDAEFPNQQQQQQKQHQKHQHQQQQQQQHRRHYSSIPHTYYEQDSEKSNEIVFGAVQEQSSKRVAKPKPKPIESGDQMNNNTQQNLHYRSHSVSYPYGYYPNT

SEQ ID NO: 1479 - protein, 628 aa, Arabidopsis thaliana
MAGGAITPDSLIGLIAEINEIPGNFGLFKKDCSDLARRVGLLTHLIEEIRDSSPPSESDASSSLNSHECDWWSDLVVGLQAAKRLLSSATSFQARESSDGAAKRISFQFQCVTWKLEKALGDLTYDRYDISDEVREQVELARLQLRRAMQRYGSLNSKKFSSGLSEPMEKDASSNRKVIEKLESIPETVHSLSDEKKFESPPPWKSSSVSLAFFLSKDGDDERLEKAVTENSDDSQKSDNLTIPEDFLCPISLELMKDPAIVSTGQTYERSFIQRWIDCGNLSCPKTQQKLENFTLTPNYVLRSLISQWCTKHNIEQPGGYMNGRTKNSDGSFRDLSGDMSAIRALVCKLSSQSIEDRRTAVSEIRSLSKRSTDNRILIAEAGAIPVLVKLLTSDGDTETQENAVTCILNLSIYEHNKELIMLAGAVTSIVLVLRAGSMEARENAAATLFSLSLADENKIIIGASGAIMALVDLLQYGSVRGKKDAATALFNLCIYQGNKGRAVRAGIVKPLVKMLTDSSSERMADEALTILSVLASNQVAKTAILRANAIPPLIDCLQKDQPRNRENAAAILLCLCKRDTEKLISIGRLGAVVPLMELSRDGTERAKRKANSLLELLRKSSRKLGSL

SEQ ID NO: 1480 - protein, 453 aa, Arabidopsis thaliana
MAKVYWPYFDPEYENLSSRINPPSVSIDNTSCKECTLVKVDSMNKPGILLEVVQVLTDLDLTITKAYISSDGGWFMDVFHVTDQQGNKVTDSKTIDYIEKVLGPKGHASASQNTWPGKRVGVHSLGDHTSIEIIARDRPGLLSEVSAVLADLNINVVAAEAWTHNRRIACVLYVNDNATSRAVDDPERLSSMEEQLNNVLRGCEEQDEKFARTSLSIGSTHVDRRLHQMFFADRDYEAVTKLDDSASCGFEPKITVEHCEEKGYSVINVSCEDRPKLMFDIVCTLTDMQYIVFHATISSSGSHASQEYFIRHKDGCTLDTEGEKERVVKCLEAAIHRRVSEGWSLELCAKDRVGLLSEVTRILREHGLSVSRAGVTTVGEQAVNVFYVKDASGNPVDVKTIEALRGEIGHSMMIDFKNKVPSRKWKEEGQAGTGGGWAKTSFFFGNLLEKLLP

SEQ ID NO: 1481 - protein, 362 aa, Arabidopsis thaliana
MIPFPLLPTPIETNYRACTIPYRFPSDNLKKATPTEISWINVFANSIPSFKKRAESDTSVPDAPARAKIFEQRYAGFLEGWKKDPESNGGPPDGVILGRVREHLLRELGFRDIFKKVKDEENAKAISLFPEVVSLSDAIEDDGERLENLVRGIFAGNIFDLGSAQLAEVFSRDGISFLATSQNLVPRPWVIDDLNKFQAKWVKKPWKKAVIFVDNSGADIILGILPFARELLRRGIQVVLAANELPAINDVTYTELTDIVSQLKDGNGQLIGVDTSKLLIANSGNDLAVIDLSRVSHELAYLSSDADLVILEGMGRGIETNLYAQFKCDSLKIGMVVKHVEVAQFLGGRLYDCVFKFNEVQS

SEQ ID NO: 1482 - protein, 387 aa, Arabidopsis thaliana
MVFISETSDDGSNGGDPTKNPQEEEEENLPPIPQGIPDELIESTVLLIRRCHYPTLSLLSKTFRRVISSSELYKSRFILNLTDSVLYALIGFSPYNTTNLYILNCNIPRNISLHLREIKSLPPLNHGSAVVTIGYHMYVIGGHNRLHQPTSNVSIIDLRFHTSCSLPRMQRTRVYAAAGVIDGRIYVIGGCVKRNDHWIEVFDIENRIWSSVPHHRYCNGSSLRGEGFVTSVVMQNKIYILDSLFGFAYEPRHGTLQSLGFETQFMFLWRDPCCVIEGLLYCIDPMCVLGHAIVVYDPNELIWRRVKGAYILPKFCYYQCKMANFGGKLAILGCSNSSQRGLKDVWFVEIELENRQSGEIWGKVDSLAIVLRSVKSPSIDLFRSVTF

SEQ ID NO: 1483 - protein, 424 aa, Arabidopsis thaliana
MTTMISNLPRVLIEEIFFRVPLKSLRAVRLTCKSWNTLSKSRSFRKLYISKRATREEESMMIAMMNFDLYSMRVVVDDDVDPSKAFKKKRNKKSIAFKRQPIFLDEQVKISQVFHCEGLLLCFLKEDDTRVVVWNPYCGQTRWIQLRYSHRPHKDRFIYALGYKDKESRGSFQLLRFVDYFLGAPKNQYFWYEIYDFNSDSWTTLDVTPHWCIYCCDRGVSLNGNTYWCAKERKAEDDIVDHIISFDFTNERFGPLLPLPSKVMEHEYEIVTLSYVKEEKLAALFQHYEADWNEFDIWITTKIDAEVVSWSMFLRMDTGPRIEVPHICEGFFIDEEKKVAMGFEEDFDRKTFIIIGEAGYVRKLDIKAHVDRKCRPTVCSYVPSLVQIKKPARGKRKRQSSLEKRLFDQNMLRLEAFKKLGGYF

SEQ ID NO: 1484 - protein, 216 aa, Arabidopsis thaliana
MGKAKKPQKFAVVKKMISHKALKHYKEEVLNPNKKDLTELPRNVPSVPAGLFFSYNSTLVPPYRVLVDTNFINFSIQNKIDLEKGMRDCLYANCTPCITDCVMAELEKLGQKYRVALRIAKDPHFERLPCIHKGTYADDCLVDRVTQHKCFIVATCDRDLKRRIRKIPGVPIMYVTNRKYSIEKLPEATLGGGMYLPAETSESTATMVLDYVNSLL

SEQ ID NO: 1485 - protein, 466 aa, Arabidopsis thaliana
MDVPRPAFKCFDDDGRLKRSGTVWTASAHIITAVIGSGVLSLAWAIGQLGWIAGPTVMLLFSFVTYYSSTLLSDCYRTGDPVSGKRNYTYMDAVRSILGGFRFKICGLIQYLNLFGITVGYTIAASISMMAIKRSNCFHESGGKNPCHMSSNPYMIMFGVTEILLSQIKDFDQIWWLSIVAAIMSFTYSAIGLALGIIQVAANGVVKGSLTGISIGAVTQTQKIWRTFQALGDIAFAYSYSVVLIEIQDTVRSPPAESKTMKIATRISIAVTTTFYMLCGCMGYAAFGDKAPGNLLTGFGFYNPFWLLDVANAAIVIHLVGAYQVFAQPIFAFIEKQAAARFPDSDLVTKEYEIRIPGFRSPYKVNVFRAVYRSGFVVLTTVISMLMPFFNDVVGILGALGFWPLTVYFPVEMYIRQRKVERWSMKWVCLQMLSCGCLMITLVAGVGSIAGVMLDLKVYKPFKTTY

SEQ ID NO: 1486 - protein, 481 aa, Arabidopsis thaliana
MKKRMWRISLISQISDLLCLSRGSSSTLKTLTPFCFTLSRSPFHQSGGDDDASGLKNQLLRFRNDSGKVASVLERNKIQGAAFVELLRQLRPWPVLSQLVFDWRRNKALCDGLPMTADEYAKGITISGRLKNVDLALSLFHESANKTTSVYNALMGAYLCNGLSHHCEQLFLDFNSQQDGPSSSTPSVSTYNILISLYGRLIMVERMESVFLQLQQLNILPDSSTYNNLIAGYIYAWDWDKMEATFHSMKNGLVKPTLATYLLMLRGYANSGNLLRMEDMYQAVKRHVDRNEIKLIESMICAYYRSCHKDRIRKIKTLSKLIPKKSYKPWLYLLLMQVYAKDDNLHAMENFIDQAITKGLQIETDGIMRSIVASYFRCNAVDKLAKFVQRANSAGWKMSRSMFHGLMIMYGSQKRFKEMENVLSEMESFKISRSKKTLCILLRVYAATHGQEHKVNQVAGMMLKHGHDFQRPEASKRVMGK

SEQ ID NO: 1487 - protein, 199 aa, Arabidopsis thaliana
MASTENPDPETGKSEPIPASATPPPSSAASFLDCRKIDIITRVLLFSATLTALIVMVTSDQTEMTQLPGVSSPAPVSAEFNDSPAFIYFVVALVVASFYALISTLVSISLLLKPEFTAQFSIYLASLDMVMLGILASATGTAGGVAYIALKGNEEVGWNKICNVYDKFCRYIATSLALSLFASLLLLVLSIWSALSKRT

SEQ ID NO: 1488 - protein, 236 aa, Arabidopsis thaliana
MAKIKPQALLNQSKKKKGPSRISISTIIVCNLVVAVVILSLVTTYRHWSQRSRNTIEHETRSQRFEDTNTASGQKTYDLPGFADINTSKGLITVELFKEGSPEVVDKFLDLCQKDHFKGMPFQRVIKNYLVQAGHSPSSIPVEEWTAKGKLRGRLHIGPKHEAFMLGTPKNKGNNKDFELLITTAPIPDLNDQLIVFGRVLKGEDVVQEIEEVDTDEHFQPKSPIGITGVVLKLET

SEQ ID NO: 1489 - protein, 127 aa, Arabidopsis thaliana
MVAFAGAKYAARSLPIMVADSNHIVLEFQKGRLENMFWKKDGCSKCSGDSKFVCLNKEECAIKPQNCKNQGGQVDCSLGIQLAFSGTDKHYTALNSWYEVANLKQYSLYGLYSNLKDSLTNPFKNIF

SEQ ID NO: 1490 - protein, 439 aa, Arabidopsis thaliana
MRGVTPNYYHSYTFFFFFFVVLLALFLHVFSINTLSSTETLTISSNRTIVSPGNIFELGFFKTTTSSRNGDHWYLGIWYKSISERTYVWVANRDNPLSKSIGTLKISYANLVLLDHSGTLVWSTNLTRTVKSPVVAELLDNGNFVLRDSKGNYQNRFLWQSFDYPVDTLLPEMKIGRDLKTGHETFLSSWRSPYDPSSGDFSFKLGTQGLPEFYLFKKEFLLYRSGPWNGVGFSGIPTMQNWSYFDVVNNFIENRGEVAYSFKVTDHSMHYVRFTLTTERLLQISRWDTTSSEWNLFGVLPTEKCDLYQICGRDSYCDTKTSPTCNCIKGFVPKNVTAWALGDTFEGCVRKSRLNCHRDGFFLLMKRMKLPGTSTAIVDKTIGLNECKERCSKDCNCTGFANKDIQNGGSGCVIWTGGAHGYEELRRRRSRSICQNRPL

SEQ ID NO: 1491 - protein, 230 aa, Arabidopsis thaliana
MASPTIRTVASYNTHLEYSVDFFGDEFIVTVTWDSSVISRWIRNVLFNNRFSSHPLVVGVGVQWTPFSYYSDPRPNNYYADPPPIRYYSDNPADILQLCVGNRCLIIQLGYCDQVPNNLRSFLADPETTFVGVWNGQDAGKLARCCHQLEIGELLDIRRYVTDSWGRSMRRSSFEEIVEECMGYQGVMLDPEISMSDWTAYDLDLDQILQASLDAYVCHQLGVWTRLWEV

SEQ ID NO: 1492 - protein, 284 aa, Arabidopsis thaliana [sequence omitted]

SEQ ID NO: 1493 - protein, 176 aa, Arabidopsis thaliana
MMNSCGIQQNAFEEMRRNAAVSDRRDAVICPKPRRVGALNHHSSRSLRWQLNHQMELCESNSGSEILDFILTKGGGGGGEQDQTRTVMTPPLFFTGSPPSRVSNPLTKDSLFREELLMVASPSPSTPRATKPQPPSSPRNGSCVMAATSFGNNPVVRVVGFDCDRRSSNRSISTLA

SEQ ID NO: 1494 - protein, 274 aa, Arabidopsis thaliana
MICTESNHQRFSFAGDLGQSDKGTPMEQQPSGPVRRDTTLLDSSNSDFEFHISSNFDPGDSSPADEIFADGMILPVLPFQVTATSTMPKRLYKYELPPIVSAPTLSSYLPPLPLPLPEHSRKYSVKETRGSLNGRGSGANSDSEAEKSSKSFWSFKRSSSLNCDIKKSLICSFPRLTRSNSTGSVAISKREMLRDINKHSSQRHGVPRPGVNPSSHMRPPSSFCCSSYQFRPQKHAGKNGGGRGGSFWIAPVIGGPSPFGLGSILRLTKEKKKK

SEQ ID NO: 1495 - protein, 322 aa, Arabidopsis thaliana
MLWYNDMHRILREPGMDQYGIPVERKEMKHKGRNVIWSVGMDKCLIEALAVQAKNGNKVDKCFNDKAYTAACVAVNTRFNLNLTSQKAINRLKTIKKRYRVMRDILSRDGFWWNSSTKMIDCESDELWRRYIAVNPDAKAFRGKQIEMYEELRTVCGDYQTPGKYNKVKKESSHHLNDVKQFEEDSVSFPLGSSEEHSDTDGTESYAGASEYMHEESQDLPPPRDPLRRPSKRSRNSDPCQEAMLVVASSIRRLADAVVQSKTLINTEELLKAVMEIDELEEAKQMYAFEYLNGDPVKARAFMAYNNRMRKMFLFRQFWWWK

SEQ ID NO: 1496 - protein, 162 aa, Arabidopsis thaliana
MADQTESPRSYHIFITIMSKRRTWVCLFIAVYAILVSSSWNLLRSVLNWYKLQYTSSNSDYSPSRLPAVYASVVLGAMFGAMSMVAAMTVAVPAVMVIWISVVVLLAFFGKSRRVLVVEGRKITREVVGFVFKVLLKEGNVVAAFCAVLAYFLLIRRDFDSY

SEQ ID NO: 1497 - protein, 242 aa, Arabidopsis thaliana
MEEPCETLDSGEAYQISRYHNYNQHSSRSSSPWLDLRVFYVRISNFVVEDSTPEVLTINHIPLDPDTLLEINGVRMGMYSEGGSSQLRRDRVDKKSEEATYVSTDNIRLTGSVKFEVYDKNELVLSGTLEMSGSNGFTGESKNRWKMNCEAEVTAGSGFLKEKSINGQELSSPLPTIEVYVTGCFSGTPIILTKTLQLGLKKKQSRRMALDAIPEYETAEPQKDTSYALDLQVTFKLSYAMI

SEQ ID NO: 1498 - protein, 315 aa, Arabidopsis thaliana
MIGSFLTRGLVMVFGYAYPAYECYKAVEKNKPEMQQLRFWCQYWILVAALTIFERVGDALASWVPLYCEAKLAFFIYLWFPKTRGTTYVYDSFFQPYVAKHENEIDRSLIELRTKAGDLAVIYCRKAVSYGQTRIVEILHFVALQSTPKPKPKEKKQAAAPEEEEQKQPDLKATSQAASSNPQVRLQSKKPQLVTKEPISPKPLSSPRKQQQLQTETKEAKASVSQTKLTTLTPPGPPPPPPPPPPSPTTAAKRNADPAQPSPTEAEEASQTVAALPEPASEIQRASSSKETIMEETLRITRGSLRKARSAGAPR

SEQ ID NO: 1499 - protein, 210 aa, Arabidopsis thaliana
MSHQTVALASKAKSPKPKRGKLDKEKMTALEKHVSFFDRNKDGTVYPWETYQGFRALGTGRLLAAFVAIFINMGLSKKTRPGKGFSPLFPIDVKNSHLCMHGSDTDVYDDDGRFVESKFEEIFNKHARTHKDALTAEEIQKMLKTNRDPFDITGWLSDYGEWKILHTLAQDKNGLLSEKSVRAIYDGSLFHQLEKKRSSSSSRGKKQKLP

SEQ ID NO: 1500 - protein, 310 aa, Arabidopsis thaliana
MGSFDLPHSSSFKGESEIFLRNVFENILKTYLRKNPTAKTIWELVQSLDNEKICYDHFTFRTLKVDGYGIDSLSSFFMAYGYKIGGGLDFPKKKLRVLWFSPPDVHVPNDGHGLGNGPLPRLVIAEVLVDELSPESQGIIRKYLKQEGGKQAVLSSTLGSLIWEKPTWTDFKQLAKESEFAAWTLIHGYTMNHLAFAVHRFKHRFSDIKFVKQRLEEKGFKLNSDGEILKVSQDGLLFQVSSISERLPVTFADGVTETIPASYIEFTQRQVLPEFKDVPLDEIKEFHRREAFELDNANHVMESTRFTTKF

SEQ ID NO: 1501 - protein, 289 aa, Arabidopsis thaliana
MNTLIPSEKRWIITGVLLAGLVGGALLFTSFIRAADETLFLCSTASAKSRAVAAAADYEATPIQLQAIVHYATSNVVPQQNLAEISISFNILKKLAPANFLVFGLGRDSLMWASLNPRGKTLFLEEDLEWFQKVTKDSPFLRAHHVRYRTQLQQADSLLRSYKTEPKCFPAKSYLRGNEKCKLALTGLPDEFYDTEWDLLMVDAPKGYFAEAPGRMAAIFSAAVMARNRKKPGVTHVFLHDVNRRVEKTFAEEFLCRKYRVNAAGRLWHFAIPPAAANATIDSGDYRFC

SEQ ID NO: 1502 - protein, 340 aa, Arabidopsis thaliana
MPSFNSSGNLAVAVALLFAGALYFYFSSITVSDPMSDLLHNVETRWTEYPVDELEAVLDKAAMGNNKTVIIAMVNKAYVEEVEGGRTMLDLFLESFWEGEGTRPLLDHLMLVAADQTSYDRCLFRRLHCYKMDTDGVDLEGEKVYMSKDFIEMMWRRTHLLLDVLSRGYNLTFTDTDVMWLRSPFPRLSYNESLDMQISVDSIGLVGGHLINTGFYHVRSNNKTISLFQKWYDMRLKSTGMKEQDVLKSLLDSGFFNQLGLNVGFLNTTEFSGFCQDSHDMGVVTTVHANCCRHILAKISDLTLVLRDWKRYKASHVNSNWSPHVECGRSWSDTHYIPKL

SEQ ID NO: 1503 - protein, 140 aa, Arabidopsis thaliana
MSEEFDESEIIFSDNYFPIRRREDGNEKENNRPVDFRENSERVWNKSSRRSKTTPLPSAVTAFSSSLPVNIPMRRYSTEEEYSDDDGGRKMIPPHLIVGRRMEGGQMAFSVCTGNGRTLKGRDLSRVRNSVLKLTGFLEA

SEQ ID NO: 1504 - protein, 334 aa, Arabidopsis thaliana
MPTMGNKNSMCGLKRFPNYKKSPIGSFAKNSSSHDGIKTIEAVNSCSFSRKADLCIRIITWNMNGNVSYEDLVELVGKERKFDLLVVGLQEAPKANVDQLLQTASSPTHELLGKAKLQSVQLYLFGPKNSHTLVKELKAERYSVGGCGGLIGRKKGAVAIRINYDDIKMVFISCHLSAHAKKVDQRNTELRHIANSLLPRDKRKRDLTVWLGDLNYRIQDVSNHPVRSLIQNHLQSVLVSKDQLLQEAERGEIFKGYSEGTLGFKPTYKYNVGSSDYDTSHKIRVPAWTDRILFKIQDTDNIQATLHSYDSIDQVYGSDHKPVKADLCLKWVNS

SEQ ID NO: 1505 - protein, 203 aa, Arabidopsis thaliana
MAKGRKPTTMNRSDRYLGSYTYGDSHGNSVTDELELGEEDIWSPAVIHDDTTENEESYGTWNLRATLGKNGRVGGLSLAFEGSLVAPPSSSPMIVQKIHGGGGEGEEDRRKLASSAPVNVPDWSKIYRVDSVESIHELDDEDDEDEESGMMPPHEYLAKSQARRSRKIGGGGASVFDGVGRTLKGRELRRVRDAIWSQTGFYG

SEQ ID NO: 1506 - protein, 261 aa, Arabidopsis thaliana
MASSSDPWMREYNEALKLSEDINGMMSERNASGLTGPDAQRRASAIRRKITILGTRLDSLQSLLVKVPGKQHVSEKEMNRRKDMVGNLRSKTNQVASALNMSNFANRDSLFGTDLKPDDAINRVSGMDNQGIVVFQRQVMRVEQDEGLEKLEETVMSTKHIALAVNEELTLQTRLIVCLRCCSLLFLLILISYSNEMGLSSMQDDLDYDVDITDSRLRRVQKSLALMNKSMKSGCSCMSMLLSVLGIVGLALVIWLLVKYL

SEQ ID NO: 1507 - protein, 231 aa, Arabidopsis thaliana
NSDDSRVISSVLLMKQNLVAVDILLNQMRDRNIKLDSFVVSAIIETNCDRCRTEGASLAFDYSLEMGIHLKKSAYLALIGNFLRSNELPKVIEVVKEMVKAQHSLGCYQGAMLIHRLGFGRRPRLAADVFDLLPDDQKGVAAYTALMDVYISAGSPEKAMKILREMREREIMPSLGTYDVLLSGLEKTSDFQKEVALLRKEKKSLVASARFRENVHVEDKICDLLFATNLL

SEQ ID NO: 1508 - protein, 210 aa, Arabidopsis thaliana
QPNQGSTVSSQILNEATQCVESINGVKEGRWKATLNYYKPMLKDQANQLEFPRDFLGISLADQPNKYYFIIRTQRIVLEADSSIQLIMEKLQSYKSKVALYFDGFQYQLGDFRLRVGKVVPTHSENVRGIVMEVEYLPISSMEKAQKVMEEFLEIWNEALAKRSLPGKFVNIDLNFGEFGLGDIYTPQHTAVRYALVMAHMIATVQAVRG

SEQ ID NO: 1509 - protein, 75 aa, Arabidopsis thaliana
MSGNMSKSEEKQELPLETSPYTKYEDIEDYKKNAYGTSGHQDVKPGHGGGTTDAPTPSGDAAPSAIDSANQKAKK

SEQ ID NO: 1510 - protein, 258 aa, Arabidopsis thaliana
MSAFEDDSFVILNDDASESVPVSGSFDATDSFSAFDGSLQVEDSVDDVFAAPSSDYGAYSNGDGIFGSNGDHDGPILPPPSEMESDEGFALREWRRQNAIQLEEKEKREKELLKQIIEEADQYKEEFHKKIEVTCENNKAANREKEKLYLENQEKFYAESSKNYWKAIAELVPKEVPTIEKRRGKKEQQDPKKPTVSVIQGPKPGKPTDLTRMRQILVKLKHNPPSHLKLTSQPPSEEAAAPPKNVPETKPTEAVTAA

SEQ ID NO: 1511 - protein, 622 aa, Arabidopsis thaliana
MLTKMSLPIPPKFLPPLKSPPIHHHQTPPPLAPPRAAISISIPDTGLGRTGTILDESTSSAFRDYQSLFVSQRSETIEPVVIKPIEGSIPVNFPSGTYYLAGPGLFTDDHGSTVHPLDGHGYLRAFHIDGNKRKATFTAKYVKTEAKKEEHDPVTDTWRFTHRGPFSVLKGGKRFGNTKVMKNVANTSVLKWAGRLLCLWEGGEPYEIESGSLDTVGRFNVENNGCESCDDDDSSDRDLSGHDIWDTAADLLKPILQGVFKMPPKRFLSHYKVDGRRKRLLTVTCNAEDMLLPRSNFTFCEYDSEFKLIQTKEFKIDDHMMIHDWAFTDTHYILFANRVKLNPIGSIAAMCGMSPMVSALSLNPSNESSPIYILPRFSDKYSRGGRDWRVPVEVSSQLWLIHSGNAYETREDNGDLKIQIQASACSYRWFDFQKMFGYDWQSNKLDPSVMNLNRGDDKLLPHLVKVSMTLDSTGNCNSCDVEPLNGWNKPSDFPVINSSWSGKKNKYMYSAASSGTRSELPHFPFDMVVKFDLDSNLVRTWSTGARRFVGEPMFVPKNSVEEGEEEDDGYIVVVEYAVSVERCYLVILDAKKIGESDAVVSRLEVPRNLTFPMGFHGLWASD

SEQ ID NO: 1512 - protein, 115 aa, Arabidopsis thaliana
MGNCLRHESEMHWAGEDWDEFITEDEEDHHYSSKTTRDGKPVIVTRDSKSSVPSHEIKIRLTKKQLHDLLSKVNVHDLTFQQQTFSCPILNNRGYEEANQQRLWRPVLQSIPEVN

SEQ ID NO: 1513 - protein, 410 aa, Arabidopsis thaliana
MGSVSLKIGDGTARFRRTSICSSAVNLLMLFSVVTTNLFALYAFSSHSQANSPLLHSSNNISLVSQHLSLILREIDSSQRKLAQMEKQMLGYESIDISRPNIVPELKLFLQRHQLPLGKDSRTGITEMVSSVGHSCGKSTDLLSQYMSYKVFDRCPDDWSLGQKLILRACEPLPRRRCLAKTVQKQDLSKSPDSLWRSVSNKSVNWSGLGCKSFDCLKGKKLSKECVGCFDLGVEKDRFVKVKGKNDFLIDDVLGLGSGKIRIGFDISGGSGTFAARMAEKNVTVITNTLNNGAPFSEFIAARGLFPLFLSLDHRFPFLDNVFDLIHASSGLDVEGKAEKLEFLMFDLDRVLKPRGLFWLDNFYCANDEKKKELTRMIERFGYKKLKWVIGEKADAQVYLSAVLQKPVRA

SEQ ID NO: 1514 - protein, 396 aa, Arabidopsis thaliana
MMLKLIKSMVQAITRPIQYLIISYLRYLVGPPSLTHHDNQVTVIIEETSENGRINVIHGATQAYLFDKINLDFVEEREFDDIYQGAKLKWRIFVDKNNIGNIPKQCFELRFDEKHRDLVFDSYIPFVESKAKEIKSKKRILEMHTYSHCCDTWETKILDHHSSFETIVMKEDLKRRLIDDIDLFISKEDFYKRVGRHWMRYYLLHGLPGAGKTSLVAAIAKYLNFDVYNITQGVKTDFDTRRLIRRVEDSSILLVEDIDTSLEGSKVALSQLLSSLTWPWSNGKARVVIFTTNNKERFDQTLLCRMEMKIYMGHCCFEDFKTLASNYLGISHDNDAPHRLYPDIKRLIDGQAVTPGQVVEELMKSQDVDVALQSLVRTLEMTSIISNKIDEDDKDL

SEQ ID NO: 1515 - protein, 178 aa, Arabidopsis thaliana
MMKPTSKSIQRVGRFLKKTLGSIKSTICSSDYKNLPNDTPLLSPYSCSRRCPEDSQTQTKESYTVICCDTAVADTTHQKSLNNQHKKKPKKVAEPFEDAKKRGDALAQKMKDLNMVDLRDVDHALDVREALRCYSSIRSPVYLDIVDNFFTDMYYEFSDPRTSAKINGSRRKAGSFRL

SEQ ID NO: 1516 - protein, 110 aa, Arabidopsis thaliana
METTKSNSSESDVNAKWDACLDLTARRFVYSSLGGAFAGLLFFRSPVTRWASIAFGAGIGIGSAYTDCSRVFDASSSTSATLLAAPKSTETSVSQVSRNLVLWDRFVRNS

SEQ ID NO: 1517 - protein, 553 aa, Arabidopsis thaliana
MELFTKGNNVKLRSHLDKFLVADDDQETIRQSRKGDARRAVWTVEPVVDKPNLIRLKSSHGTYLTASNKPLLLGMTGEKVTQTASFNKLMDWQTQWEPERDGFQVKLKSWCGKWMRANGGTPPWRNSVTHDEPHTSKTKNWLIWDVITIDGSDLENMSDGDESSVSSPVGSEFGSEPGSPVSARSTKSSISRFASLGLSTSPRWSSKPKSTASSFNQKETPVSVSAMEFFQKAKAIRMRNSHNKYLTADDDEETVTQNRNGSTKNARWTVEPVRDSFHVIRLKSCYGKYLTASNERFLLGATGKKVIQLKLSRVDSSVEWEPLREGSKIKLRTRSGNYLRGNGGLPPWRNSVTHDVPHLSATQDSISWDVDVVEILTDSEFKTESAKAPPPKTTSPPPHRRPTSSPLSAESPRTSSSLSDRSDSDVSTFPKFLKHLWFCLKLQLYRFPVIENFDFDFDQSVESPPKSDGRTIYYHVADEEGHVEDETTVGYAFTFKGNSVAELTQTLREETCMEDAVVCTRSPLNGKLFPLRLQLPPNNGTLHVILLPSSASL

SEQ ID NO: 1518 - protein, 245 aa, Arabidopsis thaliana
MPSGAKKRKALKKKKQQEAIGTSINGNDEHGSQDGRGSDSSLSSPGSQGNQEFGTKDSSALLSSAVVKGASKEISRDAGVTQGLGPKTGNAIVEKSTNSSSDNRTRPAKNVACGNSVTEITPVVDSVKPVVSISKTVTSEKSGLVETSTHSNLVKKKSEKDEEYHPSPVLENNNSKVVMLPRSAPETSKKVESVRKSEVPVSPEEKLAESSACMQPLLLPGPPVVRRTSWLSCCGLFDAMTGSDR

SEQ ID NO: 1519 - protein, 172 aa, Arabidopsis thaliana
MKESSRKQGAASPCAACKLLRRRCAQDCVFSPYFPADEPQKFANVHRVFGASNVNKMLQELPIHQRGDAVSSMVYEANARVRDPVYGCVGAISSLQQQIDVLQAQLALAQAEVVHLRVRQSTNFPGHGLCPDSPSSSGSPSSKQVSPQDNKGMFSHMDIVDEASLGESMWSC

SEQ ID NO: 1520 - protein, 314 aa, Arabidopsis thaliana
MESTKKQVSLELLPWLVVHTDGTVERLAGTEVCPPGLDPITGVFSKDIIIEPKTGLSARIYRPFSIQPGQKIPLMLYFHGGAFLISSTSFPSYHTSLNKIVNQANVIAVSVNYRLAPEHPLPTAYEDSWTALKNIQAINEPWINDYADLDSLFLVGDSAGANISHHLAFRAKQSDQTLKIKGIGMIHPYFWGTQPIGAEIKDEARKQMVDGWWEFVCPSEKGSDDPWINPFADGSPDLGGLGCERVMITVAEKDILNERGKMYYERLVKSEWKGKVEIMETKEKDHVFHIFEPDCDEAMEMVRCLALFINQVEA

SEQ ID NO: 1521 - protein, 398 aa, Arabidopsis thaliana
MSSLSRVLRGTFNTCPIRRFSSAATVVSEPTAVTAAISPPQKSLTSLVNGERNPKRIVEKFKKACESERFRTNIAVYDRTVRRLVAAKRLHYVEEILEEQKKYRDMSKEGFAARIISLYGKAGMFENAQKVFEEMPNRDCKRSVLSFNALLSAYRLSKKFDVVEELFNELPGKLSIKPDIVSYNTLIKALCEKDSLPEAVALLDEIENKGLKPDIVTFNTLLLSSYLKGQFELGEEIWAKMVEKNVAIDIRTYNARLLGLANEAKSKELVNLFGELKASGLKPDVFSFNAMIRGSINEGKMDEAEAWYKEIVKHGYRPDKATFALLLPAMCKAGDFESAIELFKETFSKRYLVGQTTLQQLVDELVKGSKREEAEEIVKIAKTNDFLKLKLNLPSQEE

SEQ ID NO: 1522 - protein, 208 aa, Arabidopsis thaliana
MSLVLRFRQHLSQTSSRLSLLSRIGGYRSYTQPAKIEDEEEEEFDQRKLPTDYDPATFDPTEHRSPPTDRVFRLVDEISSLTLLEISELGSIIMKKKGMTELPTVAVMKPGAGGGVGVGGGGGMVSQSGVSEEAKVEKTVFEIKLESFEASAKIKIIKELRSFTDLGLKEAKALVEKTPAILKAGLSKEEGEKILEKLKALGAKVVLE

SEQ ID NO: 1523 - protein, 292 aa, Arabidopsis thaliana
MASCLQASMNSLLPRSSSFSPHPPLSSNSSGRRNLKTFRYAFRAKASAKIPMPPINPKDPFLSTLASIAANSPEKLLNRPVNADVPPYLDIFDSPQLMSSPAQVERSVAYNEHRPRTPPPDLPSMLLDGRIVYIGMPTDDDIFCFQLVPAVTELVVAELMYLQWLDPKEPIYIYINSTGTTRDDGETVHTVCVGAAIGQACLLLSAGTKGKRFMMPHAKGEESEFDYFIFLIPVMQLQVITNRDILVELLSKHTGNSVETVANVMRRPYYMDAPKAKEFGVIDRVSLGTVIF

SEQ ID NO: 1524 - protein, 606 aa, Arabidopsis thaliana
MFPKSLAVSRKNSNLTKGVSGLRRLCSSSSTITGSPCPPRYDVAVIADLIEKQHWSKLGVHVTDINPNELFRQLISSELDPDLCLRYYSWLVKNSDISVSLELTFKLLHSLANAKRYSKIRSFLDGFVRNGSDHQVHSIFHAISMCDNVCVNSIIADMLVLAYANNSRFELGFEAFKRSGYYGYKLSALSCKPLMIALLKENRSADVEYVYKEMIRRKIQPNVFTFNVVINALCKTGKMNKARDVMEDMKVYGCSPNVVSYNTLIDGYCKLGGNGKMYKADAVLKEMVENDVSPNLTTFNILIDGFWKDDNLPGSMKVFKEMLDQDVKPNVISYNSLINGLCNGGKISEAISMRDKMVSAGVQPNLITYNALINGFCKNDMLKEALDMFGSVKGQGAVPTTRMYNMLIDAYCKLGKIDDGFALKEEMEREGIVPDVGTYNCLIAGLCRNGNIEAAKKLFDQLTSKGLPDLVTFHILMEGYCRKGESRKAAMLLKEMSKMGLKPRHLTYNIVMKGYCKEGNLKAATNMRTQMEKERRLRMNVASYNVLLQGYSQKGKLEDANMLLNEMLEKGLVPNRITYEIVKEEMVDQGFVPDIEGHLFNVSTKS

SEQ ID NO: 1525 - protein, 342 aa, Zea mays
MAANVALVLLSSCSPSTSAAAASLLPRRRFLPSRRRRASSRATTIMSALGDDPIREWILTEGKATQIKGIRSIGGGCINSAQRYDTDAGPFFVKTNSRIGPEMFEGEALGLKAMYDTKSIRVPLPYKVGSLPTGGSFIIMEFIEFGRSRGDQSDLGRKLAEMHKAAKSDKGYGFPVDNTIGSTPQINTWTDDWIEFYSKHRLGYQLELASRRYGDSAILEKGQRLIKNIRPLFDGAVIEPCLLHGDLWSGNISSDSNGDPVILDPACYYGHNEAEFGMSWCAGFGGDFYNAYFQVMPKQPGFEKRRDLYLLYHYLNHYNLFGSGYRSSAMSIIEDYLYVLAI

SEQ ID NO: 1526 - protein, 158 aa, Zea mays
MAMGLINANPIIHEKKERRIRQAPETTDENAAESIDQLEIFDHIRDIKDPEHPYSLEQLNVVTEDSIELNDESNHVRVIFTPTVEHCSMATIIGLCIRVKLVRSLPPYYKVDIRVAPGSHATEAAVNKQLNDKERVAAALENPNLLDMVEECLSPTFD

SEQ ID NO: 1527 - protein, 532 aa, Zea mays
PSHCAPSLPPCLRRLGGLPPPSLSRAKSAHQFPWIFELWKMPRWTENSASTKSAELVKQQDRLEFDDPDEVDEEEEVEYEEVEEEVEYEETEDEYGQTEAVRQVDAKHDSKMVDADTDEGGKGSHDELLALPPHGSEVYVGGIASDVSSDDLKKLCESVGEVVEVRMPGKSGRLYAFVNFRTKELASKAIQKLNNKDLKGKKIRVSSSQAKNRLFIGNIPYNWTENEFKKAAEEVGPGVLKVNLVKAPHSDTNKGYGFIEYYNQACAEYAKKMMSTPEFKLDKNAPNVSWADTKNGGESASTAQVKSLYVKNLPKAVTQEQLKKLFEHLGEVTKVVIPPAKAGHENRYGFVHFKERSMAMKALEDTERFELDGQLLDCSLAKPLADKKDDTSAPKGGPLLPSYTPVGYGLMGAYNPLGNGLAVAGAYNPYGNGLAGAYGVLGAHAAQPMLYVPGAPPGSTMIPMVLPDGRLVYVPQPAGQQPVPMTSPPPPQKGDRHYGGSGGSSSGGRRQQRRDDSGGSNTNSRRGRRRPY

SEQ ID NO: 1528 - protein, 174 aa, Zea mays
MDTMRGALERAKMLVGMEVDEESALPPPEEQSFFDDINRHCTLNTTQRLYGFAICLAAGLTCTFLSMLVFFNPVKFGVAFTLGNLMALGSTAFLIGPKRQFDMMLDSVRIYATAIYIASIIIALFCAIYVRSKLLTLVAIILEFGALIWYSLSYIPFARSIVSKVMTSCFDTDF

SEQ ID NO: 1529 - protein, 415 aa, Saccharomyces cerevisiae
MSVKRSVSEIEIESVQDQPSVAVGSFFKGFRAPSDTTFDLYKKKKSEKDEFVLHGENERLEYEGYTDSSSQASNQYVVGLFNPEKKSIQLYKAPVLVSKVVSKSSKNLRGPKIKSKSDTRPSALRNALGEAFGTKKAKKAIADLERNRIDSDKLTDSAIDIVDSVRTASKDLPTRAQLDEITSNDRPTPLANIDATDVEQIYPIESIIPKKELQFIRVSSILKEADKEKKLELFPYQNNSKYVAKKLDSLTQPSQMTKLQLLYYLSLLLGVYENRRVNNKTKLLERLNSPPEILVDGILSRFTVIKPGQFGRSKDRSYFIDPQNEDKILCYILAIIMHLDNFIVEITPLAHELNLKPSKVVSLFRVLGAIVKGATVAQAEAFGIPKSTAASYKIATMKVPFKLPEMTRRGRGPRR

SEQ ID NO: 1530 - protein, 449 aa, Saccharomyces cerevisiae
MGLCASSEKNGSTPDTQTASAGSDNVGKAKVPPKQEPQKTVRTVNTANQQEKQQQRQQQPSPHNVKDRKEQNGSINNAISPTATANTSGSQQINIDSALRDRSSNVAAQPSLSDASSGSNDKELKVLLLGAGESGKSTVLQQLKILHQNGFSEQEIKEYIPLIYQNLLEIGRNLIQARTRFNVNLEPECELTQQDLSRTMSYEMPNNYTGQFPEDIAGVISTLWALPSTQDLVNGPNASKFYLMDSTPYFMENFTRITSPNYRPTQQDILRSRQMTSGIFDTVIDMGSDIKMHIYDVGGQRSERKKWIHCFDNVTLVIFCVSLSEYDQTLMEDKNQNRFQESLVLFDNIVNSRWFARTSVVLFLNKIDLFAEKLSKVPMENYFPDYTGGSDINKAAKYILWRFVQLNRANLSIYPHVTQATDTSNIRLVFAAIKETILENTLKDSGVLQ

SEQ ID NO: 1531 - protein, 590 aa, Saccharomyces cerevisiae
MKTCYYELLGVETHASDLELKKAYRKKALQYHPDKNPDNVEEATQKFAVIRAAYEVLSDPQERAWYDSHKEQILNDTPPSTDDYYDYEVDATVTGVTTDELLLFFNSALYTKIDNSAAGIYQIAGKIFAKLAKDEILSGKRLGKFSEYQDDVFEQDINSIGYLKACDNFINKTDKLLYPLFGYSPTDYEYLKHFYKTWSAFNTLKSFSWKDEYMYSKNYDRRTKREVNRRNEKARQQARNEYNKTVKRFVVFIKKLDKRMKEGAKIAEEQRKLKEQQRKNELNNRRKFGNDNNDEEKFHLQSWQTVKEENWDELEKVYDNFGEFENSKNDKEGEVLIYECFICNKTFKSEKQLKNHINTKLHKKNMEEIRKEMEEENITLGLDNLSDLEKFDSADESVKEKEDIDLQALQAELAEIERKLAESSSEDESEDDNLNIEMDIEVEDVSSDENVHVNTKNKKKRKKKKKAKVDTETEESESFDDTKDKRSNELDDLLASLGDKGLQTDDDEDWSTKAKKKKGKQPKKNSKSTKSTPSLSTLPSSMSPTSAIEVCTTCGESFDSRNKLFNHVKIAGHAAVKNVVKRKKVKTKRI

SEQ ID NO: 1532 - protein, 295 aa, Saccharomyces cerevisiae
MSLRTPKRSRTSDEQEQEQEQEQVQNPDTHVNNEHQQRPGPTTLLSTPVRLKNGFGTPSPPSPPGITKSITKSRRRPSTTSLQGIFMSPVNKRRVGITAHGRVYDHNDDGHESESEDDENEEENENQKKYDGHVSMPLLPPTTPKSRRSEVFLSPSPRLRSPPTAARRSTGERPIREISHTLRTRLNYALVKLQNGWTDKTLPELETELAPAVQTPPRRYHNRFPDSADAGTSAHTAFLQALGGHPPREEATAVETLMLLSSPTKKQQHRPVPATSAGEPTDETEPESDTEVETS

SEQ ID NO: 1533 - protein, 231 aa, Zea mays
MEDWDSEDFQPVAPVVKVEPLKNQWADEDVDADDVKDSWEEEEEEEKPKPAAVQKNATKPSAKAPAKKGKQQASTSAEEPDEPLSPTSEKIRQQRLVEEADFKSTTDLFAKKSGEQKSLDTFIPKSESDFAEYAELIANKLLPYDKSFHYMALLKNVMRLSMTPLKGSDAKDISSSVTAIANEKIKAEKEAAAGKKKQGARKKQLHIEKGDDDFIPGRGGGYDDPDEYDFM

SEQ ID NO: 1534 - protein, 610 aa, Zea mays
MALKATAQGAAEAAVAAIGRGYDVVSDVRLKYCKGKLADPDARLIDVSRDGVQDVLLPGGIKVAAVPKSVTCDKGERTRFRSDVLSFQQMSELFNRELSLTGKIPSGMFNSMFDFSGCWQKDAANTKSLAFDGWYISLYTLALSKSRILLRDHVTQAVPSTWDPAALARFIDKFGTHIVVGVKMGGKDVIYLKQQHSSSLQPAAVQKRLKDMSDMRFLDGNGQYDMNNKHVHGKDKHDARDQRLRFVESSPSSSYCSKEDLVMVVKRRGGKEWDKDMPHSEWINTVQSEPDVISMSFLPITSLLSGVPGCGFLNHAINLYLRYKPPIEELHQFLEFQLPRQWAPVYSDHPLGPQRRKQSSASLPLSFMGPRLYVCTNMVDVGERPVTGIRLYLEGKKSNMLAIHLQHLCSLPQILQLQDDPYNHRYPEPEPEPYDRKYVEPFGSWKRFSHVYTAPVESDDDDSIVTGAQLHVSSHGLTKVLFLRLQFARVSNAALVKNPEWEGSPNLGQKSGLISTLISTHFSMAAQKPAPRPADVNINSAVYPGGPPTPVQAPKLLKYVDTAEMVRGPQDTPGYWVVSGAKLQLERGKISLRVKYSLLTAMVPDEEYEE

SEQ ID NO: 1535 - protein, 588 aa, Zea mays
MQAPEQQPQQQQQRRKGSSEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARRYLSSMRKKQPVPFTEKFPKADPAALKLLQRLLAFDPKDRPTAEEALADPYFKGLAKVEREPSCQPITKMEFEFERKKATKEDVKELIFREILEYHPQLLKDYMNGTEKTNFLYPSAVDHFRRQFANLEENGGKSGAHAASSDRKHVSLPRTTTVHSNPIPPNGTSQVPQKIPTGRPGRVVGPVIPFENAAAVDPYSQRRVSRNPVLPPTTSNMSAYAYHRKSDNSDRELQQELEKDRMQYQPAQRFMDAKVVSQMSPDLRSSYYIPKGVPKADPADRTALHSSMIHGIAPFSGIAAVGGGYNKVNAVQYGVSRMY

SEQ ID NO: 1536 - protein, 465 aa, Zea mays
MGGCLSQEEHRLQSRPAEAAGADGLRKSKSDSKAVASVLAPPKDVVDLQVEGYGNVNIFTYDELRAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVDWARPLLVHNRKLFRIIDPRMEGQYSTKAATEVASLAYRCLSQNPKGRPTMSQVVETFEAVQNMPECQDILLQNSITGAVTLYEVPKEPADRVELEKAKQEPAVKSAAMPPMNGKPVPQSRRTRPGNGRSKSEPSLECKMYIPSPDSDGHQLGLEAVASPDGSIRDPPDEDLYKI

SEQ ID NO: 1537 - protein, 502 aa, Zea mays
MATNGSSPRVRDTESSLEKVKRQLSSGSGRYLLQGPLLKRSETLRKWNERWVILDPTSGKMEYKLRRNETAIKGTILFDASSTITLSPVNFQGMPKYNGCCFYIGTPQKKDYFLCAETPGAAKAWVSTLHATQLVLRAHKEAVNSLAGNGSPATLGTVATAVANANATAMEATKEIEAALKVSMRAALGLDTNNSNEGQLDDLTIMKETLRVKDEELQHLAKDIRSRDATIKEIADKLTETAEAAEAAASAAHTMDEQRQLLCSEIERLKQALERQIEQSVVKLRQSEEKVISLSKEKEQLMKERDAAFQEAHMWRIELVKAREQAVIQEATIARAEEKARVSEADAAARIKEAAEKLHTVEKEKEELLALVGVLQSQVLREQSSTKQVCEERSESCSGADNSPLLTKHVDASDDDVDKACVSDSRSVPVSSDSTEVQLAVDGVDIRPVGDAEWSSFQQPEALIADVREVSPEADGGSLDIPVVNPPPVSDHIQGGGGATHP

SEQ ID NO: 1538 - protein, 430 aa, Arabidopsis thaliana
MKLKLSSISMNHKNVLLIKLISAILISFFAFRLFILHSSEFSPIFASVTGKFEARFLPPEIIVPENEDLIPQDIEVEKCDLFAGKWIPDSVGPIYTNKSCGSLIDGHQNCITNGRPDLDFLYWKWKPHDCLLPRFDPRRFLQLMRHKSWAFIGDSISRNHVESLLCMLSTIEEPVEVYHDMEYKSKRWHFPLHNLTVSNIWSPFLVQAAIFEDSNGVSTASVQLHLDRLDETWTSLMPSFDYAIISTGKWFLKSAIYHENAKLVGCHNCQEKPHIEELGFDYAYNASLHNVMDFLAAEDNSKGTVFFRTSTPDHFQNGEWHSGGTCKQTEPVSDEEIEIKDVHKILKDIEIDQFKRAVREKTNQDGGNLKLLDFTRMLLTRPDGHPGEYRQFRPFDKDKNAKVQNDCLHWCLPGPFDYLNDVILETIVNG

SEQ ID NO: 1539 - protein, 315 aa, Zea mays
MAAAWAVLAAVLVAAQVASAAPVTAPAFLWAPKNYGFRSDDAKEVVHYQTISPKNLAKSVLEEGGWSTFMCSREDTEKHVDVAIVFIGSKLQSSDISKDKQVDPALADTLKLSFTESEFSMAFPYVSTSDDEKLEESLLSGFTENCKSGFGRNRITYTDTCAVSGQDLKTYHNMDAINDLVVSGRTNPSGQTDVIVFCSGGFEKLGTTESEGELLSQLVDLLKLSGARHTILYASQPSGYLLENPSGSPVARHLAERTNGTKTGLLSKCDGECLVKSTLLEGTFVGIVLLIILISGLMCMMGIDTPSKFEAPQES

SEQ ID NO: 1540 - protein, 431 aa, Zea mays
MAMRAAARQAILSPPLGPRSPRPFLCGCSLSIAPRLEPCRAASSTTAPAAGKHLPPLFSVAPMMDWTDNHYRTLARLISRHAWLYTEMVVAETIVHQKDNLDRFLAFPEEQHPIVLQIGGSNLENLAKATELANDYSYDEINLNCGCPSGKVAGHGCFGARLMFDPEFVGDAMSTIAANCDVPVSVKCRIGVDDRDSYEELCEFVDKVISKSPTRHFIIHARKALLSGLSPAENRKIPPLKYEYYFALLRDFPEIKFTLNGGITNVSQVSASMRQGAHGVMVGRAAYNKFAGLSSPWNMLGHVDGEIYGKQTRYISRRQILENYQAYGDSIIDQYGPSRPNVRQLVKPLLNLFHSEPGNSLWKRKADSALRHCKTVKTFLEETLDAISDSVLDKPVNREPSSDEEYFASVDSLLPPKYTTPMHERLVAAST

SEQ ID NO: 1541 - protein, 665 aa, Zea mays
MAAARHGGYRSFDVARRREFDLERSRRSKEYRYSSRHRDSDRHRDGSRGREVPNGYIRHRSPYAPPKSRPSKRKDDKEPGEVSSDSGSESGGRPPVLREDGGLGVCRDGGALPASKKRKHSPGFHDTNVSKLRARDEVWSRRGPDAIAVELPLPSPPPMSAVGGCSPMDPEVLVVPNDAERMDAITEGEEDCATRNIFTSRWADAAEEEEVVIVPKKKKSVPPAHLPEQKSTKKIMGSELGEAMGSKTSRRSSSSSSNSMGSENWNIEVDEGDGIDSSVGCSLDTHSRSNMRRSGSPEVVRTPRRCFNMLQGCRSIDDFERINTINEGTYGVVFRVRDKKTGEIVALKKVKVDKENGREGFPLTSLREINILLSFDHPSIVDVKEVVVGGHDDDTFMVMEYMEHDLKGVMEAMKQPYSQSEVKCLMLQLLEGVKYLHDNWVLHRDLKTSNLLLNNRGELKICDFGLSRQYGSLLKPYTQPVVTLWYRAPELLLGAKEYSTAIDMWSLGCIMAELLSKEPLFTGKSEIDQLDKIFRILGTPNEERWHGCSKLPGFKGNFVKRPYNRLRDKFPAVSFTGGLTLSEAGFDLLNRLLAYDPEKRISAADALNHEWFREVPLPKMKEFMPTFPALNEQDRRIKRYMKSPDPLVEQQMKEQGSIGDHGLFD

SEQ ID NO: 1542 - protein, 451 aa, Arabidopsis thaliana
MTTALFSPSNRRKRRLTHFFFTVLAFILLAAFIYGHDFISFSRRSLHSPTIVHQSAIVVVVDEPPPPPPTSPPPPSPPPPSPPPPSPPPPSPPPPAFAVGKTPEGCDVFKGNWVKDWSTRPLYRESECPYIQPQLTCRTHGRPDSDYQSWRWRPDSCSLPSFNATVMLESLRGKKMMFVGDSLNRGMYVSLICLLHSQIPENSKSMDTFGSLTVFSLKDYNATIEFYWAPFLLESNSDNATVHRVSDRIVRKGSINKHGRHWRGADIVVFNTYLWWRTGFKMKILEGSFKDEKKRIVEMESEDAYRMALKTMVKWVKKNMDPLKTRVFFATMSPTHYKGEDWGGEQGKNCYNQTTPIQDMNHWPSDCSKTLMKVIGEELDQRAEFPVTVLNITQLSGYRKDAHTSIYKKQWSPLTKEQLANPASYSDCIHWCLPGLQDTWNELFFAKLFYP

SEQ ID NO: 1543 - protein, 339 aa, Zea mays
MAPLVPMSQPWVEKYRPRQVKDVAHQEEVIRVLNNTLQTADLPHMLFYGPPGTGKTTTALAIAYQLYGPELYKSRVLELNASDDRGINVVRTKIKNFAAVAVGTARKAGYPCPPYKIIILDEADSMTEDAQNALRRTTETYSKVTRFFFICNYISRIIEPLASRCAKFRFKPLSEEVMSSRIMHICNEEGLNLNAQAMSTLSVISQGDLRRAITYLQSAARLFGSSISSSDLISVSGVIPEDVVKSLLAACRSGEFDVANKEVSSIIADGYPVSQLMAQFLDVIVSADDIPDDQKARICKKLGETDKCLVDGADEYLQLLDVASETIRSLFNMPRTLVF

SEQ ID NO: 1544 - protein, 293 aa, Zea mays
MLRRNIRQRREYLYSKSLEGPQRALFEKKRRIRAALEEGKPIPTELRNEEHDLRRQIDLEDQERQVPKSIVDNEYATATIREPKILLTTSRNPSAPLTQFVKELKVVFPNSQRMNRGGQVISEIVEACRSHDITDLILVHEHRGQPDGLIVSHLPHGPTAYFGLLNVVTRHDIKDRKTMGKMSEAYPHLILDNFSTQIGERTATILKHLFPVPKPDSKRIITFANRDDYISFRHHVYEKPGGPKSIDLKEVGPRFELRLYQIKLGTVEQKEAQSEFVLRPYINTAKKQKTLGA

SEQ ID NO: 1545 - protein, 333 aa, Zea mays
MGSVASAAAPPSPHSALPQEGAPPYGPGLAGILPQTSVGEEKKEEKVDYLNLLCPVPFEEIQREALMSLKPELFEGLRFDFTKGLNQKFSLSHSVFMGSLEVPAQGSETIKVPTAHYEFGANFLDPKLMLIGRVMTDGRLNARVKCDLTDNLMLKVNAQLTQEAHYSQGMFNFDYKGSDYRAQFQIGNNAFYGANYIQSVTPNLSMGTEMFWLGHQRKSGIGFACRYNTDKMVGTLQVASTGIVALSYVQKISEKVSLASDFMYNHMSRDVTSSFGYDYLLRQCRLRGKIDSNGVVAAYLEERLNMGVNFLLSAEIDHCKKNYKFGFGMTVGE

SEQ ID NO: 1546 - protein, 530 aa, Arabidopsis thaliana
MGDSTGEPGSSMHGVTGREQSFAFSVQSPIVHTDKTAKFDLPVDTEHKATVFKLFSFAKPHMRTFHLSWISFSTCFVSTFAAAPLVPIIRENLNLTKQDIGNAGVASVSGSIFSRLVMGAVCDLLGPRYGCAFLVMLSAPTVFSMSFVSDAAGFITVRFMIGFCLATFVSCQYWMSTMFNSQIIGLVNGTAAGWGNMGGGITQLLMPIVYEIIRRCGSTAFTAWRIAFFVPGWLHIIMGILVLNLGQDLPDGNRATLEKAGEVAKDKFGKILWYAVTNYRTWIFVLLYGYSMGVELSTDNVIAEYFFDRFHLKLHTAGLIAACFGMANFFARPAGGYASDFAAKYFGMRGRLWTLWIIQTAGGLFCVWLGRANTLVTAVVAMVLFSMGAQAACGATFAIVPFVSRRALGIISGLTGAGGNFGSGLTQLLFFSTSHFTTEQGLTWMGVMIVACTLPVTLVHFPQWGSMFLPPSTDPVKGTEAHYYGSEWNEQEKQKNMHQGSLRFAENAKSEGGRRVRSAATPPENTPNNV

SEQ ID NO: 1547 - protein, 424 aa, Arabidopsis thaliana
MQPSRTRVSFFETGETMKQRKKSYLSIFVIFFSLFFFGIFMYNDNLKSSIADFTSSNPFSSSFVELPPDECDLFTGQWVFDNKTYPLYKEEECEFLTEQVTCLRNGRKDSLFQNWRWQPRDCSLPKFNARVLLEKLRNKRLMFVGDSLNRNQWESMVCLVQSVIPPGRKSLNQTGSLTVFKIQDYNATVEFYWAPFLVESNSDDPEKHSIIDRIIMPESIEKHGVNWIGVDFLVFNSYIWWMNTVSIKVLRGSFDDGDTEYDEIKRPIAYERVLRTLGDWVDHNIDPLSTTVFFMSMSPLHIKSSDWANPEGIRCALETTPILNMSFNVAYGQFSAVGTDYRLFPVAENVTQSLKVPIHFLNITALSEYRKDAHTSVYTIKQGKLLTREQQNDPANFADCIHWCLPGLPDTWNEFLYTHIISRR

SEQ ID NO: 1548 - protein, 425 aa, Zea mays
MQRDTSSSDVSASHVGRVRRRKHPSEASTDGNRANGQPLLVNDQNKYKSMLIRTYSTVWMIGGFAFIIYVGHLYIWAMVVVIQIYMARELFNLLRKSSEEKQLPGFRLLNWHFFFTAMLYTYGRFLSRQLVNTVTSDHLLYKVVSGLIKYQMFICYFLYIAGFVWFILTLKKKTYKYQFKQYAWTHMILLTVFAQSAFTVANIFEGIFWFLLPASLIVINDIFAYLFGFFLGRTPLIKLSPKKTWEGFIGASVTTIISAFLLANVMGRFQWLTCPRKDLSTGWLYCDPGPMFKPEHYSLGESVPHWFPWKDLAIMPVQWHALALGLFASIIAPFGGFFASGFKRAFKIKDFGDSIPGHGGITDRMDCQMVMAVFAYIYHQSFIAPQNFSVEIILDQILRNLTYEEQKYLYEQLGEMFHERQLGQS

SEQ ID NO: 1549 - protein, 519 aa, Zea mays
MAYTTSPSTSTSTAAAVAWAFAAATCVKLLLVPTYRSTDFDVHRYWLALTHALPVRQWYTDTSSQWTLDYPPFFAYFSRLLSLPAPLVDATLVSIPVRDATPFAHLIYLRLTVAFSDLLLLGSVLLLARDAQRKQRPFLALALVVWSPALLAVDHVHFQYNGFLIGLLLLSLHFLEQGWDLIGGVVFACLLCSKHLFLVAAPVYFMYLFRHYCCGRGVVKGLGRLVLMGSGVAAVFAAAFVPFVYYGQMQQLISRLFPFGRGLCHAYWAPNFWVFYIILDKILAFLLRRLGFNIAIPEASFTGGLVGDSSPFAVLPKVTPIATFLLVILAMAPCLIKAFSNPQPKHIIRWVSYACTCGFMFGWHVHEKASLHFTIPLALIAMDSLNDARHYFLLSIVSCYSLFPLLFENQEYLIKVLLLLTYAALMWVGFTVHFAAKSDLEGKKISRSGSTVKKNGIIGWIGLSYLLGIAGIELWSQVFHHHVFGDRLPFLPLIMVSFYCGLGMMYSWVWQLVHIVRHT

SEQ ID NO: 1550 - protein, 372 aa, Zea mays
MTPAAAISGSSSHVVVSSARLRQPFTLPPRTACPIAAAASPVTRRGVAVAAVSSPVVSAAAGKDAKQAPKDFLQIIDFDKDTIMKILNRAIEVKALIKSGDKSFQPFKGKTMAMIFAKPSMRTRVSFETGFFLLGGHAIYLGPDDIQMGKREETRDVARVLSGYNDIIMARVFAHQDILDLAKYASVPVINGLTDYNHPCQIMADALTMLEQIGRIENTKVVYVGDGNNIVHSWLLLAAVLPFHFVCACPKGFEPDANTVEIARSAGISKIEITNSPREAVKGADIVYTDVWASMGQKEEADYRKQKFQGFTVDEALMEIAGPQAYLMHCLPAERGVEVTDGAIEAPNSIVFPQAENRMHAQNAIMLHVLGA

SEQ ID NO: 1551 - protein, 134 aa, Zea mays
MAEKEAAAMWGGGDKLILRGLQFHGFHGVLQEEKTLGQMFVVDIDVWMDLAAAGESDCIADTVSYTDIYSIAKDVVEGTPRNLLESVAHSIAEATLLKFPQISAVRVKVGKPHVAVRGVLDYLGVEITRHRKKE

SEQ ID NO: 1552 - protein, 215 aa, Zea mays
MATAPVTSSMATNSTCVRLPSMPLRRAPAIVSFASRPWSTAMTSCTGLSRHSDVVAAAGHQKLMGSLNNNEGLMFGVVVARFNEVVTNLLLQGALETFERYSVKAENITVVSVPGSFEVPITAQKLGKSGKFDAILCIGAVIRGDTTHYDAVANSAASGVLNAGLSAGVPCVFGVLTCEDMDQALNRAGGKAGNKGAEAALTAIEMASLFRHHLG

SEQ ID NO: 1553 - protein, 448 aa, Zea mays
MPPRAAPALRVLPLALAAAIFSGLTAILFYLSGVSSSHSGSRLSEADLAALAALRGGFSKCVDANGLGLKAVTGEDYCRVVIQYPSDTVSKWRDPITHKAESLSFEFNLCEAVASWEHVRNSTTVLTKEYIDALPNGWEEYAWRRINKGILLNKCQNRSLCMEKLSLVLPETSPYVPRHFGRCAVVGNSGDLLKTKFGDEIDSYDAVFRENGAPTQNYTEYVGRKSTFRLLNRGSAKALDKVVELDETKKEALIVKTTIHDIMNQMIRELPITNPVYLMLGTSFGSSAKGTGLKALEFALSICDSVDMYGFTVDPGYKEWTRYFSEVRKGHTPLHGRAYYQMMECLGLVKIHSPMRGDPGRTVRWLPTKATIEAARVASEKLLKRPGAGSDDPLGTCTMIKKRRKGKAPNRSGLRDAAMKHLEDMKGAARYPLERNAGGGYLCMINDR

SEQ ID NO: 1554 - protein, 429 aa, Zea mays
MAGAVSALFLLDIKGRVLVWRDYRGDVSALQAERFFTKLLDKEGDSEVHSPVVYDDAGVTYMFIQHNNVFLLTAARQNCNAASILLFLHRVVDVFKHYFEELEEESLRDNFVVVYELLDEMMDFGYPQYTEAKILSEFIKTDAYRMEVTQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFIPPDGSFDLMTYRLSTQVKPLIWVEAQIEKHSRSRIELMVKARSQFKERSTATNVEIEVPVPSDATNPNIRTSMGSAAYAPERDAMVWKVKSFPGGKEYMCRAEFSLPSITAEEGAPEKKAPIRVKFEIPYFTVSGIQVRYLKIIEKSGYQALPWVRYITMAGEYELRLI

SEQ ID NO: 1555 - protein, 393 aa, Zea mays
MEHLRWRPTVNERDFIECALQSDLRVDGRHSFDFRKLKITFGREDGSSEVQLGETHVMGYVTVQLVQPYRDRPNEGTLAIFTEFSPMADPSFEPGRPGELAIELGRVIDRGLRESRAVDMESLCVVAGKHVWSVRVDLHILDNGGNLIDAANIAALAALSTFRRPECTVGGDDGQQVTVHDPEVRDPLPLTIHHMPIAVTFAYFGEGNIVVLDPTYKEEAVMGGRMTAIVNSNGDVCAIQKAGGEGVMSSVIMQCLRIASVKAADITSKIKKAVDSYTTEKALKKVKRLPTSVPQKINVTNVTMDGKGDGELEKQSVQMHSDVQQISKDPPTMVKASSREDAQPMTESSNAEVNTSSAVAAGESESHEIGSPKSLKDAIKPKHKRKKKKSDRS

SEQ ID NO: 1556 - protein, 601 aa, Zea mays
MAQIPNLDNAPLNLAALREQSQKDLFGILKNIRGKKCLVIDPKLAGTLSLVVQTSLLKEYGAEVRILSPEPLQTECPKIVYLVRSQLRFMKFIASQIKNDEPKGLQREYFLYFVPRRTVACEKILEEEKVHQKLTFGEYPLYLVPLDDDVLSLELDHSLQECLIEGDTSSIWHVAKAIHKLEFAFGVIPNVRAKGVASTKAAELLNSMQLEDPVNMDDMGIPEINTVILLDREVDMVTPMCSQLTYEGLLDEMLQINNGSVEVDASIIGAQQDGKKVKVPLNSSDKLYKEIRDLNFEVVVQVLRQKATSIQQDYAEVKSTNTQSVSELKDFVRRLHSLPEIARHVHLAQHLQSFTGKPSFHARLDIEQTILEVQNFEICFEYIEEMIHKQEVIENVLRLLVLLSLTNAGLPKKNFDYMRREILHSYGFEHMHLLYNLEKAGLLKRQESRSNWVGITRALQLIVDVNDTANPTDISYIFSGYAPLSIRLVQHAVRSGWRSIEELLKLLPGPHLDLKRGGLTINSSPEVHPGLGAQQSIDRVGHRSLVLVVFIGGVTFAEIAALRFLSAQEGMGYDFLVATTKVVNGNTILRPIIANSKEGMM

SEQ ID NO: 1557 - protein, 343 aa, Zea mays
MIPTRPAQASFRDRTNEFRAAVESARRHAVPSSSSAAAAPSSSSTRPLDGLIAATSARSEFNNRASKIGLGIHQTSQKLTRLAKLAKRTSVFDDPTVEIQELTAVIKKDITALNNAVVDLQALCNSQNESGSLSKDTSNHSTTVVDNLKNRLMSATKEFKEVLTMRTENLKVHENRRQMFSSSAAKDASNPFIRQRPLVARDPSESSVPPAPWASDSASTPLFQRKKTNGDHGASSSQPFAQQQQLAVQQDSYMQSRAEALQNVESTIHELSNIFTQLATMVSQQGELAIRIDENMEETVANVEGAQGQLLKYLNSISSNRWLMMKIFFVLMVFLMIFIFFVA

SEQ ID NO: 1558 - protein, 264 aa, Zea mays subsp. mexicana
  misc_feature (209)..(209): Xaa can be any naturally occurring amino acid
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMSCAINASCAALAFAGIPMKHLAVAISCGVMDNGVVILDTSRAEEQQARSFAHLVFPNSRKSVESKDPTQRDEESERGLITCITHGAMSEDXLFQLHREGCHGVLEDLGFHEEDTAEGGVQGCLTRDPAFLYKVVINWSSAELSFVS

SEQ ID NO: 1559 - protein, 468 aa, Zea mays
MATERRRASVVVLGDIGRSPRMQYHSLSLANQASMEVDIVANGGSDPHLSLRENPSIHIHEMKTVQLTGISKISGALSLLLKAAVQFILLVWFLCFKIPRPDVFFVQNPPSVPTLAAVKLASWLRGAKFIVDWHNFGYTLLGLSHGRSHIIVKIYFWFEKYFGQMADGAFCVTKAMQHELAQNWGIRATVLYDQSPDFFHPASLMEKHGLFSRLGNSMCSAMGNADCISVEEVGEDMNTTAFTSKIDGQVFLKPNRPALVVSSTSWTPDEDFSILLEAALMYDRRVAAALGEDDSMDEGQLWIDIKNGKQFVYPRLLFIITGKGPDRKKYEDQIKRLKLRRVALRTMWLASEDYPLLLGSADLGVSLHTSSSGLDLPMKVVDMFGCGLPVCAASFSCIEELVKVNKNGLLFSTSSELADELMMLFKGFPEECNALKSLKEGAMKSASSSKWSTEWETNALPLVDQVIG

SEQ ID NO: 1560 - protein, 71 aa, Zea mays
MIIPVRCFTCGKVIGNKWDLYLDLLQADYSEGDALDALELFRYCCRRMLMTHVDLIEKLLNYNTLEKTETS

SEQ ID NO: 1561 - protein, 470 aa, Arabidopsis thaliana
MTSSSNSGLRRFLFTPPQRLSQGICYWGAELSNNVSWTYKTKMVVRSKAGAVPLMKHGDRFLSSLSSPALAGDPSAINRHIKKFVAASPKSVALNVLSHLLSDQTSHPHLSFFALSLYSEITEASWFDWNPKLIAELIALLNKQERFDESETLLSTAVSRLKSNERDFTLFLCNLVESNSKQGSIQGFSEASFRLREIIQRSSSVYVKTQAYKSMVSGLCNMDQPHDAERVIEEMRMEKIKPGLFEYKSVLYGYGRLGLFDDMNRVVHRMGTEGHKIDTVCSNMVLSSYGAHDALPQMGSWLQKLKGFNVPFSIRTYNSVLNSCPTIISMLKDLDSCPVSLSELRTFLNEDEALLVHELTQSSVLDEAIEWNAVEGKLDLHGMHLSSSYLILLQWMDETRLRFSEEKCVIPAEIVVVSGSGKHSNVRGESPVKALVKKIMVRTGSPMRIDRKNVGSFIAKGKTVKEWLCK

SEQ ID NO: 1562 - protein, 176 aa, Zea mays
MSSDSSSWARALVQISPYTFSAIGIAVSIGVSVLGAAWGIFITGSSLIGAAIKAPRITSKNLISVIFCEAVAIYGVIVAIILQTKLESVPTSQMYDPESLRAGYAIFASGLIVGFANLVCGVCVGIIGSSCALSDAQNSSLFVKILVIEIFGSALGLFGVIVGIIMSSQATWPAKA

SEQ ID NO: 1563 - protein, 136 aa, Zea mays
MQFLRGSGGGGGGFPVVAWEVLRRHFSKKRSVDVRRINPKVPKEEAVAISGRLLQILSDHGPLTVANTWNHAKDAGIAGLNSKTHMKILLKWMTGRNVVKLTCVHVGNAKKFLYSPSTESSSSSAGASPSSTSASQ

SEQ ID NO: 1564 - protein, 314 aa, Zea mays
MAASNIGMMDGAYFVGRNEILAWINTTLQLGLSKVEEAASGAVACQLMDAAHPGAVPMHKVNFDAKTEYDMIQNYKVLQDVFNKLKITKHIEVNKLIKGRPLDNLEFMQWMKRYCDSVNGGFMSSYNASERRESSKGGKETNRRASVPSHTPAKSASTGHKAQASHGAKRASGQTAGAPQRSAKPSPVANSSGPAYDEQITELKLLVDSLERERDFYFSKLRDIEILCQNPEVEHVPVHAIQNILYTSEEDPQQQAPALSPIMEASEERPKQEAAHKRKSISDLDEFGMSSSSRQRLSDISDVQLCGSPLTSFS

SEQ ID NO: 1565 - protein, 376 aa, Zea mays
MSKKVGRAKKAAGGGELSRFLESHLQTISDTFQMMAESAPGALERTEWSEVVKLGDQVSRQATVAGMLWSGDLPDVETLKENIVAYFNILQGFLLVCHGSMVGAGPTLHKSIFGSAKDVVDSSFSLFKHAVSAYESRSSDRNTTIPQVTGTVWEACAALKKVPASNCIAIGRAMTRIGVCLKDVLREMNELPIGGSGDSTAEKSSNGVVDTTSCSDRDERSDLDLDDDDDDEFTEEEVAVAKLVINVVSDSLVVVKEAIRFITGLLRSSGNKDKDGANEDRVEPMEKLLSHCKEIADQVNDLGASVYPPQDSSEMELAIKRLYNGINGMRKEIGNLGGAPESTFAALEGFENCLGSLRARLADDVVNEMEGLNISH

SEQ ID NO: 1566 - protein, 377 aa, Zea mays
MAEREVVEGGTTTGGGLWRRYAPHVQMVLAQLCYTLMYFITEAAFNQGLNPYVYITYRHLLVAVLIWPFAYYLEKGLRPKMTLMLFVEIFVLSLLGVSLTLNMYFTSLKYTSPTFVTSVVNTIASMTFVIAIILRMEIVDVKSLRGVAKVAGTVVSFAGVTTMTLYKGAAITSLWKSPVQIAGSGSGGGGVAHDSWVKGSVLAVASCVCWSIWYIMQASSLKRYPAQLSLTAWMCTVGGIQSTVFTLFMQHEPEEWRIGFGVKFWSIVYSGLACNGFTVFVQLWCTEKKGPVFVTMFNPLSTIMVAILAYFIFGENLYVGSIVGGGVVILGLYMLLWGKEKDQERGTGKEREQLETDCEKQAKKVSDCVYEAPKTTK

SEQ ID NO: 1567 - protein, 141 aa, Zea mays
MGIGEHFEGVKQHWASNFAFLDYFKKVYGRAEPLPKWSDADVDEFIASDPVYGPQLKALRESRKFALAGALVGAAHLGGVALKYSKAPHGVLLATGFGAITGAVLGSEVADHWYQLYEMDKQGANLRFIYWWEDKVSGQKS

SEQ ID NO: 1568 - protein, 118 aa, Zea mays
MAKLALALLLLLAVAASASASSGSHLDLDLGFLSSGERRRECRGTVAECLAEESDEEGLDLAGSHRRALYGGGYISYGALRRDNVPCSRRGASYYNCRPGGQANPYHRGCSRITRCRG

SEQ ID NO: 1569 - protein, 574 aa, Zea mays
MEAAADEERPLIQYLAPEDDEASSRYTSDGTLDINKQRALKKSTGNWRACFMILGTEFAECLAFYATAKNLVTYLTAELGETNIDAATNVSTWIGSCYLTPLIGAFLADTYWGRYKTMIVFLLLYIVGMLTLTASAWLPLAMEDDSPDNSGLRRATAYLGLYLVSLGTGGIKPCTAALGADQFDGGDAAERVTKASFFNWYYFCTNIGSLLSGTVLVWVQENIGWGVGFTVQTVFMLFGLAVFVAGRKVYRYKKLGGSPLTRVAQVVVAAVRNCHLVLPDDTSALYHDKLLPTEPNFRIESARQFRFFDKAAIITGEKGAAAPTSPWRLCTVSQVEELKMLLRLLPVWASMVLFFAVSAQTVTTFIEQARVMDNRIGPFTIPPASIATFDVISVMVCVPVYDAVLVPLARRATGNDRGLSQLHRLSIGIALSVVVMVYAALLEGRRLALARANMPAMNIAWQAPMFAVHGAAAVFATVGVLEFFYDQSPDGMKSLGNALALLSMAAGSYFNSLALSAVGSITARGGERGWLPDDLNKGHMDYFFWMMAALGTLNLLHFLHYCNRRYRGNNNNTS

SEQ ID NO: 1570 - protein, 461 aa, Zea mays
MGERAKEWLLAAGAGAAVGALSAAAVMDLLSRSKRRERYARDLLESNAMTTGTRAGNTRSSKHLGSVASSALLSDEVVSEQLTRNIQFFGMDSQKKVTESYVVVIGLGGVGSHAASMLLRSGVGRLLLVDFDQVSLSSLNRHAVATRDDVGTSKALCLKKHFSMIYPECQIDAKVQLYDASSEEEILSGQPDFVLDCIDNIDTKVSLLAACVRRGLKVLSAMGAGARADPTRIRVAYLRESSNDPLSRSVRYRLKKEHGIEGGIPVVFSLEKPKAKLLPFQASKEEETPSDYQIVPGFRVRIIPVLGTIPAIFGQVMASYVVTQLAGLDFQTEPVVNLDLDHYRILHQRLIEHEELMYGTAEQVLVDAEEVMYIVKELWRGRSARDQSQDTGRKMWRSVNELMLVRWDKSKAAGISNLILVKFSEADAHESTTLDRIKEQEPEFYSMVSRVLKRAEMEFAL

SEQ ID NO: 1571 - protein, 595 aa, Arabidopsis thaliana
MSPFSETSVLLLPMVEKCINLLQTYGVSSITKLRQIHAFSIRHGVSISDAELGKHLIFYLVSLPSPPPMSYAHKVFSKIEKPINVFIWNTLIRGYAEIGNSISAFSLYREMRVSGLVEPDTHTYPFLIKAVTTMADVRLGETIHSVVIRSGFGSLIYVQNSLLHLYANCGDVASAYKVFDKMPEKDLVAWNSVINGFAENGKPEEALALYTEMNSKGIKPDGFTIVSLLSACAKIGALTLGKRVHVYMIKVGLTRNLHSSNVLLDLYARCGRVEEAKTLFDEMVDKNSVSWTSLIVGLAVNGFGKEAIELFKYMESTEGLLPCEITFVGILYACSHCGMVKEGFEYFRRMREEYKIEPRIEHFGCMVDLLARAGQVKKAYEYIKSMPMQPNVVIWRTLLGACTVHGDSDLAEFARIQILQLEPNHSGDYVLLSNMYASEQRWSDVQKIRKQMLRDGVKKVPGHSLVEVGNRVHEFLMGDKSHPQSDAIYAKLKEMTGRLRSEGYVPQISNVYVDVEEEEKENAVVYHSEKIAIAFMLISTPERSPITVVKNLRVCADCHLAIKLVSKVYNREIVVRDRSRFHHFKNGSCSCQDYW

SEQ ID NO: 1572 - protein, 420 aa, Zea mays
MAAPLLPSSVSVLLSLHIALLLVLCSSQVGDSCSSVRDCGTGLYCGNCPAAGRTKLSCIRDLAIQPTSIVKGLPFNRYSWLVTHNSFSILGEPSRTGVERVTFYNQEDSVTNQLRNGVRGLMLDMYDFNDDVWLCHSLQGQCYNFTAFVPAVDTLKEVEAFLSENPTEIITIFIEDYVHSPMGLSKVFTAADLMKYWYPISEMPTSGKDWPSVTDMVAKNRRLLVFTSDASKEASEGVAYQWSYLLENEPGDPGIVPGSCPNRKESQPLNSRPASLFLQNYFPTIPVQNEACKENSGLPQMAQACYAAAGNRIPNFIAVNFYMRSDGGGVFDVQDRINGRTLCGCDTIAACQAGAPMGACKDTGAPNQTTSPSVNGNVYSGTIEFKTHSTSAASNNNIRSRSVFLLRLQLTLLLFFSFRL

SEQ ID NO: 1573 - protein, 460 aa, Zea mays
MLRLRACGGTAPASVPALVRSRLSRRSSSTAYAAATVASASSSSSTLEDLAAEHRGLAKVILKKGKTQIFRDGSPMVYSGAVDRIIGRPPPKSGDIVLVADGTEKPIGWGLYNSVSMFCVRLMQLEEEARRDPTCTLNMERLLEARISSAVGLRRSLGLPSTDTNAYRLINSEGDRLSGLIVDIFADVAVIASSAAWVEKYRQEIQFLVSTVNGVSHIKWRPSTDILKEEGLDISEHKEPASPCSTVKVMENGIIYLVSLEGQKTGFYADQRENRYIISLLSKDQRVLDLCCYSGGFALNAAKGGADNVIGIDSSGSALDLANENIVLNELNQGKVSFVKGDATTFMKGAISENELWDLVILDPPKLAPRKKVLQSASGMYRSLNALAMQVVKPGGLLMTCSCSGAMTQSGMFLKTIQGAASMAGRKVTVLRQAGAACDHPIDPAYPEGQYLSNYLLRVA

SEQ ID NO: 1574 - protein, 556 aa, Synechocystis sp.
MFDAIDAALADIKAGKAVVVVDDENRENEGDLICAAQFATPALVNFMAVEARGLICLAMTGDRLDELDLPLMVSKNTDSNQTAFTVSIDAAPHLGVTTGISAEDRARTIQIAINPVTRPEDLSRPGHIFPLRAKTGGVLKRAGHTEAAVDLSRLAGLYPAGVICEIQNADGSMARLPELVEYARKYDLKLISIADLISYRLQHDRFVQRETICEFPSQFGEFKLYAYRNLLDQTEHIAIVKGDPSEFGQQPVMVRMHSECLTGDALGSLRCDCRMQLQAALKMLENHGLGVVVYLRQEGRGIGLVNKLKAYSLQDLGYDTVEANERLGFPADLRDYGMGAQMLNDLGVKQIRLITNNPRKIAGLKGYGLEIVERVPLLIEANDYNSHYLTTKAEKLGHWLVKNYLLAIAIKFTPNVASAQQRYEKLEKIRALLQGTPLMVHEDNRPVAIALFGKNSLIFHVGLDQNLPSGQPWQKHDHSPYPALVKDFLVQLKQWPDLQALAFLIAQGKDPMETLQVSLDRENVSFADLTADALNQWQPQTVYTYSKQGSGEMTNR

SEQ ID NO: 1575 - protein, 81 aa, Zea mays
MVANGDAPARGSAAAAASLRRRRTTSGAAAGGGGASSMLQFYTDEAAGRKMSPNTVLIMSIGFVAVVAVLHVFGKLYRTSN

SEQ ID NO: 1576 - protein, 143 aa, Zea mays
MLKFLSKVVVEYCPLDPRKAAAVELLAQCNGRKAKDSNPACSVELRRLPSPAPSTDLKSQPTLPPPRVLVTYFTGAEEAIVFAEGATAQGIRDQIVARGRLIDTEKMFRDGGEKWPVVIPEEELGMSFPGIKPKKAEDKPQAE

SEQ ID NO: 1577 - protein, 115 aa, Zea mays
MLAATDPMLWHKVAAVSGVAALGLGTYGAHMFRPKNPVYKEVWHTASLYHLVHTAALLGAPITKRPNVFGGLLTAGIVLFSGTCYTVAYLEDRKFSSPAPLGGFAFIAAWASLLF

SEQ ID NO: 1578 - protein, 285 aa, Zea mays
MSTSEVWSLSDFEISKYIGEGRFGKVYLAREKQSGYVVALKVIFKAKLQKYHFHAHLRREIEIQQSLDHPNVLRLFTWFHDEERVVLVLEYAARGELYKVLRAAGRFTERTSATYVASLAGALAYCHKKQVIHRDIKPENLLIDIEGRLKIADFGWAARSNAKRHTLCGTIDYLAPEMVEKKAHDHAVDNWTLGILCYEFLYGSPPFEADEQDDTLRRIVRVDLAFPSSPCVSSEAKDLISKLLVKDSSKRLCLEDIMKHPWIKKNADPSGSCIKQKDVTRSKLL

SEQ ID NO: 1579 - protein, 210 aa, Zea mays
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKAEPAAEATSREVAVEEKKEEAEPAAATEAAPAPAETPSEEAVVEEKKEEEKKEEEDKPAAEEAAPPAAAAAAEEK

SEQ ID NO: 1580 - protein, 525 aa, Agrobacterium tumefaciens
MTQIAHPDSILIIDFGSQVTQLIARRIREAGVYCEIHPFQNAAEAFEKLQPKGVIFSGGPASVTAEGSPRAPQAVFDSKVPILGICYGQQTLCTQLGGVVEGGHAAEFGRADIDIKKASPLFEGFWEQGKSYPVWMSHGDRVTKLPEGFEVIATSENAPFAIAADEKRHYYTTMFHPEVVHTPDGGKLLSNFVHKIVGLKSDWTMAAYRAEMIRKIREQVGTGRVLCALSGGVDSSVAAILIHEAIGDQLTCVYVDHGLMRLGESEQVVGMFRDHYNIPLVHVDAADLFLGELSGVSDPEVKRKTIGRLFIEVFEAEAAKIAADGKGAPKFLAQGTLYPDVIESVSFSGGPSVTIKSHHNVGGLPERMNMQLVEPLRELFKDEVRALGRELGLPESFIGRHPFPGPGLAIRCPGAITREKLDILRKADAIYLDEIRKAGLYDTIWQAFAVLLPVQTVGVMGDYRTYDFVCALRAVTSVDGMTADFYPYDMNFLGRAATRIINEVRGINRVVYDVTSKPPGTIEWE

SEQ ID NO: 1581 - protein, 194 aa, Zea mays
MAATALLLPSLAALTDTPRRAHRLLQPQLQLQRGSLVSRSLRPPRRRRLAVSAVQETKEGEAKTADEITEKYGLEFGLWKVFSSKEEEGGEGKKSRTDQAKELLAKYGGAYLATSISLSIVSFTLCYLLVSAGVDVQDLLAKVGIVTGETGGKVGTFALAYAAHKAASPIRFPPTVALTPVVASWIGKIRKGGD

SEQ ID NO: 1582 - protein, 490 aa, Bacillus halodurans
MDFHTDTIILLAGLLFIVGVITAKFSTRLGVPALVLFILVGMLVGSDGLGLIHFDFSQAHFAQLIGIFALVIILFEGGLQTKWKTVQSVAVPSLSLATFGVLITSTLVAVAAKYVLGVSWLEAYLFGAIVGSTDAAAVFAVLKEQNIKDRLATTLEAESGTNDPMAVFLTLSLIELITIGSMNPLHLFGSFLWQMGAGLILGFGLGKLGSYSINKINLDSSGLYPVFALAFALLTYSVTAMIGASGLLAVYVAALVIGNQDLTYRHSIFRFNEGFAWMMQMLMFIILGLLVFPNQLFEASIFIKGILLSLILMLVARPVAVFLTTIKMRFDWKEKLFLSWAGLRGAVPIVLATFPMTAGLENSPLFFNVVFFVVLTSALIQGSTIAHFANKLQLTGPQKTTPLHSLELVSIGKANAEIVELEMKQDTPVIGKTLEEINLPKDVLVNAIIRDEQLITPYGKTTIQADDILYVLVSKKKKRQLKELFQAKES

SEQ ID NO: 1583 - protein, 516 aa, Chlorobaculum tepidum
MATSLQSVIVLDFGSQYTQLIARRIREIGIYSEIFPYHTKAETIRAHQPKAIILSGGPNSVYDEKAFMPDPEVFSLGVPVLGICYGLQAIAKHFGGNVESSSKQEFGRAKMLVNHDESESLLFRDIPDSDVWMSHGDKVTQLPEGFRVTASTANAEVCAIESFGSKAALKVYGLQFHPEVQHSLYGKQLLSNFLIDIAGITPDWSPKSFIQHQIEEIKRVAGDSTVVCGISGGVDSTVAAVLVSKAIGDKLHCVFVDNGLLRKDEAVKVMEFLKPLGLNISLVDASDLFLGRLKGVASPEKKRKIIGRTFIQVFEKNIHDEKFLVQGTLYPDVIESVSVKGPSETIKSHHNVGGLPKRMKLKLIEPLRELFKDEVRAVGRELGIAEDILMRHPFPGPGLAVRVLGSLTRERLDVLRDADQIFIDELKSSGLYSKVWQAFSVLLPVQSVGVMGDKRTYENVLALRAVESTDGMTADWAHLPHDFLAKVSNRIINEVRGINRVVYDISSKPPATIEWE

SEQ ID NO: 1584 - protein, 284 aa, Arabidopsis thaliana
MKLYEHDGVDLEDGKTVKSGGDKPIPRKIHNRALLSGLAYCISSCSMILVNKFVLSSYNFNAGIFLMLYQNFVSVIIVVGLSLMGLITTEPLTLRLMKVWFPVNVIFVGMLITSMFSLKYINVAMVTVLKNVTNVITAVGEMYLFNKQHDNRVWAALFLMIISAVSGGITDLSFNAVGYAWQIANCFLTASYSLTLRKTMDTAKQVTQSGNLNEFSMVLLNNTLSLPLGLLLSYFFNEMDYLYQTPLLRLPSFWMVMTLSGLLGLAISFTSMWFLHQTGATTYR

SEQ ID NO: 1585 - protein, 620 aa, Escherichia coli K12
MDSHTLIQALIYLGSAALIVPIAVRLGLGSVLGYLIAGCIIGPWGLRLVTDAESILHFAEIGVVLMLFIIGLELDPQRLWKLRAAVFGCGALQMVICGGLLGLFCMLLGLRWQVAELIGMTLALSSTAIAMQAMNERNLMVTQMGRSAFAVLLFQDIAAIPLVAMIPLLATSSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLLENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 1586 - protein, 478 aa, Escherichia coli K12
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDMVAFEVAQFVEKPNLETAQAYVASGEYYWNSGMFLFRAGRYLEELKKYRPDILDACEKAMSAVDPDLNFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 1587 - protein, 437 aa, Bacillus halodurans
MDARSLISLIPSLSAYKWYGKVTRVIGLTIEAKGPQASIGELCYILVGKQGTKVMAEVVGFKEERVLLMPLNGTAEIAPGSLVEGTGRPLQVKVGYSLIGHVIDGCGRPLTGEALPNGLTPYPTDNPPPNPISRPRIKEAMHLGVRAIDGLLTVGKGQRVGIFAGSGVGKSTLLAMLAKNAAADLNIIALIGERGREVKDFIERDLGEDGLRRSIIVVATSDQPALMRIKGAMTATALAEYFRDQGLHVNLMMDSVTRFAMAQREIGLAVGEPPTTKGYTPSVFALLPKLLERAGTNGKGSITGFYTVLVDGDDLNEPISDTVRGILDGHFVLDRELANKGHYPAINILKSVSRVMNDIVTDEQKRAAEHVRSLLSVYKESEDLINIGAYKRGSSKQIDEAIERQPEVISFLRQNTDEVAIAEHSIQQLIQAFGKGD

SEQ ID NO: 1588 - protein, 427 aa, Chlorobaculum tepidum
MMSNNQFDSIESAIEDIKNGKLIIVVDDEDREDEGDFIAAAEHVTPEMVNFITKEARGLLCVAIPMERARELQLEPMVQRNTSQHETNFTVSIDAIAEGVTTGISAYDRYMTLKMLADPSSTADDFSRPGHIFPLRAMDGGVLRRVGHTEAAVDLCRLAGCQPAGLLCEILHDDGSMARVPELLKLKEKLGMKLITIKDLVAYRMQRSKLVHRAVESKLPTAYGEFKLIAYETIVDQQNHMAFVKGDVGNGEPVLARVHSQCATGDTFGSLRCDCGHQLETALRMIEKEGRGVLIYLMQEGRGIGLINKLKAYNLQDEGFDTVEANEKLGFKPDLRDYGIGAQILQDLGVRKMRLMTNNPKKIVGLEGYGLEIVERVPLEIEPNEVNRHYLQTKRDKLGHMIQMASGNERILFERLADEQLKQHKKD

SEQ ID NO: 1589 - protein, 543 aa, Corynebacterium glutamicum
MTISSPLIDVANLPDINTTAGKIADLKARRAEAHFPMGEKAVEKVHAAGRLTARERLDYLLDEGSFIETDQLARHRTTAFGLGAKRPATDGIVTGWGTIDGREVCIFSQDGTVFGGALGEVYGEKMIKIMELAIDTGRPLIGLYEGAGARIQDGAVSLDFISQTFYQNIQASGVIPQISVIMGACAGGNAYGPALTDFVVMVDKTSKMFVTGPDVIKTVTGEEITQEELGGATTHMVTAGNSHYTAATDEEALDWVQDLVSFLPSNNRSYAPMEDFDEEEGGVEENITADDLKLDEIIPDSATVPYDVRDVIECLTDDGEYLEIQADRAENVVIAFGRIEGQSVGFVANQPTQFAGCLDIDSSEKAARFVRTCDAFNIPIVMLVDVPGFLPGAGQEYGGILRRGAKLLYAYGEATVPKITVTMRKAYGGAYCVMGSKGLGSDINLAWPTAQIAVMGAAGAVGFIYRKELMAADAKGLDTVALAKSFEREYEDHMLNPYHAAERGLIDAVILPSETRGQISRNLRLLKHKNVTRPARKHGNMPL

SEQ ID NO: 1590 - protein, 807 aa, Zea mays
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEIIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRSKDNPEAMEEDEVDDIAEIKAAHFEESMKYARRSVSDADIRKYQAFAQTLQQSRGFGSEFRFPDQPTAAAAAADPFASAAAAADDDDLYS

SEQ ID NO: 1591 - protein, 170 aa, Zea mays
MPPSASMPATHTAVYVAAVPLRAPKGPAQLLMSAGYSLGMWDLQHFMVLLRPDPALAQALVFDFQPRDPEDVLAALAVLSRREIPGVVRRRTLRRVPDRRCWLVGHCCDAVGAATRFSERWTTGLVVGEHDCRDYTDGLVEVLTGEKRVLESLRLRGNGSSTSTSGAAPP

SEQ ID NO: 1592 - protein, 132 aa, Zea mays
MSRSLGIPVKLLHEAAGHVVTVELKTGEVYRGSMVECEDNWNCQLENITFTAKDGKVSQLEHVFIRGSRVRFMIIPDMLKNAPMFKRLEARIRGKGSAVGVGRGRAVAMRARAAAGRGGGPVGRGGAPPVRR

SEQ ID NO: 1593 - protein, 520 aa, Zea mays
MGEAQDYYNTSTALAGAAAAGLALLAVCSYYLLVGRRRGKAPKRYAPVVGTVFHQLYHVRRLHDYHTDLFRQRKTFQLLVPAGRRQIYTCDPAVVEHILRTNFANYGKGSFNYENMTDLLGDGIFAVDGDKWRQQRKIASYDFSTRALRDFSGAVFKRNAARLAGIVSGNAASGQPMEFQGLALRATMDSIFTIAFGLDLDTLGGSAEGSRFAAAFDDASEFTLLRYVNAFWKAQRFLGVGSEAALKKRVKVVDEFVYKRIRERAQELSDSKMATEDTVPDSRQDMLSRFIHTATNESGTVDYKYLRDIILNIVIAGKDTTAGALAWFLYMACKHPEIQEKICQEAAKATSASETAGVDEFAQSLTDEALNKMHYLHAALTETLRLYPSVPLDNKQCFGDDVLPDGSSVSKGDIVFYVPYAMGRMEYLWGKDAEVFRPERWLDQDGEFQQESPFKFTAFQAGPRICLGKEFAYRQMKIFAAVLLRFFVFRLRDGDKASVNYRTMITLHIDEGLHLTATAR

SEQ ID NO: 1594 - protein, 426 aa, Zea mays
MEMEQLCSLLRDLDALKQHPDDLTSTIDRMRERLVAMMNPAAGAASRSKIKDMSAEVVDNNPYSRLMALQRMGVVENYERIRDYSVAIVGIGGVGSVAAEMLTRCGIGRLLLYDYDTVELANMNRLFFRPEQVGMTKTDAAVQTLSGINPDVVLESYSLNITTVKGFETFLASLKAQSSHERSTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLNFGQVSPYLGYNSLKDYFPAMEMRPNPQCLNPACVHRQKEYMESKPARDAAAKTKMEAEASTENECPVHLDNEWNISVLDDEETETSSIRNTPDILPEGLVRELPDADSYAGPAAPVSSSAIDDDDDLEELQRQLDALNAS

SEQ ID NO: 1595 - protein, 452 aa, Zea mays
MASGATLSWVKTPFDTRRFHDLSNLSFRCRNPFGSIQPWWLQTDQDSSLIKVRVAADYSDSMPDSKYTRDRGYHPLEEVKERPKKKDLLLTDIETARTVVEANSKGLLVFPARVHNEPHGHVSWSEFQYVVDEYGDIFFEVPDSENILEDDTANNPVTVLIGMDGPIIGESSVAISDFSDYMDGENFMDVPDEHHTKIDTEITDILIEWGMPATMRAIHPIYFAKCLTKAIHNNNGEKMDSPSNGLSIVGYLRPAFIEEESYLRSMFHGDNGGYSSDWKVNETDEYNRETRPVSGTNRLIDDDKSRFDFNHAETRTDSMIYKLEIMTIELFSMYGKQFKIDPQDFQDSEPDILANSASSIIERIKENSDQCAAALRSLCRRKKGLTVEEASLIGVDSLGIDVRAFSGLEVKTVRFSFNAQALSERSAEKKIRRMLFPRYQRKNVKASTEDES

SEQ ID NO: 1596 - protein, 249 aa, Zea mays
MPPNRKRRAAAMDPAAGGAGQQRQNKASAGKKVKKGGGSGGRWPAVKPKKDLQINRLKGTHLLTIPDFFTSAEAKAFIDIAESMGFTHQGSLGPLKGEAYRDNDRISVTDPLLAQAIWESGINRIFTDISVSGKVATGLNPNIRFYRYTEGQRFGRHIDESVSLADGSKTYYTLLIYLSGKGSAKDSSGQALVGGETVFYDQRGGVVAEVAPVQGMALLHLHGAKCMLHEARVVKKNAKYVLRSDVVFS

SEQ ID NO: 1597 - protein, 443 aa, Zea mays
MFKLARSSQFASALKGAYSAPIRQSAFQQRRNLSIHEWRSAQLLDSYGIKVAKGNVAHNAKEAEEVAKTIEGDDMVIKAQVLAGGRGKGHFDNGFKGGVRIVYSPREASILADQMIGHKLITKQTGERGRICNSVYIVERKFARREFYLAILMDRATQSPIIVASSQGGMDIEAVAKESPESIITTPVDIHVGVTDEMAKKISTELGFSPQCIDAGADTIQKLYKLFMEKDATQIEINPLSETSDHQVMCMDAKLGFDDNADFRQKEVFEWRDVTQEDADEVKAAEQGLNFIKLDGDIGCLVNGAGLAMATMDIIKLNGGAPANFLDVGGGATPKAIKSAFDLITADPKVTAIFVNIFGGIVRCDDIAKGLISVAETMNLRIPIIARLQGTNMEAAQKLIDESGLKIFSINDLQSAAEKSVQFSKIVKTARDIDVGVEFNLGI

SEQ ID NO: 1598 - protein, 197 aa, Zea mays
MAVLLWRCICGPQQSFSKNRGASTPSPPAGRRSKYSGQSVKAMPMRLLTVGKKRYRGTQLLVEEYKEKLGHYCEFEDTLIRSNPKLTSDVKVQVEAEDTAMMQQLKSDDFVVVLDENGKDVISEQIADLIGDAGNTGSSRLTFCIGGPYGLGLQVRERADATIRLSSLVLNHQVALIVLMEQLYRAWTIIKGQKYHH

SEQ ID NO: 1599 - protein, 305 aa, Zea mays
MLRTLARMAPKNWTKESFTLNTGAKIPAVGLGTWQSKPGEVREAVKAALQGGYRHIDTALAYGNEKEVGQGIKDSGVPREEIWVTTKLDNPWHKRVEEGINSSLSSLGLDYVDLYLMHWPSSTDPDDLKKHYPDWDFKDTWAEMQKLPESGRVKNIGVSNFAIKNLEKLFADSRFKITPAVNQIELHPNNPSPKLLDYCKEKGIHCTAYSCLGSTDSPLYKNEKLKKLAESKGKSVQQVLLMWGLQRGTSVIPKSVTASRIMGNFELDGWELTDEEMKEISSLPERFKVCGDAWLPVKVFFGDDE

SEQ ID NO: 1600 - protein, 742 aa, Saccharomyces cerevisiae
MGSSINYPGFVTKSAHLADTSTDASISCEEATSSQEAKKNFFQRDYNMMKKAPAPTKSKLSLALQTSKSSSSANGTVQEDTSSKTEDFSTKSIKKKPDSGVESHVSIQSDSGPQSDSDLDSDSSISSCDERNEESLKDYRPGGYHPAFKGEPYKDARYILVRKLGWGHFSTVWLAKDMVNNTHVAMKIVRGDKVYTEAAEDEIKLLQRVNDADNTKEDSMGANHILKLLDHFNHKGPNGVHVVMVFEVLGENLLALIKKYEHRGIPLIYVKQISKQLLLGLDYMHRRCGIIHTDIKPENVLMEIGDVEGIVQMVEALDKQKREAKRLQRHVSRSSDITANDSSDEKWAECQTSMPCGSSSNSKSRSIEKDLSKRCFRRPRRHTIITGSQPLPSPISSSNFFEMRAHFCGSSHNSFSSVSGNRNIPSSINNNSINNGIGIKNSNNSFLNSVPHSVTRMFINEDSNDNNNNDNSKNKNNNNNNSNNNNNEDIMNTPLHEEQLADSLSTFDISNISQSSDTNGPYISNTMDSNSNVSTDINSPENLIQIKIADLGNACWYDEHYTNSIQTREYRSPEVLLGAPWGCGADIWSTACLIFELITGDFLFEPDEGHSYTKDDDHIAQIIELLGELPSYLLRNGKYTRTFFNSRGLLRNISKLKFWPLEDVLTEKYKFSKDEAKEISDFLSPMLQLDPRKRADAGGLVNHPWLKDTLGMEEIRVPDRELYGSGSDIPGWFEEVRDHKRH

SEQ ID NO: 1601 - protein, 773 aa, Arabidopsis thaliana
MTITSNISVQNDNLVVQGKTILTKIPDNIILTPVTGNGFVSGSFIGATFEQSKSLHVFPIGVLEGLRFMCCFRFKLWWMTQRMGSCGKDIPLETQFMLLESKDEVEGNGDDAPTVYTVFLPLLEGQFRAVLQGNEKNEIEICFESGDKAVETSQGTHLVYVHAGTNPFEVIRQSVKAVERHMQTFHHREKKKLPSFLDWFGWCTWDAFYTDVTAEGVDEGLKSLSEGGTPPKFLIIDDGWQQIENKEKDENCVVQEGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGISLLKIWNMNKFTGIVGVFNCQGAGWCKETKKNQIHDTSPGTLTGSIRADDADLISQVAGEDWSGDSIVYAYRSGEVVRLPKGASIPLTLKVLEYELFHISPLKEITENISFAPIGLVDMFNSSGAIESIDINHVTDKNPEFFDGEISSASPALSDNRSPTALVSVSVRGCGRFGAYSSQRPLKCAVESTETDFTYDAEVGLVTLNLPVTREEMFRWHVEILV

SEQ ID NO: 1602 - protein, 258 aa, Arabidopsis thaliana
MGTMGKAFYSVGFWIRETGQALDRLGCRLQGKNHFREQLSRHRTLMNVFDKTPNVDKGAFVAPNASLSGDVHVGRGSSIWYGCVLRGDANSISVGAGTNIQDNALVHVAKTNLSGKVLPTVIGDNVTIGHSAVLHGCTVEDEAYIGTSATVLDGAHVEKHAMVASGALVRQNTRIPSGEVWGGNPAKFLRKVTEEERVFFSSSAVEYSNLAQAHATENAKNLDEAEFKKLLNKKNARDTEYDSVLDDLTLPENVPKAA

SEQ ID NO: 1603 - protein, 554 aa, Arabidopsis thaliana
MSLCCDLQINLNNQFTFFVNQDLISEYSGFLRKMIKQSNKKKKNHKNSRIIIEVEDFPGGSDGFDLVLRFCYGGGISIDVSNVSILHCSSVFLEMTEKLCSSNLLLRTEKFLEGMFYWSWNDIVLCLKSCEQVFLHADSYGLVDKLVFGVLAKIPQNSDVSHVFSSSSPSSSASASASSQSPETAMIRSYSDKRSTSRSFSCRTSNEWWFDDMSILGPKIIEKLINTLGAHDKNNDSLVLTKFLLHYLKTKVPNKSTNKLEYSGLADTAVQGVVFAAKTAFSCRKMFWVLRVLSGFSISKESRIGLERVIGEMLDQATLDDLLIPAGGKGEKGVYDVDLVIRLLKVFVRIGNTEEGDQNLRMRRIGKLIDKYLREISPDQNLKVSKFLEVAESLPDSARDWFDGLYRAINIYLESHPKLSSEDRTKLCRCLNYKKLTLDTCKQLAKNPKIPPNIAVQALKSQQLSNETRPHSREDKNKVNKIWNSRKYLEEKPILVCLKGFDMSEKFEDDLMMNLERKQWNNSEKVSKEKKSEVMSRSVRHGHTHSSSSFPRLC

SEQ ID NO: 1604 - protein, 500 aa, Arabidopsis thaliana
MSISLYFLLLLPLFLIFFKKLSPSKGKLPPGPLGLPIIGNLHQLGKSLHRSFHKLSQNYGPVMFLHFGVVPVVVVSTREAAEEVLKTHDLETCTRPKLTATKLFSYNYKDIGFAQYGDDWREMRKLAMLELFSSKKLKAFRYIREEESEVLVNKLSKSAETRTMVDLRKALFSYTASIVCRLAFGQNFHECDFVDMDKVEDLVLESETNLGSFAFTDFFPAGLGWVIDRISGQHSELHKAFARLSNFFQHVIDDHLKPGQSQDHSDIIGVMLDMINKESKVGSFQVTYDHLKGVMSDVFLAGVNAGAITMIWAMTELARHPRVMKKLQQEIREILGDNKEKITEQDLEKVHYLKLVIEETFRLHPPAPLLLPRETMSDLKIQGYNIPKNTMIEINTYSIGRDPNCWENPNDFNPERFIDSPVEYKGQHYELLPFGAGRRICPGMATGITIVELGLLNVLYFFDWSLPDGMKIEDIDMEEAGAFVVAKKVPLELIPTPHQW

SEQ ID NO: 1605 - protein, 389 aa, Arabidopsis thaliana
MVDLLNSVMNLVAPPATMVVMAFAWPLLSFISFSERAYNSYFATENMEDKVVVITGASSAIGEQIAYEYAKRGANLVLVARREQRLRVVSNKAKQIGANHVIIIAADVIKEDDCRRFITQAVNYYGRVDHLVNTASLGHTFYFEEVSDTTVFPHLLDINFWGNVYPTYVALPYLHQTNGRIVVNASVENWLPLPRMSLYSAAKAALVNFYETLRFELNGDVGITIATHGWIGSEMSGGKFMLEEGAEMQWKEEREVPANGGPLEEFAKMIVAGACRGDAYVKFPNWYDVFLLYRVFTPNVLRWTFKLLLSTEGTRRSSLVGVGSGMPVDESSSQMKLMLEGGPPRVPASPPRYTASPPHYTASPPRYPASPPRYPASPPRFSQFNIQEL

SEQ ID NO: 1606 - protein, 167 aa, Arabidopsis thaliana
MVNYVLKITADLENLTNLQPSGGCDDSNFPYLFKLKCERCGEVTPKETCVTLNETFTPPGGRGTCHLVQKCKFCGREGNVTMIPGKGRPLTLEDSEAGEHAPLMVFDCRGYEPIDFGFGGYWKAQAESGTKFDEIDLSSGEEFTEYDEKGECPVMISNFRASFSVTK

SEQ ID NO: 1607 - protein, 363 aa, Buchnera aphidicola (Uroleucon rudbeckiae)
MKKKYRIAVLPGDGIGPEVMREAYKILNILKNHFSLPLETREFNIGGSAIDQEGTALPKKTLLGCENSDAILFGSVGGKKWDDLPINQRPERASLLPLRKHFNLFANLRPAKLYSELKYLSPLRSDIIKNGFDILCIRELTGGLYFGKPTGRLKKNNIEYAFDTEIYYNYEITRIAHLAFQLAQTRNFKICSIDKSNVLNSSVLWREIVKKVSKNYPDVHLSHLYIDNATMQIIKDPNQFDILLCSNLFGDIISDECAIITGSIGMLPSASLNEKKFGLYEPAGGSAPDIEGKNIANPIAQILSVSMLVRYGMNLKTIADKIDQSVISVLKKGYRTADISNNNNYLKTNEMGDVIANTLISGE

SEQ ID NO: 1608 - protein, 509 aa, Bradyrhizobium sp. BTAi1
MTFLSEIGVILLMFTVGLELSVAELWATRWRVLSAGGLQFALGSVAFGGVAYLLGASPSAAVMVGAAAAVSSTAICAKQLADQGELTTRHGRTSVAVLLFQDIATAPLLAALPLLASRTEAGTQIAIEVVRILAILGIIVLVGKPILYRSLAWVARHGHSEAFLLASILLVLITAWISHYLGIEPALGAFIAGLVLGESDFRHRIEDDIRPFRDLMVGLFFITTGVQLNLALVTQSPLSVIFWLFLLVPIKIVISAIALRLAKLGSLDAGRGAIILGHGGEFGLLLVSLGISADFLPATIGQPAMIAIAISMALAPLLIREHDRLVQHIFRAHRQPHHPQLEELEGFDQSKDLQQHVLVCGAGSLGRIVSRALLKAGISHLLFETRYEPFVQAKELGLPVILGDASRLATLEAAGVERARAVVVTFHQHRPAFRILRALRHRFPNLALIASARTEAAAEELQLIGNVNVFHEHIAAGLALARQCLQEVGLPRDRLEVLFSQMRRELHTE

SEQ ID NO: 1609 - protein, 365 aa, Buchnera aphidicola (Macrosiphoniella ludovicianae)
  misc_feature (128)..(128): Xaa can be any naturally occurring amino acid
  misc_feature (346)..(346): Xaa can be any naturally occurring amino acid
MKKQYRIAVLPGDGIGPEVMKEAYKILKILQNYFSLHIEIKEFNIGGIALDKEGVALPKDTLLGCENSDAILFGSVGGKKWNNLPIEKRPERASLLPLRKHFNLFYNLRPAKLYSELRFLSPLRSKTXIKNGFDILCIRELTGGIYFGEPRGRLKKNNIEYAFDTEVYYDYEINRIAHVAFQLARTRKNKVCSIDKANVLNSSLLWREIVTKVSKNYPDVHLSHLYIDNATMQIIQNPNQFDILLCSNLFGDILSDECAIITGSIGMLPSASLNEKNFGLYEPAGGSAPDIAGKNIANPIAQILSLSMLVRYGMNLKKIANKIDQSVISVLKKGYRTFDISDDNNXFLKTNEMGDVIADALINGE

SEQ ID NO: 1610 - protein, 520 aa, Ustilago maydis 521
MSKELKSPSKDGKRKGKASDAVPSPKKSKKASTSSHPVPSSSASTSKLKNKAGAGQATLKVNGFKSGLKQLSQSGAAFASFADYNPAPSTRFSLYRADGLPDEVGASINNADERLLLAGETDTMAYVGNNFEFGSSAEARGYTGEYMVGIYDPSSSSVTLRAVPTFQVTRSIKANSSLSSISSTRTFADYGEMTAARRALGDAFGNRKQKANARNQDRMKVDTANMEVILDDFTGGIQDNLASLPSLDEVLASSTSSRPMPPANLDAKHPAEAYRISDLIPSDIFGSLPIQKLIDNVDDHEALKELLPYSKEFPAWIWSRLLDNLQRSSHLAGNSSGKKHTTFSDDEDDAEATANGAAGDDLMMMPALGATEDKEDAKDKVRIAYYMSLLWFIQSRPKSVSQRGKLISSLKLDGEDANKRIIKAILSTFTETPANSERAVMSAFHQTKVLAYMCALALHLDNFSVDHDKLARNCNIPPATLRELFRTLGCTSSVVGGEKRMVLKTPFTLPQPRKGKAGGR

SEQ ID NO: 1611 - protein, 363 aa, Buchnera aphidicola (Uroleucon aeneum)
MTRKYRIAVLPGDGIGPEVMREAYKILNILKDDFSLPLEIKEFNIGGAAIDQEGVALPKKTLLGCENSDAILFGSVGGKKWDNLPINQRPERASLLPLRKHFNLFANLRPAQLYSELKNLSPLRSNIIKNGFNILCIRELTGGIYFGKPTGRLKKNNIEYAFDTEIYYNYEINRIAHLAFQLSQTRNYKVCSIDKSNVLNSSILWREIVKKVSKHYPDVHLSHLYIDNATMQIIKDPNQFDVLLCSNLFGDIISDECAMITGSIGMLPSASLNEKKFGLYEPAGGSAPDIEGKNIANPIAQILSLSMLVRYSMNLKKIADKIDQSVISVLKKGYRTADISNNNDYLKTNEMGDVIASALISGE

SEQ ID NO: 1612 - protein, 784 aa, Oryza sativa Japonica Group
MAAILPDLATQVLVPAAAVVGIAFAVVQWVLVSKVKMTAERRGGEGSPGAAAGKDGGAASEYLIEEEEGLNGQNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPSCPSHLEFPLSSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 1613 - protein, 365 aa, Buchnera aphidicola (Uroleucon ambrosiae)
  misc_feature (128)..(128): Xaa can be any naturally occurring amino acid
  misc_feature (154)..(154): Xaa can be any naturally occurring amino acid
MKTKYRISVLPGDGIGPEVMREAYKILNILKNHFSLPLEIKEFNIGGAAIDQEGVALPKKTLLGCENSDAILFGSVGGKKWDHLPIDKRPERASLLPLRKHFNLFANLRPAQLYSELKYLSPLRSDIXIKNGFNILCIRELTGGIYFGKPTGRXLKKNNIEYAFDTEIYYDYEINRIAHLAFQLAQTRNYKVCSIDKSNVLNSSVLWRETVQKVSKNYPDVHLSHLYIDNATMQIIKDPNQFDILLCSNLFGDIVSDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 1614 - protein, 364 aa, Buchnera aphidicola (Uroleucon erigeronensis)
MKKKYRIAVLPGDGIGPEVMQEAYKILNILKDHFLLPLEMKEFNIGGIAIDQEGIALPKNTLLGCENSDAILFGSVGGKKWDYLSIDKRPERAALLPLRKHFNLFSNLRPAKLYADLKYLSPLRSNIIKDGFDILCVRELTGGIYFGKPNGHSKKNDIEYAFDTEVYYDYEISRIAHLAFQLARNRKKKVCSLDKSNVLKSSILWKEIVEKISKNYPDVHLSHLYIDNAIMQIIKDPSQFDVILCSNLFGDIVSDECAAITGSIGMLPSASLNEKNFGLYEPAGGSAPDIAGKNIANPIAQILSVSMLVRHGMNLKKIADKIDESVVSVLKQGYRTADISNNSHNYLKTSEMGDIIANFLINGK

SEQ ID NO: 1615 - protein, 386 aa, Candidatus Kuenenia stuttgartiensis
MKALIVDGEWNPRKNYPLSNEEQAKKRANVGSQVWQHTQFEVKDVSVPNLQDDEILVRIKSCGICGSDTHLYETDKDGYIIFSGVTELPRIIGHELSGIVEQTGKNVRNVSKGDWIAAESIMWCGMCHACRSGSPNQCKYIKLMGLSADGAFAEYIAINERYCWEINDFREIYSEDEAFDIGALIEPVGCAYNGLFIVGGGFQPGATVVVYGTGPIGLGAIALAKIAGASQIIAFDIIDERANIALEMGADYAFNTNKMRDCLSGEKVMEITKGWGADIQIEAAGAAPATIPEMEKSMAINGKIIYLGRAATTTSMHLDHLVSGANKIVGARGHSGYAIFPSIIKLIATGRLKLDKMITARYPFAGIMEAIKASSERTDGKILIHI

SEQ ID NO: 1616 - protein, 363 aa, Buchnera aphidicola (Uroleucon helianthicola)
MKQKYRIAILPGDGIGPEVMREAYKILSILKDHFSLSLEIQEFNIGGSAIDQEGIALPKKTLLGCQNSDAILFGSVGGKRWDHLPINERPERASLLPLRKHFNLFANLRPAKLYSELQHLSPIRSNIIKNGFDILCVRELTGGIYFGKPSDRVKKNNVEYAFDTEVYYDYEINRIAHLAFQLARTRKFKVCSIDKSNVLNSSILWREVVEKVSKMYPDVHLSHLYIDNATMQIIKNPNQFDVLLCSNLFGDIISDECAVITGSIGMLPSASFNEKNFGLYEPAGGSAPDIAGKNTANPIAQILSLSMLVRYGMKLNKIADKIDDAVALSLKAGYRTADISNDNNFLKTNEMGDVIANFLINGK

SEQ ID NO: 1617 - protein, 364 aa, Buchnera aphidicola (Uroleucon obscurum)
MKTQYRIAVLPGDGIGPEVMREAYKILKILKNNFLLSFEIEEFNVGGIAIDQEGLALPKKTLLGCEKSDAILFGSVGGKKWDNFPIEERPERAALLPLRKHFNLFANLRPAKIYSELKHLSPLRSNIVRDGFDILCIRELTGGIYFGQPSGRRLEKNNIEYAFDTEIYYDYEINRIAHLAFQLAQSRSHKVCSIDKSNVLNSSILWKEIVQKVSKNYPDVDLSHLYIDNAIMQIIKNPNQFDVLLCPNLFGDIISDECAIITGSIGMLPSASLNEKKFGLYEPAGGSAPDIAGKNIANPIAQILSLSMLVRYGMNLKDIADKIDKSVLSVLKKGYRTADISNNNNYLKTNEMGDVIANALISGE

SEQ ID NO: 1618 - protein, 363 aa, Buchnera aphidicola (Uroleucon solidaginis)
  misc_feature (76)..(94): Xaa can be any naturally occurring amino acid
MKTKYRIAVLPGDGIGPEVMREAYKILNILKNYFSLPIETREFNVGGAAIDQDGVALPKTTLLGCENSDAILFGSXXXXXXXXXXXXXXXXXXXLLPLRKHFNLFGNLRPAQLYSELIHLSPLRSDIINNGFNILCIRELTGGIYFGKPAGRLKKNNIEYAFDTEIYYNYEINRIAHLAFQLAKTRNYKVCSIDKSNVLNSSILWREIVQKVSKNYPDVHLSHLYIDNATMQIIKNPNQFDILLCSNLFGDIISDECAMITGSIGMLPSASLNEKKFGLYEPAGGSAPDIEGKNIANPIAQILSVSMLVRYSMNLKTIADKIDQSVISVLKKGYRTADISNNSHYLKTNEMGDVIASALISGE

SEQ ID NO: 1619 - protein, 783 aa, Oryza sativa Japonica Group
MARQGFRPRFPVQTHTTNPHDGLIRLNKFVSRFSATIGAVVFQLLVTTTTLSAAAPTPIALPGCPESCGGIQVPYPFGIGDGCSYHGFNLTCDDEAHHHQTPPKLFMATDNGTVVQVLNISLPDGTVRVRSKLSQSSIAGSSSSSSNASSSRSDLPADGPFTVSSAYNWLVAFGCNIVADLTPYGNIADGSSCAATCIDGWQNFAGPSCSGIARCRTSVGRGVHSYTIQVTSLIDRNSMGASTSTTWAAAFVAEQGWFSANENAMLYNFTNWLPFTVESVPVVLEWWLDLIRDGAILPLSVGPNTTDFRCLSLHSSSYYNDLNYDRRRCNCSQGYEGNPYIRDGCRDIDECQQPDVYPCHGTCINMPGTYRCLAKKSVKSLPGLITIIAVSAGFGLLFSLLGVAKITNKIKQRRAKKLRRKFFKKNHGLLLQQLISSNKDIAERMKIFSLEELDQATNKFDQNRILGGGGHGTVYKGILSDQRVVAIKKSKIVVQREIDDFINEVVILSQTNHRNVVKLYGCCLETEVPLLVYEFISNGTLSFHLHGQNENPLKWKDRLRIALETARAIAYLHSAASISVLHRDIKSTNILLTDTMTAKVSDFGASRSISIDETGILTIIQGTYGYLDPEYYYSSRLTEKSDIYSFGVILAELLTRVTPVFSSETSERTSLASYFVSFIRDNRLSDILDSQIVNEVGAEDAKVVAKLAEACLRLKGEERPTMRQVETTLEDVQRSKVQLNHQIARVSNSNTLKNQTYEGSKCYEGTRQYSLEKEFIQSSEFPR

SEQ ID NO: 1620 - protein, 466 aa, Streptococcus pyogenes MGAS315
MDAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPLLQEKADFITKKVEEDGILYALEELGLIDKELQFPQLDLPNHKGPKATIKTNHGDMTLVLFPDHAPKTVANFLGLAKEGYYDGIIFHRIIPEFMIQGGDPTGTGMGGQSIYGESFEDEFSDELYNLRGALSMANAGPNTNGSQFFIVQNSKIPYAKKELERGGWPAPIAASYAAIGGTPHLDRRHTVFGQLVDETSFQVLDLIAGVETGAQDKPKEDVIIETIEVFD

SEQ ID NO: 1621 - protein, 365 aa, Oryza sativa Indica Group
MVPVLDYLGKLGVRQDALPDLLRRYPQVLHASVVVDLAPVVKYLQGMDVRPHDVPRVLERYPELLGFKLEGTMSTSIAYLVGIGVARRQVGSVITRFPEVLGMRVGKIIKPFVEHLEGIGLQRLAIARIIEKKPYVLGFGLEDKVKPNIEALLEFGVRKEALAFIVAQYPDILGIELRDKLAAQQSLFESSILVSSEDFGRVIERMPQAISLGRTAVLKHVNFLTSCGFLLSQVSKMVVACPQLLALNMDIMKMSFEYFQNEMERDLVELVEFPAFFTYGLESTVRPRHEMVAKKGFTCSLAWLLNCSDAKFDERMKYDTIGIEEMEVDNSFDTNTLSERVEDEVEDEDLDEDSDYDSTDDEFIE

SEQ ID NO: 1622 - protein, 347 aa, Zea mays
MSTHAASRRSSSSSAVAKRPAIAEGATKAAGPGPTAAQAKKRTALVNITNVAAPGARVAAVGKVAPPVTGAYLISGGSRQRFEITCPFCSNSNLMQKLNPATSGAPLKKPSLANARTIRGSAAKSASIKPAPPVSRHDSSSEQKHNVLVPTTVHVPSRAPALVPYSSFVSPGRSRDSVSTDETMSTCDSMKSPDFEYIDNGGCSMLASLQRRADEHLRTSEDRDVEENKWKKNGPAPMEIDSICEVDSNLEDPQLCAALASDFYMHLREAEMKKRPSTDFMKTIQKDVNPSMRAILIDWLVKVAEEYRLAPDTLYLTINYIDRYLSGNKINRQRLQLLGVACMLIAA

SEQ ID NO: 1623 - protein, 219 aa, Oryza sativa Indica Group
MASPHPHPHPGAPLAARPLSALASFFLARPSSTAAAPPPRHVTLSCSLPHCNHNQWAASRCRGTAGRRRLQVVVAMSSSAPPPPPGSVQKSEEEWEAILSPEQFRILRLKGTEYPGTGEYDKLFAEGVYECAGCGTPLYKSSTKFNSGCGWPAFYEGFPGAIARTPDPDGRRIEITCAACGGHLGHVFKGEGFNTPTDERHCVNSISLKFIPASEDSKL

SEQ ID NO: 1624 - protein, 314 aa, Brassica napus
  misc_feature (190)..(190): Xaa can be any naturally occurring amino acid
MESTKKQLSLEVLPWLVVHSDGTLERLAGTEVCPPGLDPETGVLSKDIIIDPKTDLSARIYRPDSIQPGQKLPVVLYFHGGAFLIASASLPNYHTSINKLVAQANIIAVSVNYRLAPEHPLPTAYEDSWNALQGVQAGNEPWINDYADFNQFFLAGDSAGANISHHLAFRAKQSDHTVKIKGIGMIHPYXWGTQPVGSEVTDEARKQMVDGWWRFVCPSDKGSDDPWINPFADGSPNLEGLECERVIITVAERDILRERGKMYYEKLVNSNWRGNVEIMETKGKDHVFHIFEPNCDEAKEMVRRLALFINQVEA

SEQ ID NO: 1625 - protein, 253 aa, Triticum aestivum
MHPTRWELSHMVDLQAAALVIAVWNITALHDSHHPPCGSKLQLPRPSPPRSGGARRTGAPRPRSLRLHLGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 1626 - protein, 338 aa, Zea mays
MDRLEMQDDSKRSNRPKYSKFTQQELPACKPLLTPAIVISAFLLVGILFVPIGLASLSASQEIVELVDRYDTSCVPVADKVGFIQNTKTDKSCTRTLTIPKHMKSPIQIYYQIGDFYQNHRRYVKSRSDKQLRYKDAAHLTKDCEPEVYSAGGAPIVPCGLVAWSLFNDTYTISVNKKAIVVNKKDIAWQSDKKKKFGSDVYPSNFQNGNLIGGARLNESIPLSEQEDLIVWMRTAALPTFRKLYGRIETDIMENDELTVVIQNNYNTYSFGGSKALVLSTTSWIGGKNNFIGFAYLIVGGFCLFLALVFVVLYMIKPRTLGDPSFLSWNRGTMDYPS

SEQ ID NO: 1627 - protein, 214 aa, Brassica juncea
MDPFYTSFSDSFLSIPDHRSPVSDSSECSPKLASSCPKKRAGRKKFRETRHPIYRGVRQRNSGKWVCEVREPNKKSRIWLGTFPTVEMAARAHDVAALALRGRSACLNFADSAWCLRIPESTCPKEIQKAAAEAAMAFQNETATTETTMVEGVIPAEETVGQTRVETAEENGVFYMDDPRFLENMAEGMLLPPPELGWNHNDLTGDADVSLWSF

SEQ ID NO: 1628 - protein, 509 aa, Brassica juncea
MTSVNVKLLYHYVITNLFNLCFFPLTAIVAGKAYRFTIDDLHHLYYSYLQHNLITIASLFAFTVSGFGLYIATLPKPLYLVEYSCYLPPRHLKVSVSKIMDIFYQIKADTSSRNVACDDPSSLDFLRKIQERSGLGDETYSPEGLIHVPPRKSFAGSREETEKVIIGGIENLFENTKVKPKDIGILVVNSSKFNPTPSLSAMVVNTFKLRSNIKSFNLGGMGCSAGVIAIAIDLAKDLLHVHKNTYALVVSTEGITQGIYAEENRSMMFSNCLFRVGGAAILLSNKSGDRRRSKYELVHTVRTHTGADDKSFRCVQQGDDEDGKTGVCLSKDITNVAGTTLTKHIAICRPLILPLSEKFLFFATSVAMKLLKDKIKHYYVPDFKLAVDHFCIQPGGRAVIDELEKNLGLSPIDVEASRSTLHRFGNTSSSSIWYELAYIEPKERLKKGNKKGWQIALGLGFKGNSAVWVALNNVKASANSPWEHCIDRYPVKNDSDLSKSKTQVQNGRS

SEQ ID NO: 1629 - protein, 585 aa, Coccidioides immitis RS
MYNRAMVPAPNPRLTELFDQLRQEYENQSRSHGECEHQLTGQLQEMEMIRQRVTQLEQAHIDMKQKYEAEIRGLRMELESRGIHLPPSHVGGPPTHGGLSQAPPPALGHGPSNLFGGIIANQGGGPPALAPPPPQDQQQPPQHSLQPPASGAQGPPQPQQGAFGGYQPNSAVNGYGPPPPAPTSSPGPGKGRANRAPPGPATPQQNQPVAYADPRESPQIPQPTPGQPIPYRVGNALGELEPDKLPPTQKKEGTDWYAVFNPEIPRVLDVELVHTLSHNSVVCCVKFSSDGKYVATGCNRSAQIFDVASGQLVTTLQDDTANKEGDLYIRSVCFSPDGKFLATGAEDRQIRVWDIANRKIRHIFAGHENDIYSLDYSRNGRYIASGSGDKTVRMWDVYDGKQELILSIEDGVTTVAISPDGRYVAAGSLDRSVRVWDTTTGYLVERLESPDGHRDSVYSVAFAPNGRDLVSGSLDKTIKMWELTPPRGIMAGSGPKGGKCVRTFEGHKDFVLSVCFTPDGHWVLSGSKDRGVQFWDVMTGHAQMMLQGHRNSVISVAPSPTGQLFATGSGDCRAKIWSYGPWGRR

SEQ ID NO: 1630 - protein, 220 aa, Brassica juncea
MDPFYTSFSDSFLSIPDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPESTCPKEIQRAAAEAAMAFQNETATTETTMVEAVKPAEETVGQTGGETTEENGVFYMDEEAGFGMPRFLENMAEEMLLPPPELGWNHNDLTGDADVSLWSF

SEQ ID NO: 1631 - protein, 422 aa, Zea mays
MIRPGSKDSQNYDNNNQRVHPQPIDDNMNQNGDSMDTVIGRIFNNISSLKSAYIQLQEAHTPYDPDKIQEADKLVIEELTRLSELKHAYREKHPKPIAASPQDSRLLSEIQEQQNLLKTYEVMVKKFQSQIQSRDTEITHLQQQIDEAKLRKSKLEKKLKQRGLLNRESEESDEEENYFSIELTPSLFTSAVDNAYQSIHDFSKPLINMMKAAGWDLDGAASAIEPGVVYTRRAHKKFAFESYICQRMFSGFQEESFSIKDSNISVSNEAFFHQFLAVRAMDPLDVLSQNPDSVFGKFCRSKYLSLVHQKMEGSFFGNVDQRNYVMSGGHPRTPFYQAFLKLAKSIWLLHRLAHSFDPKAKVFQVKKGSEFSDIHMESVVKDIILEDVAERPKVGLMVTPGFLIGTSIIQSRVYLSGAKCAD

SEQ ID NO: 1632 - protein, 804 aa, Oryza sativa Indica Group
MAPAQCARVQRVFHFGKGKSEGNKAMKDLVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 1633 - protein, 442 aa, Clostridium difficile 630
MGGLSMNEKNKMGLISIILLGINAVVGAGVFLLPGDAMKSFGVASIFVYIFDMLLVLSMAFCFAEVAGKFNKNGAAYVYTKEAFGDFCGFEVGLMKWVIGCISWGALIVGFPTSLSAVWAPAGEPHIQKIIIVAMIVGLTIINLLGVSLSKIVQNVITVGKLIPLILFIGIGIFFIKGVNFTSSTMVPPGAGATEFGAAALLMFYSFTGFESIAVAAEDMENPQKNIPIAIISVIVIASIIYILNQVVCVGILGDSLSSTSTPVADAARICFGNMGAGLVTFGTLVSVGGICMCGAFVNPRSCVALADDKMLPRIFARKDKKGTPYVAIIATMLITIPIALSGSFAELAAISAVARFIQYIPTSLSVLVFRKKRPELVGTFKTPFGAVIPLIAVCVGTWLLFQASMHQLIMGLGALAIGVPLYFIMKSYNRKVYGENLKKIV

SEQ ID NO: 1634 - protein, 1076 aa, Ustilago maydis 521
MECIFSDVGKSSPSCPNRTDQETMQGLLLREAISSEEQAHWKEAIKAEMDGLERMSIWEIVDKPRNTNLVDSKLGLTIKTDANLITVKYKARFCVDYDEIFAPVVPQDAIRAILAIAAQQDWELDSIDVTQAYLNANLHHDVYLKTPEGADVPKGKVYKLVKGLYGLKQSGREWNLELDAHLRSMGFSSLPCAPCVYLRGTGDSKIIIAVYVDDMLITGPDRKGVDAVKAAITTKWKITDNGRAKELLKIRISRNRQARTLTLDQRAYIESIIKQWLPKNSKSWCPMDSTPVPAPMDFVPSAALKEQYPALVGKLLCVSTPSDPTSISLSIALPVTWGQDTDATAIATYTDANWASDPNTERRSTSGSITEVSGSLPYLDESCRSQSDWEQERERGNGISLSKAARCYDTHDRGTSRGIHDLQLTPAQLNDWPIIQECDTLPHLRFVNLVLFALSSLPRSGPTLGLVATQSRCDPSIKLNASVVLSSSFSPLSIHDSTTTISVFAKSTVPTMRSVSLLRASSKAFSDTSAARCLSTSATSRLAQPAAAAATGAAKAQLSQIALSRAKDVESNWQGTSMLGGTTKNYIDGKFVESSTSSWLDVNDPSTQALLSRVPLTTKSEFEAAVANAQAAFPAWRETSLLSRQQVMFKLQALLRDHMDDIANAIVLEQGKTFADAKGDVLRGLQVVEVACGITSTLMEERIEVSKDMDTYARREPLGVTAAIAPFNFPAMIPLWSIPMATVTGNTLVLKPSERVPGASMIIAELCERAGMPKGVLNVVNGAVDIVNGICDDPRIKAISFVGSDKAGAHIYNRGTANGKRVQANLGAKNHAILMPDANKNFALNSIAGAAFGAAGQRCMALSVVVAVGEAQSWVPELVERAKQLKISGGFEEGADLGPLISPQARERVRSLTGSVEQEGGKILLDGRDFSCPDYPNGNFVGPSVIEAGPGMKAYDQEIFGPTLVVLKADTLDQAIDYINKNKYGNGAAIFTTNGATARKFEKNVNAGQLGVNVPVPVPLPMFAWSGNKGSVMGDIGFYGKSALNFYTSFKTSTSLWRSDDAQLSEKASVNMPTMS

SEQ ID NO: 1635 - protein, 467 aa, Burkholderia mallei ATCC 23344
MEGSQTGLGTGLKQRHVTMLSIAGVIGAGLFVGSGHAIVEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPAHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 1636 - protein, 723 aa, Thermotoga sp. RQ2
MWLLFLIPLVALGFAAANFAAVVRKPEGTERMKEISSYIRSGADSFLAHETKAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQVDNLNIYTNWLGINFVPFAMPVSGYALGCSIIAMFDRVGGGVYTKAADMAADLVGKTELNLPEDDPRNPATIADNVGDNVGDVAGLGADLLESFVGAIVSSIILASYMFPIYVQKIGENLVHQVPKETIQALISYPIFFALAGLGCSMLGILYVIVKKPSDNPQRELNISLWTSALLTVVLTAFLTYFYLKDLQGLDVVGFRFGAISPWFSAIIGIFSGILIGFWAEYYTSYHYKPTQFLSKSSIEGTGMVISNGLSLGMKSVFLPTLTLVLGILFADYFAGLYGVAIAALGMLSFVATSVSVDSYGPIADNAGGISEMCELDPEVRKITDHLDAVGNTTAAIGKGFAIGSAIFAALSLFASYMFSQISPSDIGKPPSLVLLLNMLDARVIAGALLGAAITYYFSGYLISAVTKAAMKMVDEIRRQAREIPGLLEGKAKPDYNRCIEITSDNALKQMGYPAFIAILTPLVTGFLLGAEFVGGVLIGTVLSGAMLAILTANSGGAWDNAKKYLEAGNLEGYGKGSEPHKALVIGDTVGDPLKDTVGPSLDILIKIMSVVSVIAVSIFKHVHLF

SEQ ID NO: 1637 - protein, 300 aa, Arabidopsis thaliana
MEGGVEELSIEQLASSISTYKEQLEQVRQLLSEDPRNSEYADMEKELKEVIALTEEVLATAKQNEISLSDAGVSAEATPGSPDLEGAWEKTGLRNDPIHEGKFPVGTKVQAVFSDDGEWYDATIEAHTANGYFVAYDEWGNKEEVDPDNVRPIEQNAIVEAERLAQATKNALKRKIEKAASSDYQTKTLPAKLKIDPNDPEDVKIAKRKKIHAFKSKARFEQLEVVQNKKQNDWQQFQTTKAKTKKVGFFTGRKKESIFKSPEDPFGKVGVTGSGKGLTDFQKREKHLHLKSGNAEGTDE

SEQ ID NO: 1638 - protein, 384 aa, Ustilago maydis 521
MFLQQSSKALNGGQSAQKEKLAKEKAANRPWVEKYRPKTIDEVAAQEHTVAVLKKTLLSNNLPHMLFYGPPGTGKTSTILALARQLFGPELMKTRVLELNASDERGITVVREKIKNFAKLAVTNPKEGFPCPPFKIIILDEADSMTQDAQSALRRIMEQYSRITRFCLVCNYVTRIIEPLASRCSKFRFRSLDTSSTKARLEMIASAESVAFRDSGVLDTLISTSDGDLRRAITYLQSASRLHSLTGEDKSAITSESIVEIAGVVPNRVIASLADAIGIEAYSPDDDVEMQPTGGAKKRDTFERIRDEVRIITREGYSITQLLLQLHDHVIGHPTSQAKIKAKAALLMAEMDKSLTDGADEELQLLNLCLKLQEVVQTDGKAYV

SEQ ID NO: 1639 - protein, 246 aa, Vitis vinifera
  misc_feature (99)..(99): Xaa can be any naturally occurring amino acid
MFAGENGLQGDPRLKAISEAIRVVPHFPKQGIMFQDITTLLLDHKAFKDTVDIFVDRYRDMGISVVAVDTQRLRVGKGIFYDYCLKFELKREDSCLVLXLNLWPIGAKFVPLRKPKKLPGEVISEAYVLEYGTDRLEMHVGAVQPGERALVIDDLIATGGTLCAAIKLLERVGAEVVECACVIGLPEAKGQCRLNGKPLYILVEPRNILAAYELMNLLSIGKSTTILDGICAMQQWGHCTKKGEGM

SEQ ID NO: 1640 - protein, 364 aa, Buchnera aphidicola (Uroleucon sonchi)
MKKKYRIAVLPGDGIGPEVMREAYKILNILKYHFSLPLEIEEFDVGGSAIDKEGVALPKKTLLGCENADAILFGSVGGRKWDSLPIDQRPERASLLPLRKHFNLFANLRPAQLYSELKYLSPLAFLIVIKNGFNILCVRELTGGIYFGQPSGRSKTNNFEYAFDTEVYYDYEINRIAHLAFQLAQTRNYKVCSIDKSNVLNSSILWREIVKKVSLSYPNVHLSHLYIDNATMQIIKDPNQFDVLLCSNLFGDIISDECAIITGSIGMLPSASLNEKKFGLYEPAGGSAPDIEGKNIANPIAQILSVSMLVRYSMNLKNIADKIDYSVISILKKGYKTADIAHDNNYLKTNEMGDVIADALISGE

SEQ ID NO: 1641 - protein, 488 aa, Acinetobacter sp. ADP1
MVKELYIAGEWRLGRGKVIQSTFPADNSVNAEISTASFEDIEEAIVKADQAWRAPEWRNRLPHERAKILYKVADIIEARVDALAALQTRDNGKPLAETRGLVFSAAATARYVAAACETMNDELTSQRAPDFMTFSVHEPVGVVAAITPWNSPIASEVQKLAPALAGGNAVILKPAEATSLIALELAKIFEEAGLPKGLLSVLVGKGSVVGDAIVKHPLVRKISFTGGTTTGRHLAHIAADKLITTSLELGGKSPTIVLPDADIELAAKGIAYGIFSSAGQACIAGSRLFIHSSIYDQFLARLVEITKSLRVGHPEQKDVHMGSLINAAHLASVDRYVQLAKQEGGEILTGGQAMTEGEFAKGSFYLPTIITGLKNQAQVCQEEIFGPVLVVMKYEHEDDLIEQANDSCFGLAAGIWTESYRKAWRIARVLEVGTVWINTYKKFSISAPFGGFKDSGIGREKGRQGILSYMQQKSIYMGLNEQPNPWAD

SEQ ID NO: 1642 - protein, 526 aa, Ashbya gossypii ATCC 10895
MSFSDEEDFDDIYGDDNKQNSETAVAAGKRKADGEAGAGPTSKEEAARGADNSGASAAETTTTPASWLDQLAALQVLSSNLNQLQQSTNNNSNNNTNSSDSTSNDSNKGNVPDQMLARGMPDLSQLQQLQQTMNQLQQQAAPLTQQQQQEAKQVKADLSRDINKMFIGGLNWETTEDNLREYFSKYGNVTEVKIMRDGTTGRSRGFGFLSFADASSVDEVVKTQHILDGKVIDPKESDPTGRARKAGKIFVAGIGPDVRPKEFEEFFSQWGSIIDAQLMLDKDTGRSRGFGFITYDSPDAVDRVCQNKFIEFKGKRIEIKRAEPRQVQKQRTTNASPTGQPFSLNTSQAPQPPQQQFQMMANPMMANPLFNPQAMADYYAKMQEYYQQSGIDYSQMYQQQMQQMQQMMSMMTGGNAPAGGMPAGANGAGGNGDDTNGVPTIGEDSSSTSSGKDNNDKESSNNRHDSYGNRDRERSPDARRGHRNYNDREEGGHGFRRENRDRGFRGRERRGGGYGRDRRGYHPYSR

SEQ ID NO: 1643 - protein, 459 aa, Candidatus Kuenenia stuttgartiensis
MLCQHFLYSQQFPDVCNASLNYYQFLIMEKLLEKIKTKKAKIGIIGLGYVGLPLALEFVRSGYCVTGIDRNKDHVASLNRGKSYIGDVKDEDIAQFVEKRLFLVTDDASAISTLDAISICVPTPLTKTKDPDMSYIINVSQEIKKHMRKGQLLVLESTTYPGTTEELVLPILEGDTLRVGKDFYLAFSPERVDPGNKVYSIRNVPKVVGGVTKQCTELAMSLYGQIVEKIVPVTSTKVAEMVKLLENTFRSVNIALVNEIAVMAERIGIDVWEVIDAARTKPFGFMSFYPGPGLGGHCIPIDPLYLSWVAKKNGFELRFVALADQINSAMPEFVVEKITDALNNFEKSVKGSAIHILGVAYKKDVGDIRESPALEIMHQLKNKGAKLTYSDPYIPEINYHGLCTKSKTHTKEFFSKIDCSVIVTDHCCFDYDLIVSHSKLIVDTRNALKGVNRKHIFRL

SEQ ID NO: 1644 - protein, 548 aa, Ashbya gossypii ATCC 10895
MPAAHETESPPIQTLGQRKRQQNEKVDQKWKTLPEDMSAGSEIPMGSKCHGAEPVPRKSIWQRAREIFLKYMKFVGPGLMISVAYMDPGNYATDVSAGASHKFALLCIVLYSGLIAIFLQSLCIKLGTVTGLDLSRACREYFPRWLNITLYVLSEAAIIATDIAEVIGGAIALNILLKIPLPAGAVITCTDVLLVLLAYTPGTSSMRLVRVFELGVATLVLGVTVCLCIDLAYIPSTTSVAKIFRGFIPSREIFQNNGMYAAVGILGATVMPHSLFLGSGIVQPRLLEYDVQHGHYSMDIDSDDDSSLENKTSRQTKESRFLDYRPSIYAIRYAMKYSIIEVSVALLTFALFINCAILIVSGSALYDTPEAIDADLYTIHHLLSNTLAPAAGTIFMLALLFSGQSAGIVCTIAGQIVCEGHIRWTITPWKRRILTRAIALIPTLAVSTALGKNGLSQALNASQVALSVLLPFLTAPLIYFTCSKRIMSVKVSKPMPDGVPADEEEQTPEYVDMSNGWITSLAAIFIWIFISFLNIYAIVQLGLTSRQT

SEQ ID NO: 1645 - protein, 336 aa, Bradyrhizobium sp. BTAi1
MRRAPDRSRISLCASALQTGPVTENHILVRGPRLNADPYNVLGVKKDASQDDIQKAYRKLAKKLHPDLNPGNKQAEEQFKAVSAAYDLLSDPEKRARFDRGEIDASGQERPRQRYYRDFAGGAAGDHPYASSEGFSDFSDEGDLFSSLFGRGGRMNLKMRGQDVHYRLPVEFLEAVNGATRRITLSDGSTVDVTVPPGARDGQLLRLAGKGGAGIGGGPPGDAFVEIVVKPHPLFTRKDDDIHLELPVSLTEAVLGGKISVPTPTGAVSMNVPKGSNTGTVLRLRGKGVARSNGTRGDEYVKLKVVLPEKPDPELEKFVQSWTAGKAHDPRRGMEA

SEQ ID NO: 1646 - protein, 427 aa, Candidatus Kuenenia stuttgartiensis
MNYIGPEAILQKKQEYLIPCVYHFYKKPMQIVRGEMQYLYDHKGKKYLDLYGGVSVMNAGHCNPEIVEKICAQVNTLQHTTTIYLTQPIADLAEKLSEITPGNLKRSFFCASGSEANEGAALISQLFTKKSKFVAIEQGLHGRTKLTMNLTGIPMWRTDPYPSGNVTHIPAAYCYRCAYGLTYPNCDLKCARRLEDVVRDGDFAALIIEPIQGNGGIITPPPEYFQLIREILNKYKVLLITDEVQTGFGRTGKMFAIEHWDVVPDIMCMAKALANGTPLGAFITNDAVASAYTRPGASTTGGNPVSATAALATIDVIENYRLVEKAKELGDYFKNALNDLQQKYRIIGDVRGMGLMLGVELVKEDKIPAFDETDNILEQLKDLGILAGRTGISRNVLTFQPPLVITQNDIDHLCMVLGIILSKVSDG

SEQ ID NO: 1647 - protein, 292 aa, Bacillus clausii KSM-K16
MITVVGSINIDLVVHTGTMPVLGETVLGGEFQTNPGGKGANQAVAAARLGADVTMIGKVGNDPYGKLVTDNLQNEQINTDYIEVEKDGHTGVAMITVTNNDNAIVVAPGANFSWKPEEAAQYRDVFKQTNVLVLQLEVPLPFIEEIAKIGKEERCIVILNPAPAQPLPSSLLDLVDYITPNETECQTIFKQSVEQAVQRYPNKLLVTEGKKGAAYHDGQQLVQVNGFPANVVDTTGAGDTFNGALAAALASGQQLAEAVTFANAAASLSVEQAGAQAGMPSKQQVLARLGSS

SEQ ID NO: 1648 - protein, 484 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMINDRAAPANRQKPLDAVFNRNGKAVKLKECKVKPEVIVSIPDSEKEKKSKFPGGQKVCRRVPTLFDNLTKCSRASDGITTPKKKNPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSGSQEIL

SEQ ID NO: 1649 - protein, 197 aa, Ashbya gossypii ATCC 10895
MYLIGPTRGVQSMFSSFRLASRHTTSVLRTFHTSKPIMLQAGDAIPKSIPGLHENSPGNSVDIGAEVASGKHLIVGVPAAFSPACSSSHVPGYIQHLDELKSKGFKQVLVTCVNDSFVTKAWAESLKCPSDVRVIADTQGAFASAGGFLFDGKQTFGNDRSVRYALVVEDGKVVRDFVEPDKTGLKVSAAENVLKEL

SEQ ID NO: 1650 - protein, 452 aa, Staphylococcus aureus subsp. aureus MW2
MNYTQQLKQKDSEYVWHPFTQMGVYSKEETIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNAFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRKCKENGLMIRNLENVITFVPVLSMSNKEVKTMVRIFKKAVHNILDRKC

SEQ ID NO: 1651 - protein, 139 aa, Oryza sativa Indica Group
DRYDEFEKLNTEILGVSIDSVFSHLAWVQTDRKSGGLGDLKYPLISDVTKSISKSFGVLIPDQGIALRGLFIIDKEGVIQHSTINNLAIGRSVDETMRTLQALQYVQDNPDEVCPAGWKPGDKSMKPDPKGSKEYFAAI

SEQ ID NO: 1652 - protein, 137 aa, Populus trichocarpa
MESDMVMHYGGCHCRRVRWRVQAPSSVVALNCNCSICSMRASIQFIVPSEKFELLGDSKEFLTTYTFGTHTAKHTFCKFCGITSFYVPRANPDGFSITLRCVDPGTLTHVEIKNFDGQNWERSYNQAFASSSQGAGC

SEQ ID NO: 1653 - protein, 578 aa, Mycoplasma hyopneumoniae 232
MAKLNSYKFKGIGASSGIAIAKVFKLVEQKIEISDQKVEDISTEIQIFEEGVKKSVSQIEKIKKLATKLAKDELEILDAHILIATDPVLKEDTINLIKQGYSAAYSLKETAKNHTNFLLETGDEYLMARATDIKDASQRIIKNILNLNILDLSAIDKDVIIVADDLKPSDTAQLNSYVKGFATNIGSKTSHSAIMARSLEIPAILGVSDILEKVENDDILAINGDLGYGIINPNQEEIEEFERQKANFEAEKEKLQEFLNKKATSADGKKVVIAANIGSVEDSYAAKKVNADEIGLFRSEFLYMDRSNWPSEEEQFLSYKAVIESQNPKKVVVRTLDIGGDKTLKYFDFAKELNPFLGYRAIRLCLDKLEIFKTQLRALVRASEFGNLAIMFPMVASLDEFFQARAVFDEVYNQIKAKYPNVAPKSNIKIGIMIEIPISAILADKFAEHVDFFSIGTNDLIQYSFAADRMNEKVAYLYQTLNPGLLKLIKMTIDAAHAKGKWVGMCGEMAGDINAVPLLLGLGLDEFSVSASSVLKVKKLISELNYQKMQEIAKKTLEFSTEEQVIKYLESLNLIRHN

SEQ ID NO: 1654 - protein, 221 aa, Populus trichocarpa
MNQKSLIYAFVSRGTVILAEFTEFSGNFNSIAFQCLQKLPATNNKFTYNCDGHTFNYLADNGFTYCVVADESAGRQVPMAFLERVKDDFVSKYGGGKAATAQANGLNKEFGPKLKEHMKYCADHPEEISKLAKVKAQVSEVKGVMMENIEKVLDRGEKIELLVDKTENLHSQAQDFRSQGTQIRRKMWLQNMKVKLIVLGILIALILIIVLSVCKGFNCGK

SEQ ID NO: 1655 - protein, 404 aa, Mycoplasma hyopneumoniae 232
MQPTYKNKKFIDDIDFLNKTVILRVDFNVPIKNGEISSIKRIIASLKTIKKIVNNGGKLVILSHLGRIKSKEDLPKKSLRIVAEKLAEILGQEIKFIPENRGPKVENAISQLEKGEILVLENTRFQDLNNKAESKNDAELGRYWASLGDVFINDAFGTLHRAHGSNVGIATYIKESAIGYLVKEELDALSKLIFSPQRPFYAIIGGAKISDKIGIISTLLEKADKVLIGGGMAYTFKKALGYKIGLSIYEDDKLELAASLVKKYPDKLILALDAALAPEFADLEPLYNQENPLEIPDHLEGMDIGPLTIELFKDHLKDGKTILWNGTLGVAEFKNFARGTKEVAKIIANLKECYSIIGGGDSIAAIEAEGLSNSFSHISTGGGASISFIENGDLIGLGPIQEKD

SEQ ID NO: 1656 - protein, 187 aa, Saccharomyces cerevisiae
MPIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 1657 - protein, 268 aa, Oryza sativa Japonica Group
MSQGQPRRPPPDGSGARPVMYGDVFDVSGELAGQPVAPRDAAKLQSAEEAVLGEAQKGGPAAAMQSAAAINARAGHVGRAQVTGAIADEGVAVAVAETELPGRRVVTESVAGQVVARLATPPRVVATQPSGSLDKDAVTIGRALEWRPRPPRRRPVDQSDAAAIQAAEMLATGRTVTVPGGVAAAAQAAADHNAAPAARDEDRIKLRDVLTGARGKLPADKAATREDAERVPSAEVRNRPDMATTPGGVADAVTAAARLNQERPTRSF

SEQ ID NO: 1658 - protein, 559 aa, Candida albicans SC5314
MSYPTPKKEQDSILSESYQSFSTASTKNPIKNFIYSFRVNRDLQVTSDEITTPDDLLKGYQVKLIALSSCIGSGLFISSASMISSAGPGGTVIGYFIVAILMFFIVQALGELTSSYPVRGNFLVYNTRFIDESWGFAMNWNYCLQWIVNIPLSLVAASLTIQYWTDKIDPAVWVAIFWVVIVGISIFGVKGYGYGESLFSVIKVVAIAGFCILGVILAAGGGEQGYIGGRNWHPPFVNGFHGICNTLVNSAFSYSGTELAAIAAAETSNPRKSLNKTIKQIFWRILIFYMLVIVIVCFLIRHDDPKLMGNSSWPVSPFVIAISNGGIKVLPSIFNAVILSALLSVANASVFATYKPLVALAEAGHGPKFLAYVDQKGRPIYSIIIALAFGLIGFVGSSSSQAVVFNWLLALSGLSCIFIWFSISLAQIRVNYACKVQGIDSKNVPFKAIGGDYGAYFSMLINVLILMAQFYVGLYPINGKSLNASTFFQAYLAVPIVLVFYVGHKLWTKNWSWYIKAKDIDITTGRNIVDSDFELQAMEFEKEMEPKKSIMHRFVNFWC

SEQ ID NO: 1659 - protein, 336 aa, Neorickettsia sennetsu str. Miyayama
MTKALLIEKTGGPEVFKSVDINFRAPKSDEALIRHTAIGINYIDIEQRSGFYNLHENTSRRKLPAIVGCQGVGVIKELGEGAVVDVQPGDRVCYATIPYGAYSEERVIKLKYLHKIPDFLSDIDVAACLYSGMVSFYLTCRAYLVMNDFTVMVHAVDTDMGDMLCQWIRARAPGCKIIGTVGSMRKLELLKDIRCELLLNYLEDPEVLREKVHKFTRGHGVNAVYDCIGKDTYMLSLNSLARFGIYVLYEQRSGEIPPMSWKAFRARSLFFTHPSLFHYARNHVESVLAVAEVFHHMRIKKVVPNIALRCSGLDDIPEAHRQIEVGNVNGASVVIF

SEQ ID NO: 1660 - protein, 647 aa, Oryza sativa
MWKMVDALLRCSALVALVLHFVVNGCSAVNTEGSALLKFQSRVEEDPHGAMAGWSERDGDPCSWNGVRCVDGRVVILNLKDLSLRGTLGPELGSLSHLRALVLSNNLFDGPIPKEMSDLAMLEILDLSNNNLTGEVPQEIAEMQSIKHLLLSNNNFQWPLIQNSYRNFDQEIDFDVYDERGDVDQRSENGFESDSSSEENTKDNNNLSARLSSQFAARNPTVQLSRRRLLEDTNLAAASANAPVPAVASVPSTGTGSFSAFKEIKVPPPLSPPSSPPMSSGPPQRSKRWLYAIVISSIALLLIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 1661 - protein, 109 aa, Glycine max
AQPASLTRIGLAGLAVMGQNLALNIAEKGFPISVYNQTTSKVYDTLKIAKQKRNLPIYSYHNPKFFIQSIQKPKIIIILINSYTPINQTIKTLSSHLETNNYIINNNNK

SEQ ID NO: 1662 - protein, 633 aa, Oryza sativa Japonica Group
MAAAVQLLVVAAAAAMAAACCAGMAAAAATVEVTWDVEYVLWAPDCQQRVMIGINGRFPGPNITARAGDVISVTMNNKMHTEGVVIHWHGIRQFGTPWADGTASISQCAVNPGETFVYKFVADKPGTYFYHGHFGMQRAAGLYGSLIVLDSPEQPEPFRHQYDDGGELPMMLLSDWWHQNVYAQAAGLDGKDRHFEWIGEPQTILINGRGQFECTLGPARKSFEKLLNENVETCVDDQKMCSDQEKCLRRSECGPYCPRSQCAPVVFNVEQGKTYRLRIASTTSLSLLNVKIQGHKMTVVEADGNHVEPFVVDDIDIYSGESYSVLLKADQKPASYWISVGVRGRHPKTVPALAILSYGNGNAAPPPLQLPAGEPPVTPAWNDTQRSKAFTYSIRARKDTNRPPPAAADRQIVLLNTQNLMDGRYRWSINNVSLTLPATPYLGAFHHGLQDSAFDASGEPPAAFPEDYDVMRPPANNATTASDRVFRLRHGGVVDVVLQNANMLREEVSETHPWHLHGHDFWVLGYGDGRYDPAAHAAGLNAADPPLRNTAVVFPHGWTALRFVANNTGAWAFHCHIEPHLHMGMGVVFVEGEDRMHELDVPKDAMACGLVARTAATPLTPATPLPPSPAPAP

SEQ ID NO: 1663 - protein, 518 aa, Anabaena variabilis ATCC 29413
MIEAEVHLSLHNFLRSQAGFPSWPHHLTMARLVARALRLGRSALIQVGAVCGYQGRYRTSFIASALMWHGPVIIVATETVQQLLLRVEIPRLQQWLQVNKPIRTGDVWPNPEFQGILLTSPEAWLKGQLTSADNFPQGIPTIIDGVDDLEDWVRDQLTRDIQPQDWDQLILACPEQAETIRAARIELTSELFKHPANPYECYLISQSETDILTKLYTVLESASGVPEVWQQFWQQLPSEQNHPPSSSPLLFWATIARRQGLFSLHYAPIELGEILAPIWQRQPVVLIGSALEPETEAPLFQERLGLDDLTCLKFASDSQSEAIQLYIPYKLPLPNTPEFQAAFIHKVRTLVCLSATAPGLTVLLVGDVPLKAQVGAILASEFGSRVQVEKTCLDENGILVSGWEFWREHQAVLPAPQLLVIATLPLPSLEHPLVAGRVAHYKRSHQDWFRLFLLPTALNELQRAVAPVRENQGIVALLDSRVVNRSYGSQILNVLSPLARLNYLDPSLFAPSGEENSA

SEQ ID NO: 1664 - protein, 490 aa, Acinetobacter sp. ADP1
MSDVKLHRLYIHGQYTDATSGKTFDSINPATGEVIATIQQASQTDIEAAVKSAAEGQKVWAAKTAVERSRILRRAVDILRERNDELAQLETLDTGKAFSETSTVDIVTGADVLEYYAGLATAIQGEQVPLRESSFFYTRREPLGVVAGIGAWNYPIQIALWKSAPALAAGNAMIFKPSEVTPLTAFKLAEIYSEAGLPAGVFNVVQGAGREIGQWLTEHAVIEKISFTGGVETGKKVMASAAGSTLKEVTMELGGKSPLIICEDANLDRAADIAVMANFFSSGQVCTNGTRVFIPQRLKAAFEQAVVERVKRIRMGDPQHTDTNFGPLVSFPHMEKVLSYIESGKQQGAKVLIGGERATTGLLAQGAYVQPTVFTDCHDDMKIVQEEIFGPVMSILTYDTIEEAIERANNTNFGLAAGVVTQNISQAHQIIHQLEAGICWINTWGESPAEMPVGGYKESGVGRENGISTLNHYTRTKSIQVELGDYQSVF

SEQ ID NO: 1665 - protein, 420 aa, Ustilago maydis 521
MSSVENTPPTVTAPPGSGGRLSTDSAFSQSRPRRLSMLRFERHKHHGASGNPLPHRRHAFGKPSFSGFQQHFMAGLGELIGTTMFLFLAEGGAKTAQLSVSAAQNETATPLSNETIMFIALSFGMSLLVSAWMFYRITGGLFNPAITIALWWVGVLTSCRALVLFIAQILGGIAGAALVLGLTPTNSISQVTTTLQPGISLAQGFLIEMLLTSILVFSVLMLAVEKHRATYLAPVGIGLTLLAAHLFGVVWTGCGMNPARSFGPAVVAGEFNSDHWIYWIGPLAGGILAVAYFSFLKVLKYNSVVMDQDSDKEITGLKPMHVRIWNLVRHRQNPGALNPESSTHYDKSARQNFDKEETEAFEEREAIRKQMMDKPVFDGHAHEAANGRMSERNNAELMSTSTGSTARLSSGGHQGAILPK

SEQ ID NO: 1666 - protein, 219 aa, Brassica napus
MADNKDGVTPKSSAAFPLRNPNVTLNERNFAAFTNRSAAAHPWHDLEIGPEAPAVFNCVVEISKGGKVKYELDKNSGLIKVDRVLYSSIVYPHNYGFIPRTICEDSDPIDVLVLMQEPVLTGSFLRARAIGLMPMIDQGEKDDKIIAVCADDPEFRHYRDIKELPPHRLAEIRRFFEDYKKNENKKVAVEGFLPAQAAIDAIKDSMDLYAAYIKAGLQR

SEQ ID NO: 1667 - protein, 732 aa, Staphylococcus warneri
MKNRKNSYSIRKLSVGASSIIVASMLFVGAESAQAAETESQDQTTVQNVKETTESSNSNQTQQQPSEPTKAKDSDTNNTNVERPESNSTQTSNQDTDKMQDTSTNQTNENSKHIIDKTNDVSHETTKTNDTDQTSSQDNSEQSLEVDSNEAPASNDKSTPTKQEPTNSKQDIDETSKPNEDSKLVPSKSNITSKADKQEQSSKEPVEDNAQKDKHVSQEDSSLEKQGTQEVPQTDTHKDVNVTPSKSSSEQQLSTTQHITAKDSSASQEVPVHSLDSSKQDHTTSTESHINLDNLDKQATKDRTPTDNGDDQSKDGLNTLTKNAVAIYNNKSKAQATQPTKDQTNKVAPQQQYKNHDPIILVHGFNGFTADNGPGLGDSNYWGGERLNITQEARAKGYNVSEASVSALGSNYDRAVELYYYIKGGTVDYGAAHAAKYGHERYGKSYAGAYRDWKPGQKIHLIGHSMGGQTVRLLEEMLRNGNPEEIEYQKQHGGEISPLYKGGQDNMISSITTLASPHNGTHASDLLGNEAIVRQAVYDFAKSQGNKFSRADLGLTQWGLKQRPDETYIDYVKRVENSNLWKTKDNGFYDLTTEGAQELNNHTSLNPNIVYKTYTGESSDPDKKGIHHRNSHMNIKYLPTTNVIGKLDDQAWRENDGLVSVVSAQHPSNQKYVDATDQIQKGVWQVTPVQHDWDHGDFVGTQKDENGISIEQFQGFWDNLLNDAIRNEKVTD

SEQ ID NO: 1668 - protein, 452 aa, Bradyrhizobium japonicum USDA 110
MSMISARIERLPFARFHKHLLLMGGLGYMFDAMDAAVLAFILPVLRTAWNLSSVQIGVLGSSTYIGFLFGALLAGTLGDLIGRRAVMMSALALYCAASIVSAMVDTWPSFFAARVVAGMGTGAESAIVAPYLAEFVARRYRGSFTGALAGFFSFGFVAAALLGYFIVPAYENGWRIVLVITAVPVVMLLWWRRALPESPRWLESRGREKEAEALLDTIEAGFARQGHVLPHPVVEAVAPQGATGTLLANFAALLAGRQARITIMTWIMWLAITFSYYSFFVWIPGLLVQNGMSITKSFAYSIAIYCAQIPGYFSAAYFNERIGRQATIATYMVLGGASALGLAFAQSDQQIMAAGIFLSLFMNGTYAGVYAYTAEVFPTPVRTTGAGLASAIGRIGAIVSPILVGYLYPNFGFAGVFGVTTTVLLLGAVTVVLMGVPTRGRSLEEIAAGEVA

SEQ ID NO: 1669 - protein, 441 aa, Gluconobacter oxydans 621H
MRIAMVGGGYVGLVSGACFAEFGADVTIVERDLRKLEALNAGRIPIYEPGLDTLVSSNVDAGRLTFGDDLGAAMTDADAVFIAVGTPTRRGDGHADLTYVYAAAGEIARAAKTDLLVVTKSTVPVGTGREVARILRQTRPDLTFDVASNPEFLREGNAIDDFMRPDRVIVGIDRSGPDKGARAQALIEQLYRPLMAIQAPIVLTDLETAELTKYAANAFLAMKVTFINEMADLCEKVGGNIHDVARGMGLDQRIGSRFLSPGPGYGGSCFPKDTRALTAIAQDAGAPTKLVEATVAINEARKTGMAERIIAQAGGSLEGKTVGILGLTFKPDTDDMREAASLPILARLHEAGAVLQVFDPEGMDAARALLPEGVRYCEDALTASQDADIVVVLTEWNMFRALDPARLRSAMRGNAIADLRNIWSPDLMREAGFDYRSIGRP

SEQ ID NO: 1670 - protein, 446 aa, Salmonella enterica subsp. arizonae serovar 62:z4,z23:--
MLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWISGIPVWLFSLVITLALTGSNLLSVKNYGEFEFWLALCKVIAILAFIALGAAAISGFYPYAEVSGISRLWAHGGFMPNGFGAVLSAMLITMFSFMGAEIVTIAAAESDTPDKHIVRATNSVIWRISIFYLCSIFVVVALIPWNMPGLKSAGSYRSVLELLHIPHAKFIMDCVILLSVTSCLNSALYTASRMLYSLSRRGDAPAVMGKTNRSKTPWVAVLLSTGAAFLTVIVNYYAPAKVFKFLIDSSGAIALLVYLVIAVSQLRMRKILLAQGGEIKLKMWLYPWLTWLVIGFICFVLVVMLFRPAQQLEVISTGLLGLGIICTVPIMSRWKKRIRWPKAPLQNLR

SEQ ID NO: 1671 - protein, 306 aa, Mycoplasma hyopneumoniae 232
MSKILATPKARAMAKHANIDLADLKIQHRKIEASDVENYIKSLKSAQTSAEKVEVSSSQQAEKTSIPASIPPKLEGKREKIAPIRKAIARAMTNSWNSVAYVNLVNQIDVSDLWKLRKSVLDPVLKTSGVKLTFLAFIAKAILIALSEFPVMAAKYDEATSEIVYPDTLNLGLAVDTDAGLMVPVIKDAQKLSIVEIAKEIVRLAKAARERKIKPSEMQGGSFTITNYGSVGSLYGVPVINYPELAIAGVGAIIDSAEVKDGQIVASKIMHLTVAADHRWIDGATIGRFAARVKELLEKPEILGIL

SEQ ID NO: 1672 - protein, 427 aa, Salmonella enterica subsp. arizonae serovar 62:z4,z23:--
MNTNKALMQRRHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVNPYSAGMGLMPGHVYRALYPCPLHGISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRAEVMDAIAPGGLGGTYAGNPIACAAALAVLDIFEHENLLQKANTLGKTLRDGLMEIAETHREIGDVRGLGAMIAIELFENGDPSKPNATLTADIVARARDKGLILLSCGPYYNILRILVPLTIDASQIRQGLEIIAQCFDEAKQA

SEQ ID NO: 1673 - protein, 482 aa, Salmonella enterica subsp. arizonae serovar 62:z4,z23:--
MQLNDSTLFRQQAFIDGDWRDARGGDVITVSNPANGKPLGNVPKMGAQETRDAIDAASRALPAWRALTAKERATILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGEMTSNPLVRKLSFTGSTEIGRQLMEQCAKDIKKVSLELGGNAPFIVFDDADLDKAVEGALASKFRNAGQTCVCANRLYVQDSVYDRFAEKLQQAVEKLRIGDGLQSDVAIGPLIDEKAVAKVQEHIADALEKGARIITGGEAHKLGGNFFQPTILADVPDNAKVAKEETFGPLAPLFRFSDETEVIRQANDTEFGLAAYFYARDLSRVFRIGEALEYGIVGINTGIISNEVAPFGGIKASGLGREGSKYGIEDYLEIKYMCIGL

SEQ ID NO: 1674 - protein, 615 aa, Mycoplasma hyopneumoniae 232
MYKFKFADIGEGLHEGVVAQIYKKEGETVNEGDSLFSVETDKITADIPSPKTGKIVKVLMAEGDTIHVGQEIYHIDDGSRAETEVEEAKSETEEKPAGGASVVGEVKVSDALLSFDFGPKKVKTTSPEKVLVPSDSKKVEDKIEKTTNSGKIYQGQIEKEFDVIVVGSGPGGYLAAAEAGNAGLSTLIVEKEFWGGVCLNVGCIPTKAMLKTAEVFDYLEQFSDFGLSGNSDLKISWEKMHQRKTEVVNKLVGGVKAIVRSAKATSIFGKAEFVGAREISVDGKVYRGKNVILATGSVDRKLNLPGFDKGYKSGKIITSKEAINLEQKIDSIVIIGGGVIGVEFAQIFSAAGIKVTILQNLPRLLANLDSEISQIITKNLVDKGVKVITNTNILRFEDDQIIYEFEGKTELITGEKILVSIGRQANSQGLAEVGIELDSRGSVIVDDQCRTNVDRVYAIGDLSAKAMLAHVAYRHAVVSVAAILGKTEKYQEKTVPACVYTHPEIAVVGLTEEQARQAGYDFVIGKASFSHIGKAIASGNAYGFAKLIIDKKYGEIIGAHIIGPVATDLISEIVIAMDSEVTVYELAAAIHPHPTYSEIIWEAARSAVTKLKKMK

SEQ ID NO: 1675 - protein, 497 aa, Photorhabdus luminescens subsp. laumondii TTO1
MSDINLLQPVMAFLQHNHGHYINGQPVSGQGSETFSVINPATDEIIATVNQGGKAEVNAAMQAAQAAFHGVWAQTSPMERGHCLNRLADLLLAHREELAQLETLCSGKTIQLSRMLEIDSSAQFLRYFAGWSSKISGETLNVSLPSFKGEQYTAFTRREPIGVVVGIIPWNFSIMIAIWKMAAALTCGCTIVLKPSEYTPLTMLRVAELAKQAGIPDGVINVINGSGSVLGPALIGHPLCAKVTFTGSVPTGIAVGKSAMEQGLTRATLELGGKNGAAFLADMSVEKIVDGILEAGYLNQGQICAAAERFYIPASHMDDVLKLLSERLAAMKIGSPLDDSTEMGPLANKAHYDKILSLFEQARQEGSEIVYGGHALAGPGFFVAPTVIRANSPEDSLMKEETFGPVGTFLSYNDEEELIGLMNSTPFGLAASLWTNDLSKAMRMIPRIEAGTVWVNMHTFLDPALPFGGTKSSGIGREFGSAFIEHYTELKSVMVRY

SEQ ID NO: 1676 - protein, 183 aa, Glycine max
APPHGTDVSHWIPKRISTGPLKGLQVISIACGTWHSALPTSNGKLFTFGDGTFGVLGHGNRESIPYPKEVKFLNGSKTIKVACGVWHTAAIVKVTFQSNSNASSRKLFTWGDGDQYRLGHGNKGTYLQPTCVSALIKYNFHQIACGHTMTVALTTSGHVFTMGSNENGQLGNRLADEKVPILV

SEQ ID NO: 1677 - protein, 531 aa, Populus trichocarpa
METQIDSFWVLALVSKCKAFSSQDPIFLLLSLFLAWLAIALCYWVYPGGPAWGKYWLKRATCSKAKMIPGPRGFPVIGSMNLMVNLAHHKLAAAAKTLKAKRLMAFSMGETRVIITCNPDVAKDILNSSVFADRPVKESAYQLMFNRAIGFAPYGVYWRTLRRIAATHLLCPKQISSTEPQRLDIASQMVSVMACQGGDYFRVRDILRKASLNNMMCSVFGRKYDLGTSNNEIEELGGLVDEGYDLLGKLNWSDHLPWLANFDLQKIRFRCSNLVPKVNRFVNRVIQEHREDQSGQRRNDFVDVLLSLHGPDKLSDHDMVAVLWEMIFRGTDTVAVLIEWILARMILHPDIQSKVHDELDQVAGRSRPLMEADIRSMVYLPAVVKEVLRLHPPGPLLSWARLAITDTDVDGYDVPAGTTAMVNMWAITRDPQVWVDPLKFSPERFLSKEVTADVEFSVSGSDLRLAPFGSGRRTCPGRTLGLATVSFWVGSLLHEFEWARCGHEPVDLSEVLRLSCEMAKPLTVKVNPRRR

SEQ ID NO: 1678 - protein, 198 aa, Ehrlichia ruminantium str. Gardel
MTLVPMVVEPTSRGERAYDIYTRLLKERIIFITGPIEDQMASLVVAQLIFLEAENPEKDISMYINSPGGVVTAGLSIYDTMQYVKPRIATLCLGQAASMGSLLLAAGEKGMRCALPNSRIMIHQPSGGFQGQATDIEIHAKEILNIKSRLNYIYVKHTGRELSEVVASMERDNFMSADSAQDFGIIDKVIEKRLDIEV

SEQ ID NO: 1679 - protein, 503 aa, Coprinopsis cinerea
AIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGELTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTV

SEQ ID NO: 1680 - protein, 249 aa, Hordeum vulgare subsp. vulgare
MDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 1681 - protein, 325 aa, Oryza sativa Japonica Group
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMVFEP

SEQ ID NO: 1682 - protein, 363 aa, Vibrio sp. Ex25
MTDKSYKIAVLPGDGIGPEVMAQAHKVLDAIEKKHGIAFERDEHDVGGIAIDNHGSPLPESTVKACEESDAVLFGSVGGPKWEHLPPNDQPERGALLPLRKHFQLFCNLRPAQIHAGLEAFSPLRADISGRGFDIVVVRELTGGIYFGQPKGREGEGATEKAFDTEVYHRFEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIEAAVSKALSAGELTGDLAGNNPALTTSEMGDKIAEYILNS

SEQ ID NO: 1683 - protein, 213 aa, Magnetospirillum magnetotacticum MS-1
MRERDPIDVYMNTLVPMVVEQTNRGERSYDIYSRLLKERIVFLTGQVYDEVASLICAQLLFLESENPSKDISFYINSPGGVVTSGLAIYDTMQYIRPAVSTLCIGQAASMGSLLMTAGEKGKRFSLPNSRIMVHQPSGGAQGQATDIEIQAREILALRARLNNIYVDHTGQPLEVIEKVMERDKFMTAEEAKEFGLIDEVVNKRPVAEDDSAS

SEQ ID NO: 1684 - protein, 245 aa, Neorickettsia sennetsu str. Miyayama
MNRRYLRHFGLFGKEGQYTLLDAKVAVIGSGGLGCSVLYNFAAAGLGEIVIVDFDRVSESDLNRQFLFENSSVQQLKVYAAKRRLNAFNPDCKIFCYPMRIQDCPEVIEGCEVVVDCTDNFKTRFYLNELCFFQKKALISAGVTGYSGYVIVLKPFISEDSPCYRCFCPGEPEACFKGSCEDGGVIGAAVNTIGSIQAMKVIQEILHINPEKAGKLIFCDILNNRFRSAVIMRDPYCSVCGQRCV

SEQ ID NO: 1685 - protein, 481 aa, Xanthomonas campestris pv. campestris str. 8004
MFPGEPMSSVSIDGAPDAGENTRFIILISCVATIGGFLFGFDSGVINGTVDGLKQTFQSSAAETGFEVASMLLGCAIGAFFAGRLVDRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 1686 - protein, 739 aa, Staphylococcus xylosus
MENKRNKYSIRKFAVGASSILIGSLLFLNVETVKAAEENNQSEVDTQVQSGNHLGDDEHQNLVNDNTNTPVNDDKTQVNDEKDNQATHTSLHKDQQDTNTKVNDSTDKVDPEFNEADKDKEQDQAEVDPEYNAKDKAKEQDQSEVDPEYNAKDKAKEQDQSEVDPEYNAKDKAKEQDQSEVDPEYNAKDKAKEQDQSEVDPEYNAKDKAKEQDQSEVDPEYNAKDKDKEQDQSEVDPEYNATDKAKEQDQSEVDPEYNATDKEQENHVDHKDANQNKMLENSQPALNERVKNDNNIKESTSFDKLPNQTANHDSEQDDDSNPDKALNTLKENAVATPKNQTQQNVEKANEQPNKAAKQGQYKNQDPIILVHGFNGFTDDINPAVLAHYWGGDKLNIRQDLESNGYETYEASVGALSSNYDRAVELYYYIKGGTVDYGAAHAEKYGHERYGKTYEGVYKDWQPGKKVHLVAHSMGGQTVRQLEELLRNGNQEEIEYQKEHGGEISPLFQGNNDNMVNSITTIGTPHNGTHAADALGNEAIVRQLAFDYAKFKGNKNSKVDFGFGQWGLKQREGETYAQYVQRVQNSGLWKTEDNGFYDLTREGAAKLNKNTSLNPNIVYKTYTGESTRPTLFGNQKSDVNLFLPFTVTGNVIGKAAEKEWRENDGLVSTISSQHPFNQAFIEATDEVKKGVWQVTPIKHGWDHVDFVGQDSTDSNHPTEELQQFWHNLAEDLVRNEQFDA

SEQ ID NO: 1687 - protein, 468 aa, Acinetobacter sp. ADP1
MSMSDTQFDLVVIGAGPGGYVAAIRAAQLGLKTAIVEATHLGGICLNWGCIPTKALLAGAELAHQFKHASQFGFELGDINFDLSKLVQHSRQVSAQLVQGIEHLLRKNQVSVFYAKARFIAKERLELVDAQQQKQMIRAPHIIVATGAHAASLPQIPVDGDYVWSYKEALQPKQLPKSLLVIGSGAIGSEFASLYQDLGSQVTLLDLARQILPTEDHEVAQYVRKQFEQKGMRILTESTVQHLEVCEGKVHCEIHDPSGVQSLSFDHVLSAVGVKPNTQNLGLEQLGVALTNGFIQTDEWCRTNVVGIYAIGDVAGAPCLAHKASHEAILCVEKIAGIADVHPLNRLQIPGCIFTHPQVASIGLTEQQAKAEGKQIHIGKFPMSANGKAIALGQTAGFVKTIVDVESGELLGAHMVGHEVTEQIQGYAIAQALEATDEHLAQVIFPHPTLSEAMHESILASMQRAIHI

SEQ ID NO: 1688 - protein, 451 aa, Haloarcula marismortui ATCC 43049
MPSGSCLYPPIDTPSMHVDIGAALASAADPGVERATLDDLDEQVAVAHERIEQGRNKGEFGYASLNLLEATDAETIHDAVAPVADAESVITVGIGGSALGAKTITEALAEDPGSHVVLDNVDPEHVRRTLDGLSLADTAINVVSRSGTTAETLANFLVVREAYEDRGVDWTERIVVTTGESGPLRALADQHDLPTLPVPEGVPGRFSALSAVGLVPPAILGIDIEGLLAGGQQAADDLAPSLYDSPAYAYGAMAYALEEAGATVNAVMPYAERLESFGEWFAQLWAESLGKDGRGQTPARALGATDQHSQLQLYRAGHRDKVVTFVRPRERADVSIPDPDHEDLSYLAGTDLGGLIDAEYEATVASLPAADRPALEVEIDRLDAESVGELLYAMEAACVLVGELADVETFTQPAVEWGKNATRALIRGEATDETAVIDERERLRIGETESL

SEQ ID NO: 1689 - protein, 310 aa, Bradyrhizobium sp. BTAi1
MTIMSKSGVAVLGIFVVDLAFRAGNMPAIGETIAGSGFAMGPGGKGSNQAVAAARAGAEVTFVSRIGADAFGELAVKTWEAEGIRPRVSRTADAPTGAAFIYVHETRGDNAIIVVSGAADGLGAADVDAAAEAIRSSRVFVTQLEQPVAAAQRGLEIARAAGSITVFNPAPATAFDDRLFALCDYVVPNETEAEALTGIAVSDLAGARRAGDALLAKGAGTALITLGERGALFHGRDHSLHVPPFAAGKVVETAGAGDAFVGGFAAALAGGADPLEAARFGSATAGISVTRAGTAPAMPRRAEIEALLQK

SEQ ID NO: 1690 - protein, 315 aa, Vitis vinifera
  misc_feature (38)..(38): Xaa can be any naturally occurring amino acid
MKTFVVSLLMVLLVVSRVPYRTALPSTVPAFLWSHHQXEMKEAVNYQTLSPKDLAKSVVSEGGWSNLLCSGEKDQQPVDLALVFVGRELSSLDISGSKHADPALVDLLKVSFARSNFSMAFPYVAVSEEKEAMENSLISGFTETCGHDLGVSNVAFLESCSVEGGNFKKLADLHSVHDYLVSRRKMRPVGPTDLVMFCHGGSHLEELDQRLESEVFSELISSLEQSGTKYTVLYVSDPFRSIQYPSYRDLERFLAEGTYGNGSANSTTCDEVCQIKSSLLEGLLVGIVLLIILISGLCCMMGIDTPTRFEAPQDS

SEQ ID NO: 1691 - protein, 795 aa, Bradyrhizobium sp. BTAi1
MSIAHYFDTMDYGSAPEADGEARAWLKRHEATFGHFIAGKFAAPASGKHLATIEPATGKPLARIAQGVAADVEAAVGAARAAQLPWAKLGGHGRARHLYALARMLQRHARLFAVLESIDNGKPIRETRDLDVPLAARHFLYHAGWAQLQEREFADHVPVGVIGQIIPWNFPLLMLAWKIAPALAAGNTVVLKPAEFTSLTALLFAELAADAGLPPGVLNVVTGDGATGALLVDNPGVDKIAFTGSTEVGRLIRQSTAGSGKSLTLELGGKSPFIVFEDADLDGAVEGVVDAIWFNQGQVCCAGSRLLLQEGIAETFRRRLIRRMETLRVGPPLDKTIDMGAVVAPVQLERIKALVETGVKEGAEKYQASGAIPAEGCFYPPTLLWNVHPSSTVAIEEIFGPVVVAMTFRTPDEAVMLANNTRYGLAASVWSETIGLALDIAPKLQAGVVWVNATNLFDASVGFGGCRESGFGREGGREGIYEYLKPKAWSGRTARAKLPPLPEASTEGAGFGTPSIDRTAKLFLGGKQVRPDGNYARAVLSPKGKPLGEVGEGNRKDIRNAVAAARSAEAWARVTAHNRAQILYYLGENLSARSDEFARRIGELTGVSPAKARAEVEASIERLFSYGAWADKYEGTIHTPPLRGVALAMHEPIGVVGVVCPDEAPLLGFISLVAPLIAMGNRVVAVPSERHPLAATDFYQVLETSDVPAGVVNIVTGERDALAKVLAEHDDVDALWVFGSQEASTMAERLSVGNLKRTLVDHGLALDWYDRAASEGPILLRHAVRVKNIWIPYGD

SEQ ID NO: 1692 - protein, 463 aa, Burkholderia cepacia
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEEGARIAGWKDSVKALFGGQLSKITPALWGAFVCSSVTVFFLASWIPVLTVGTGRSASLAAVGLALFSAGGAFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 1693 - protein, 370 aa, Methanosarcina barkeri str. Fusaro
MKEIKFSENVARIDTSGIRKIFEAAGSDAINLGLGQPDFDTPEHIKAAAIKAINEGFTGYTVGPGIPELREALSSKFKEENGFSVSPEEIIVTSGASEALAIALAALLNHGDEVLISNPGFVSYNALTEILSGKAVGVPLAEDLTMKPEAVLEKITPKTRAIVFNSPSNPTGTVASRADIKALAEIADDYNITIISDEVYEYFVYEGEHVSPASYSDNVITVNATSKSYAMTGWRLGYVAARKDYIGQMLKVHQYFQACANSIAQKAAYAAVAGPKDSIKAMREEFRKRRDVLVKGLNDLGMECALPKGAFYAFPKVPNSTEVASKFISNGVIVTPGTAFGSEGDGHIRISYAASMKDIEKALGIMEKVL

SEQ ID NO: 1694 - protein, 316 aa, Photorhabdus luminescens subsp. laumondii TTO1
MTTKKIILDCDPGHDDAIAMLLAHGNPNIELLAVTTVVGNQTLDKVTRNALAIAHIAGITGVPFASGCHRPLVRDIETASDIHGESGLGGVKLPKHSRTLDPRHATDLIIDTIMSHPPKTVTLVPVGSLTNIALAVRKAPQIVERVKEVVLMGGGYHTGNRSAVAEFNIKTDPEAAHIVFNEKWPLTMVGLDLTHQARATPEITKAISRINTKVSRFVVELLDYYGQRYQERHGFNCPPIHDPCAVAYVIDPTVMTTQKVPVNIELNGTLTVGMTVADFRYPPTEDCHTQVAVKLDQQRFWQLIIDALKNIGDTCD

SEQ ID NO: 1695 - protein, 391 aa, Heterocapsa triquetra
MTSGRLEQAAGCTVDVRKMPSTASKIPEASNGMNPSRRSTTSGSGFTYNAERVLGSGSFGVVYQAQVVETGESVAIKKVFQDKRYKNRELQLMQELRHPNVVELKHHFYTAGDKPGETYLNVVMEYCSDTVYRVLKHYSKMKQPVPHILVQLYSYQMSRGCAYIHALGICHRDIKPQNLLVNGRANVLKLCDFGSAKRLVEGEPNISYICSRYYRAPELIFGATHYTSVIDIWSTACVTAELILGQPIFPGESGVDQLVEIIKVLGTPTREELVAMSPTYTEFKFPQIKAHPWNKVFRTGTTSPDLLDYVSKLLVYDPRLRPSGLECCMHPLFDDLRDPGARISNSRPLPDHLFDFSSEELALMDMQMKNRLIPKWWQDGRRDGSKAQAGV

SEQ ID NO: 1696 - protein, 380 aa, Mycobacterium smegmatis str. MC2 155
MVIEDSEIFAAHEGGKLSVELKSPLDTQRALSIAYTPGVAQVSRAIAADATLAKKYTWANRLVAVVSDGSAVLGLGDIGAAASLPVMEGKAALFKTFGGLDSIPLVLDTNDPDEIVETLVRLRPTFGAVNLEDISAPRCFEIERRVIEALDCPVMHDDQHGTAIVVLAALLGAVKVLDRDLASLKVVVSGAGAAGVACTNILRNSGITDIVVLDSKGIVSGGRTDLNSFKAELAQRTNPRGLTGGLAEALAGADVFLGVSAGLVPEELIATMAPNGIVFALSNPDPEIHPDAARKYAAVVATGRSDFPNQINNVLAFPGVFRGALDAGARRITEEMKVAAAHAIFSVVGDDLGVDHIVPSALDPRVGPAVAAAVAEASGV

SEQ ID NO: 1697 - protein, 606 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 1698 - protein, 407 aa, Triticum aestivum
  misc_feature (272)..(272): Xaa can be any naturally occurring amino acid
HLQQVLTKSSSYRSGIPGSASSLAAPLPELTVHVNYEGFAEDVRVGDDLLVDGGMARFEVVEKLGPDVKCRCTDPGLLLPRANLTFWRDGSVVRAKNAMLPTITSKDWLDIDFGIAEGVDFIAVSFVKSAEVINHLKSYIAARSRGSDIAVIAKIESIDSLTNLEEIIRASDGAMVARGDLGAQIPLEQVPSIQQKIVKLCRQLNKPVIVASQLLESMIEYPIPTRAEVADVSEAVHQRADALMLSGESAMGRYPDKALIVLSSVSLRIEKXWWREEKHHEPLELEDVSSSFSDKISEEICISAAKMANKLEVDAVFVYTKGGHMASLLSRCRPDCPIFAFTNSTSVRRRLNLQWGLIPFRLTFSDDMESNLNRTFSLLKARGMIKSGDLVIALSDMLQSIQVMNVP

SEQ ID NO: 1699 - protein, 464 aa, Volvox carteri
AVSYSVSVYNNIAVTGAPLSGIVSQLLSKWKLNVPTLRTVYSQPSAAELSSTNAFIVYSKGQGSYWITEGLTSNSTKVNDLLTFVRNGGSLILVNGANGNDNTFIPLIHALTGGDTLCIARSYADDTRIYRRIDPPSNFGNLPVKQFRYTADLYITGLDCLSGTSIYSSDPTKKLYAISAGITWSVGQGAVTWVGADIVADSKNTVALVTAAAVVVQTTPSPPPPPRVSTSPPPPARVSSSPPPATRSPPPRRITSPSPVLTASPPLPKTSPPPPPRVPPSPPPPVASPPPPPPPRVSPSPPPPQPVSSPPPPPPPRPSPSPPPPRSSPSPPPPSPPPPSPPPPRPSPSPPPPRSSPSPPPPVVSPPPPPPRASPPPPPASSPPPPPRPPPPSPPPSPPPPATAAANPPSPAPSRSRAGGPPLGTRPPPPPPEDDAPPPDYYFPPPQDMSPPPPKKKATGRRLL

SEQ ID NO: 1700 - protein, 164 aa, Vibrio sp. Ex25
MRHIISLLLENQPGALSRVVGLFSQRGYNIESLTVSPTDDETLSRMNITTTSDEMQLEQIQKQLHKLIDVLKVQEVTEYEHIERELMMVKVKASGFARAEVKRTADIFRGQIVDVTAAQYTVQLAGTSEKLDAFIQAISEVTEVVEVARSGVVGIARGERALKP

SEQ ID NO: 1701 - protein, 409 aa, Oryza sativa Japonica Group
MAEARATRRRAEEAEMEAEAGTEGDDGDGGGSSDYTSEDEGTEDYRRGGYHAVRVGDSFKQGAYVVQSKLGWGHFSTVWLAWDTGHSRYVALKVQKSAQHYTEAAMDEIKILKQIADGDPDDSRCVVKLLDHFKHSGPNGNHVCMVFEFLGDNLLTLIKYTDYHGIPLPMVKEICRHVLIGLDYLHRTLSIIHTDLKPENILLESTIDPSKDPRKSGVPLVAPSARTDDPPPKAHAPSVNGGLTRNQKKKIRRKAKRAAAATSEGSGTVASGETDGSDDRGNLSTANEGSPNQDGDKKEEGEGSRRGSKGTRKKMALEADLKCKLVDFGNACWTYKQFTSDIQTRQYRCPEVILGSKYSTSADLWSFACICFELATGDVLFDPHSGDSYDRDEVCLFISFQDISYLYKT

SEQ ID NO: 1702 - protein, 932 aa, Ustilago maydis 521
MFTLVGSKLASSALASTARTQLRPSTTGFSALGTTINSSITTRTLRSLADLENMSTRTSGVDAASHHSMLPSKVRPKQPASALPPPSIILTLSGPDGPGIVHRISGFLARRNMNIMDSAQFGDPTTGTFFMRVHASEPEPEHGSHPDPSAPNYAQQRNAFLARVKAEFDDEFAKQADVSVKIFGAEEKPRTLIMVSKIGHCLNDLLFRLSNKTLPITVPLIISNHPDYEPLAKANGIPFYHLPIDVAQGKTKEWQEAEMVKLAKQYDIDMIVLARYMQILSPQLCSLFSGRIINIHHSFLPSFKGAKPYHQAFERGVKLIGATAHFVTADLDEGPIIEQAVERVDHAMTPADLVQAGSDVEARVLARAVKWTAERRDDCDRPIHHDVHYRGARRRVAIIGGGPAGLSCLSQLVEIADFDVTLYERRAGFGGVWVYDAQPGACVIRYDSYGRAFALWSGDRKDGSDDGTFRPPGAMYDGLRTNLPCDVMAYRSHPFACGTPMFPDRSTVHEYIERFASQLLQQPHAKHVDVRLATAVCSVRRTSHDAFQAQQRIGSGSKWHVASTHVDSGEKSEDVFDHVVIASGRCNTPWIPTIAGLQSFTGEVIHSAWYRSPLAWQGKTVLVVGNSSSGSDIVRELSGYIVRTLPEGQAATKAYIDACNHAHASRANILHSYQDIDKSPPLDFDPRSNDAPAWAKRITVVPRIDSISHSTVVFHGGQTIDNIDVIVFATGYVYEFPYLDQCVSPFDRCPLIPPPAHQAASAAPASTPAHRTAPFLTWLDDWSLFYAVDASICVLGAPIRIVPMPFTHVQSRIVAAAWSGAILPAPGSTALPRLDPSIPTTDPTKWSTTLPHSTHTNHSSDLGYPSDTAYQNALLGLLPPHLQHPPSTQDQHSNQQQHLPPHLSHEGWSQVAPFRNEQRANTKLLRRSALGY

SEQ ID NO: 1703 - protein, 426 aa, Candidatus Kuenenia stuttgartiensis
MDNVISVILGGGRGTRLYPLTKERSKPAVPLAGKYRLIDIPVSNSLNSGINKIYVLTQFNSASLHRHITRSYKFDNFSKGFIEVLAANQTIGSLDWYQGTADAVRQNLRFFDQPNIEYILILSGDQLYRMNYQHFIREHIKSGAEVTVSAIPSERRHAQALGLLKINEQGRIVGFSEKPKDEAVIDTLSLDASFFEKRGVEPKGRTLLASMGIYLFNIGVLKEVLKKSQKPDFGKEIIPEIIKERAVHAYLFDGYWEDIGTIKSFYEANLELATLSPRFNLYSEKNPIYTSPLSLPGAIINNCRIIKSIIADGCIIDSGEISDSVIGFRTRIEKNTTIRSSVLMGADYYETKENIRANKEKGIPNIGIGENTKIVGAIVDKNVHIGENVHIENTKKIETFDAENYMIRDSIIIIPKGSVIPSNTVI

SEQ ID NO: 1704 - protein, 581 aa, Gibberella zeae PH-1
MAATKHSLADSEDRPTKKTKVDSEEKARLKAEKRERKEKKKSQESEPSAENSDADRAAEKERKKAKKAKKLEKKQKLAEAEASAEPAAEVSDEAPKKSKKEKKTTTTEASSNSEAPSSGSYIQTIALSNVPQAEIDEFLSKNEIHITDPKTENVTLRPVLEFHQLPATNLLEKKPSPFANYKAPTPIQSASWPFTLSGRDVIGVAETGSGKTMAFALPCVEAISALKHKHTKAVVVSPTRELAMQTYEQMASVAALNRMKCVCLYGGASKDDQRNLLNRGADIIVATPGRLKDFMSDGTVDLSHSAFAVLDEADRMLDKGFEEDIKMILSSCPPREKRQTLMFTATWPQSVQTLAATFMVSPVKIAIGSGGKETAGGAVELQANARISQSVEVLEPRGKEFRLLEVLKEHQQGSKKNDRILVFCLYKKEATRIENFLSRKGIRVGGIHGDLRQEQRTRSLEAFKSGQTPVLVATDVAARGLDIPEVKLVINVTFPLTIEDYVHRIGRTGRAGKTGQAITFFTVEDKSHSGSLVNILRGANQPVPEDLLKFGTTVKKKAHDMYGAFFKDVDMNAKSTKITFD

SEQ ID NO: 1705 - protein, 244 aa, Candidatus Kuenenia stuttgartiensis
MILFIKHIDIEGPGTIGDFLEDNKISSAIVDLSNKDNLPELKKTLQMVISLGGPMNVYEEEKYPFLADENVFLKEIIKRDIPFLGVCLGAQLMVKAIGGTVSKNPKKEIGFYKVSIDEEGLKDNVFRNFPGEITVYQWHGDTFSIPEGGKRIATSELCENQAVKYGRNIYGIQFHVEVTRNMIAEWAEAYEGELASLKGIVSDKQKMLEDYDNLKGEYLKQAERFYVNLFSAANLLKRKSYSLP

SEQ ID NO: 1706 - protein, 412 aa, Oryza sativa Japonica Group
MNALAATSRNFRQAARLLGLDSKLEKSLLIPFREIKVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIVSLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 1707 - protein, 191 aa, Physcomitrella patens subsp. patens
VRASFDDEFRSSQSIALGLHKRYKSVLQGGIANNLHDFIEAGVTAYSVGCTTEDLRKELLNIGTREADLEDTPVSTGSVGIKTKLAAEEVEECILWTSILFITIQCTPQPTVVRWSSTPPVTAEAQIQWRGFCELIAKAYYERGMAWMSVKPLQMEQMAVSGYAEEPSLVADRMRLVFATLEVVSPQWPKR

SEQ ID NO: 1708 - protein, 559 aa, Ustilago maydis 521
MSQSQRGSPAIADASASASKVKAQQTHKAQQNDRALSNRAKAQQNKERAAAQARARNAPNVAAAAQDKSGPVASTTQGRRSKPPTLAPPSQAGAKQSTKQATKEAPKAKAKVQPPRQTKATPQFKSKVVIRRLPPNLPAHVFWKAVSPWIRDSADCQALTTTAQTSSAPAQPGAETSEAHTSDSRSAATSSASTSPTPTVDYKQFVAGKLKTDTNKQNKHARAYVRFLDAQMLVQFYKAFDGHIFRDSRGNESIAIVEFAPYQKVVVSTPRTGTRGGPRAAKLDAQQGTIDKDADYQCFLERLSKADDQVQRSEGELLASLLDSKGKEKETEARRLAGKVTPLLLHLREQKMAQSDASTRYADKMQKAADKPTIVTAARSAGVGVTGGPSVAAVGAEDKVRAKTSTKDKKDTKDKLDKKDTKDTKDKRDKKDKAKAVAPASEEQAKLQEAEKDKSSRKETRKKRTGKRAVDADGAATPSRAQAAHVATRKAATCKTATKNRDTSASTSAHVAEPLAHVDTAKPNTRPPRRKAPPKNTHKSSTGPPSSPAAASSSKLHIL

SEQ ID NO: 1709 - protein, 442 aa, Streptomyces spectabilis
MSTTAMPASTHHTIALEQSHRLPGGQSMTDLSGLVVDRARNAEVWDKDGKRYIDFFTGVGVCNIGHSHPRFLAEVGEQLSACAVGTFYTDARSRYYELLAAQLPERLGRIHMFSTGSEAVEAAVKLARAATGKHEVVSFWGGFHGKTQGALSLHGGPRKHRSGPFPPGSHQVPYAYCYRCPLQLEHSTCGQRCVDLAEQSIENGSVGDIAAIIVEPVQGTNGNIIPPAGYLRAVRRLADRHGALLILDEVITGFGRTGSLFAFEQDPEVRPDVVVLGKAMASGVPASAIVSRAELVEGTSFGQPSAAASTFGGNPLASAAALATLRILLDERLPERSRLLGETVARRLASWKEEFPFVGNAANVGLMVGVELVEPGTRRPLPKDVTRRIFQGLLAEGVLAMAYDSRIRIYPPLSIPADHLDEGLTAFESVFRSLRSLRSTQT

SEQ ID NO: 1710 - protein, 365 aa, Candida albicans SC5314
MLGRIAKRSISITTNTPLKLPFIPLVSETGFPGAIGNTPLLKLPRISESINRNIYAKAEFMNPGGSIKDRAALYIIKDAEEKGLIKPGGTIVEGTAGNTGIGLAHVCRARGYKCIIYMPNTQSQNKIETLRLLGAEVHPVPAVAFTDPENYNHQAKRHAERLDNAVWTNQFDNVANRQAHIETTGPEIWAQLDGKVDAFTCSTGTGGTFAGTTRYLKDISNGKVKAVLADPPGSVLYSYIKSGGKEMIRGGSSFTEGIGQGRVTDNLQPDLELVDDAVKIPDEDSIAMVYRLLDEEGLYLGGTGALNVAAAVEVAKSLPEGSNVVTVLADSAHKYADRIFSKKWLAEKGLYDAIPPHLQKYAVLD

SEQ ID NO: 1711 - protein, 411 aa, Magnaporthe grisea 70-15
MKDRTESANGEKNGMATKRKAVEEPEPAQVTKRTRPSDDGSPEPVAPPATEVWRIPFPEKPAVLEERNREIEFRVVNNDGAPHSSIILAGLKCLFQKQLPNMPKDYIARLVYDRTHLSIAIVKMPLEVIGGITIREFRARAFAEIVFCAISSDQQVKGYGAHIMAHLKDYVRATSPVMHFLTYADNYATGYFQKQGFTKEISLDKSIWMGYIKDYEGGTLMQCSMLPRIRYLEVGRMLLKQKETVMAKIRLLSKSHLVHQPPEQWASAGNVTPIDPLSVPAIRATGWSPDMDELSREPRHGPHFNELRRFLYQLQNHQQAWPFLKPVNKDEIPDYYKVITSPMDLSTIEERLEQDLYATPKDLVEDVKLIVSNCRQYNNPTTIYHKCANKLEKYMWTLIKEVPEWYSLLED

SEQ ID NO: 1712 - protein, 361 aa, Oryza sativa Japonica Group
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNSQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIQ

SEQ ID NO: 1713 - protein, 540 aa, Gibberella zeae PH-1
MNTLRRASLSKPEEAGKTWPAIAIGAFVAFGGVLYGYDTGTISGILAMPYWQSLFSTGYRDAKGHLNITTAQESGIVSILSAGTFFGALSSPFMTDYIGRRPGLMIATWVFNLGVCLQVAATSIPLFLAGRFFAGFGVGQISAIIPLYQSETAPKWIRGAIVGSYQWAITIGLLLAAIVNNATGGRNDTGSYRIPVAVQFAYSLILFGGMIILPETPRFLIKKDRHEAAAKALSRIRRLTPDHPAIQAELAEVRANHEYETSIGKSSYLDCFKPPILKRQFTGCALQALQQLTGINFIFYYGTKYFQNSGISSGFVISMITSAINVASTIPGMYAIDKWGRRPLLLWGAVGMCVSQFIVAMAGTFSTGQNADGTIFVKSLAGQKAAVSFVCIYIFFFASTWGPLAWVVTGEIFPLKTRAKSLSMTTATNWLFNWAIAYSTPYLVDYGSGKANLQSKIFFIWFGCCFLCIAFVYFFIYETKGLSLEEVDQLYDEVSVASKSKQWKPSESWEHRQSVSGADGKMFGGNDHQGEVTHNEKNEA

SEQ ID NO: 1714 - protein, 168 aa, Enterococcus faecalis
MTKPTEEELKQTLTDLQYAVTQENATERPFSGEYDDFYQDGIYVDIVSGEPLFSSLDKYDAGCGWPSFTKPIEKRGVKEKADFSHGMHRVEVRSQEADSHLGHVFTDGPLQEGGLRYCINAAALRFVPVADLEKEAMANTFLYSNNPHFLDKYDKIVRKKATFDEYLV

SEQ ID NO: 1715 - protein, 322 aa, Asparagus officinalis
IQMGLAENQLSFNLLEDWLEANPDALGLRREGASVFREPALFQDYNGLPAFKNALARFMSEQRGYRAVFDPSNIVLTAGATSANEALMFCLADHGDAFLIPTPYYPGFDRDLKWRTGAEIVPVHCTSANGFRVTRAALDDAYRRAQKSRLRVKGVLITNPSNPLGTTVPRADLEMLVEFVAAKGIHLISDEIYSGTAFAEPGFVSVLEVVAARSPLAADVSGRVHIVYSLSKDLGLPGFRVGAIYSANAGVVSAATKMSSFGLVSSQTQYLLAMLLGDKDFTRRYVAENKKRIKERHDQLVEGPKEIGIGCLESNAGLFCWV

SEQ ID NO: 1716 - protein, 458 aa, Methanosarcina barkeri str. Fusaro
MSDFGGINIRIAMLSPIAWSTPPKKYGPWESIVSLLTEGLVKRGIDVTLFATADSHTAAKLHAVCPRPYEEDKDMIRKVYEGLHISEVFERAKEFDIIHNHFDYLPLTYSALVDTPVVTTIHGISSRKILPVYKKYNNKTFYVSISDAYRCRDLDYIATVRHGIDIGSFYFNEKPQDYLLFLSRLHKDKGVREAIEVAKKTGRKLRIAGFIADQAYFEKEVQPHLDNKQIIYEGHVDPEFKKELLSNAYALLHMINYEEAFGIGVVEAMASGTPVIAMNRGSMPELIRDGETGFLVNSVEEAAEAVQKLGSISRKKCRENVEKRFSVDRMVDDYIKVYETILEKCKREEERPWGFYEVLRQRPGYKVKSLTVLPQGEISLQRHFHRSEHWYIISGEGLVVKNGNEIRVLPGDSVDLPVNEIHRIKNIGSQNLVFIEIAQGDYIGEDDIERLEDKYGRV

SEQ ID NO: 1717 - protein, 353 aa, Picea abies
MEKLMILCLFCTLWIACASRENVLTLNSDPPLVNGLSWTFYKSSCPKLESIVKQRIDFYLKQDITQAAGLLRLHFHDCFVQGCDGSVLLAGSTSGPSEQGAPPNLSLRAKAFEIINDIKSRVDKACKVVVSCADVTALAAKESVRAAGGPQYRIPLGRRDSLKFATQNVTLANLPAPSSKVTTLIKAFATKNLNVTDLVALSGGHTIGIGHCTSFTDRLYPKQDTTLNKSFAQRLYTACPPKTSSNTTVLDIRTPNVFDNKYYVDLMNRQGLFTSDQDLYSDSRTKAIVNDFALDQDLFFEKFAVAMVKMGQLNVLTGSKGEIRSNCSVSNLASTSTVEVAAEDVIESYASFM

SEQ ID NO: 1718 - protein, 446 aa, Escherichia coli O157:H7 EDL933
MISEHDSVLEKYPRIQKVLNSTVPALSLNSSTRYEGKIINIGGTIIKARLPKARIGAFYKIEPSQRLAEVIAIDEDEVFLLPFEHVSGMYCGQWLSYQGDEFKIRVGDALLGRLVDGIGRPMESNIAAPYLPFERSLYAEPPDPLLRQVIDQPFILGVRAIDGLLTCGIGQRIGIFAGSGVGKSTLLGMICNGASADIIVLALIGERGREVNEFLALLPQSTLSKCVLVVTTSDRPALERMKAAFTATTIAEYFRDQGKNVLLMMDSVTRYARAARDVGLASGEPDVRGGFPPSVFSSLPKLLERAGPAPKGSITAIYTVLLESDNVNDPIGDEVRSILDGHIVLTRELAEENHFPAIDIGLSASRVMHNVVTSEHLRAAAECKKLIATYKNVELLIRIGEYTMGQDPEADKAIKNRKLIQNFIQQSTKDISSYEKTIESLFKVVA

SEQ ID NO: 1719 - protein, 400 aa, Pseudomonas syringae pv. syringae
MNDALAQLQSYPFEKLRTLLNGVTPNASLRPIALSIGEPKHPSPAFVKTALAANLDKMSVYPATLGIPELRAAIADWCQQRFDVPKGWLDPARHILPVNGTREALFAFTQTVVRRDSNGLVISPNPFYKIYEGAAILAGATPHYLPCLESHGFNPDFDSVPADIWKRCQLLFLCSPGNPTGALVPLDALKKLISLADEHDFVIAADECYSEIYFDETSPPPGLLTACAELGRSDFKRCVVFHSLSKRSNLPGLRSGFVAGDADILKAFLLYRTYHGCAMPVHSQLASICAWKDEDHVRENRDLYREKFDAVLAILSPVMDVKKPDGSFYLWAKVPMDDAEFCRELFEQTHITVIPGSYLSREVDGVNPGAERIRMALVAPLAECVEAAERIRDFLLQRRL

SEQ ID NO: 1720 - protein, 700 aa, Zea mays
MGSAAAADVVIPACAAVGIAFALWQWFLVSRVKMSAYAAPGNGGHHGGPVFRMEDDEEDVGMGGAGDRDEEEEETAGDGTVAVARCAEIQSAISVGANSFLFTQYKYLAAFTVVFAVVIFLFLGSVHRFSTDSRPCQYTSGRTCKPALANAVFSSVAFLLGAATSVVSGYLGMRIATYANGRTTLEARRGVGAAFATAFRSGAVMGFLLASLGLLVLYITIKVFGLYYGDDWESLYESITGYGLGGSSMALFGRVGGGIYTKAADVGADLVGKVERNIPEDDPRNPAVIADNVGDNVGDIAGMGSDLFGSYAESTCAALFVASISSFGADHNFAAVAYPLLISSAGLLVCLVTTLFATDLFKVKTVRGVAPALKLQLIISTVLMTVAALVVSLAALPAKFTMFDFGEAKQVKNWHLFLCVAIGLWAGLAIGFTTEYFTSNAYRTGAATNVIFGLALGYKSVIVPVFAIAVSIYVGFTLASIYGIAVAALGMLSTVATGLAIDAYGPISDNAGGIAEMAGMSRRIRQRTDALDAAGNTTAAIGKGFAIGSAALVSLALFGAFVSRAGVEDVNVLNPKVFVGLLVGAMLPYWFSAMTMKSVGSAALKMVEEVRRQFITIPGLMEGRAAPDYARCVRISTDASLKEMMPPGALVLLAPLVAGTFFGVSTLAGLLAGALVSGVQIAISASNSGGAWDNAKKYIE

SEQ ID NO: 1721 - protein, 336 aa, Legionella pneumophila str. Lens
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVTPFSDPEEVADYTISVFRNNVPASVPTINFLSGGQTPQQATANLNAINQIGHQPWLLSFSFGRALQEDCLKEWCGNKANIAKAQEALIKRARLNSMACLGEYQNDME

SEQ ID NO: 1722 - protein, 196 aa, Candida albicans SC5314
MSVPSILATTALLTVGGYMLFTGAGESFNIGEFLESTSPYMWTSLGIGSCIGFSVVGAAWGIFITGTSILGAGVKAPRITTKNLISIIFCEVVAIYGLIMAIVFSAKLTSVPSKSLYTKENLYTGYSLFWAGLTVGISNLICGIAVGITGSTAAISDAADSSLFVKILVVEIFGSVLGLFGLIVGLLMTGKAQEFS

SEQ ID NO: 1723 - protein, 272 aa, Oceanobacter sp. RED65
MQPNYEAVMRLAKLAGEAIITIYERSDYTTVTEKEDNSPLTDADLAANQIICDGLQSIADIPIISEEAHIPDQEVRKQWQRFWLVDPLDGTKEFIDRNGEFTVNIALIEEGQPTFGLIYAPVLDTFYYGGDDKAYMKKGDEPAVSIKPSQPLSQIRESNTIRMFVSRRHTDDQMELLRDRLEEKLAHVAAIPLGSSLKIAQLANGEGELYPRFGNVSEWDIAAGHAILRAAGGEILSRQFEGIEYGRKPSMIVPGFFAVGSIDFDWRPILLT

SEQ ID NO: 1724 - protein, 479 aa, Aspergillus oryzae
MATNVTLENLSSLLADDIKVKVAGIDCDGILRGKVMSKEKFLGIAEKGFGFSSAVFGWDMQDVLYTTDANIAPKDSGYVDFIAVPDLSTFRRIPWEDDIPFFLVRFIQNGQTVSADGRNMLKLICDKLAAENCQGMAGVELEFMNFQTPSEDGYSNGSQTQNIAAFLEKNTPGSLRPITAGSFSYSATRPVAFKKYFYDIFNTCAQINCGIEGWHTEGGPGVYEAALKVCDVREMADRVSLFKLLAKSIGVEHGITPCFMAKPIQGQPGSSGHIHVSLCDLDGKNLFARETPDDNAPWPDAVGLSDLGRQFLAGLLEALPDIMPLFAPTINSYKRLVENFWAPVNVSWGLEDRMASIRLITPPVCKPGATRFEVRIPGADLHPHYALAVILAAGWRGVQKKLEIKVPPVSAMKKDNTRPELLPNTLEEALKRFNAADSVAREILDGEFVDFFTATREHELRVWREAVTDWEFKRYIETV

SEQ ID NO: 1725 - protein, 488 aa, Rhizobium leguminosarum bv. viciae 3841
MSVLRKNSTRVGPGYPQVVVLVGATGDLSRRKLLTGLFHLTNAGFIPGCRIIGVSLDDIDADAFRTIARDSLDKFLTRKFSQSEWEAFAASLDYVPLAAGANALKEAVDRAEEALGAETRRVHYLSVPPSAALLAVQLLAQAELTERSRIIMEKPFGTDLASAVALNKKLHEVFDEKQIFRIDHFLGKEPAQNILAFRFANGLFEPIWNRNFIDHVQIDVPETLGLSTRAAFYETTGAYRDMVVTHLFQILAFMAMEPPTALEPAPISEEKNKVFRSMLPIEPRDVVRGQYIGYRNEPGVDPESDTDTFIALKCAIDNWRWAGVPFYLRTGKRMAEGQRIISIAFREPPKSMFPAGSGVGAQGPDHLTFDLADSSKVSLSFYGKRPGPGFRLDKLSLQFAMSETGLIGEVLEAYERLILDAMRGDHTLFTTAEGIERLWEVSQPLLDNPPPVRLYDQGGWGPKSIHQLIAPHAWRLPFERAWRDAAKG

SEQ ID NO: 1726 - protein, 151 aa, Glycine max
HASARKEVLEMEKLMVNTLQFNMSVPTAYVFMKRFLKAAQADRKLELLAFFLVELSLVEYEMLKFPPSLLAAAAVYTAQCTIYGFKQWSKTCEWHSNYSEDQLLECSTLMADFHQKAGNGKLTGVHRKYCSSKFSYTAKCEPPRFLLEKPL

SEQ ID NO: 1727 - protein, 265 aa, Oryza sativa Japonica Group
MGYAQLVIGPAGSGKSTYCSSLYQHCETVGRTIHMVNLDPAAEHFSYPVSTDIRELISLDDVMEELGMGPNGGLIYCMEHLEDNLDDWLDEQLDGYLDDDYLVFDCPGQIELFTHVPVLRNFVEHLKRKNFNVCAVYFLDSQFVSDVTKYISGCMASLSAMIQLELPHINILSKMDLVANKKDVEEYLNPEAQVLLSQLNRQMAPKFGKLNKSLAELVDDYSMVNFIPLDLRKESSIQYVLSHIDNCIQYGVDADVKVRDFDPED

SEQ ID NO: 1728 - protein, 263 aa, Ashbya gossypii ATCC 10895
MTRFVGCIDLHDGKVKQIVGGTLSSKPDGEAPVTNFVSDKSPSHYAHLYASNDVQGSHVIRLGQSNDEAALMALQAAPGFLQLGGGVTKDNCQYWLQWASKVIVTSALFDSDGSFQLQRLREISGLCGRARLVVDLSCRRASDGASWTVMMNKWQTPTTLALNEETLALLSEYCSEFLIHAADVEGLCRGIDEELVAQLGLWAAQLRGDVRVVYAGGANSVADLGLVKRLSGGRVDLTYGSALDIFGGSLVRFQDCCAWNRQQ

SEQ ID NO: 1729 - protein, 421 aa, Acinetobacter sp. ADP1
MQTPVPEYLAHVIDQCENNQTGKLADYIPELAHANPDQVALAMSTVDGQIYAVGDEDIEFTIQSMSKPFTYAYVLQQLGLDEVLDKVGVEPSGEAFNEISLGHDKRPKNPMINSGAITTHSLIPIKDQLESAEIIRRFMSELAGRELCFDEAVYASEIKTAYRNLSIGYMLRTVGILETDPVDIVNGYIRQCSILVTVKDLVKMGSILANGGIDATTGKRLLNRDVVRQVLSVMMSCGMYDAAGDWLTTVGIPAKSGVAGGILGVLPGQVSIAAFSPRLDEHGNSVRGIEMMERLSRDMGLHLMEGTPSAQTIVQSHYRTGKNASTSIYVLRGVLKFTEAEMLLRIFQGEAVDESTIVIDLTQISLIHDVGKRMFLEGVDRLIDDGHSVLLVDPEQRLEQARTHKDRVLHVYQNMDELLEK

SEQ ID NO: 1730 - protein, 432 aa, Anabaena variabilis ATCC 29413
MSIHEIFMPALSSTMTEGKIVSWVKSPGDKVEKGETVVVVESDKADMDVETFYEGYLAHIIVEAGDSAPVGAAIAYVAETEAEIEAAKSLGSSGGAAATPSAPPEPVAATAAVGVPAASQNGSNHREGRLVASPRARKLAKELKVDLTSLKGSGPYGRIVADDIEAAVGKVKQPATTPTAPTPTFTPAPVPATRTPAPAPAPAPVAAAPGQVVPFNTLQNAVIRNMVASLDVPVFRVGYTITTDGLDKLYKQIKSKGVTMTALLAKAVAVTLQKHPLLNASYSDQGLVYHPDINIAVAVAMDGGGLITPVLKNADKIDIYSLSRTWKSLVDKARSKQLQPDEYSGGNFTLSNLGMFGVDTFDAILPPGQGSILAIGASRPQLVATGDGSFAIKQQMQVNITSDHRIIYGADAAAFLQDLAKLIETDAQSLTL

SEQ ID NO: 1731 - protein, 475 aa, Myxococcus xanthus
MGTSEPVEPDHALSKPPPVAPVGAQALPRGPAMPGIAQLMMLFLRPTEFLDRCAARYGDTFTLKIPGTPPFIQTSDPALIEVIFKGDPDLFLGGKANNGLKPVVGENSLLVLDGKRHRRDRKLIMPTFLGERMHAYGSVIRDIVNAALDRWPVGKPFAVHEETQQIMLEVILRVIFGLEDARTIAQFRHHVHQVLKLALFLFPNGEGKPAAEGFARAVGKAFPSLDVFASLKAIDDIIYQEIQDRRSQDISGRQDVLSLMMQSHYDDGSVMTPQELRDELMTLLMAGHETSATIAAWCVYHLCRHPDAMGKLREEIAAHTVDGVLPLAKINELKFLDAVVKETMRITPVFSLVARVLKEPQTIGGTTYPANVVLSPNIYGTHHRADLWGDPKVFRPERFLEERVNPFHYFPFGGGIRKCIGTSFAYYEMKIFVSETVRRMRFDTRPGYHAKVVRRSNTLAPSQGVPIIVESRLPS

SEQ ID NO: 1732 - protein, 291 aa, Streptomyces spectabilis
MRGIILAGGTGSRLWPVTQAVSKQLMPVFDKPMVYYPLSTLMLAGIRDILVITTREDEIDFRRLLGDGSHLGLRLTYRTQDRPGGIAEAFLIGADFIGGEPVALILGDNIFHGRSFGVHVREHTAPDGGRIFAYPVADPTAYGVVEIGEDGTALSIEEKPAKPKSRYAAVGLYFYDEHVVDIAAGLRPSERGELEITGVNEEYLRRGALSVTVLDRGTAWLDTGTFTAMVQASEYVRVIEERQGLKIGCVEEVAWRCGYIDDERLRALSGPLLKSGYGRYLLSLLDEEALL

SEQ ID NO: 1733 - protein, 351 aa, Picea abies
MAKHITPLASVILCMFVIYGRAVHSLPTPVAGLSWTFYSTSCPSLESIVRQRMGAYLSADITQAAGLLRLHFHDCFVQGCDGSVLLNSTSGEQTTPPNLSLRAQAFKIINDIKQHVEAACSGIVSCADILALAARDSVAMAGGPFYPIPFGRRDSLTFANLSTTLANLPSPTSNVTVLISVLGPKGLTFTDLVALSGGHTIGRSNCSSFQNRLYNSTTGISMQDSTLDQNFAKNLYLTCPTNTSVNTTNLDILTPNVFDNKYYVDLLNEQTLFTSDQSLYTDTRTRDIVKSFALNQSLFFQQFVLSMLKMGQLDVLTGSEGEIRNNCWAANPSTYSIIDSEASQESPSYSM

SEQ ID NO: 1734 - protein, 580 aa, Sclerotinia minor
MKCFTSLTALTAIFAQASASAIPAIRSPATSHQKVTASCAHSATSRSCWGAYSIDTDWYDVIPHTGVTREYWLSVENSTITPDGYTRSAMTINGTVPGPAIIADWGDNLVIHVTNNLQHNGTAIHFHGIRQKGSLEYDGVPGVTQCPIAPGDTLTYKFQATQYGTTWYHSHFSLQYADGLFGPLIINGPATADYDEDLGVMFLGDWAHETVFDLWDRARSGPPISLPNTLMNGTNSCECDTSDPQCVGGGKKFEAVFVEGQKYRIRLINVGIDSHFEFAIDGHTLTVIANDLVPIVPYTTETLLIGIGQRYDVIVEANAKPNNYWIRANWGTACSSNLRAANATGILRYNSSSTAEPTSVGATPRGTCGDEPLASLVPHLAMDVGDYALMDEKLNWILGNVITWTINSSSLVLDWTNPTTLQVFRNESIFPTDYNVVPISKEITNSDWVVYVIEDLTTAGTWHPMHLHGHDFFIVGQEQAVFDPVNTPSTFNLKNPPRRDVAALPAGGYLAIAFKLDNPGSWLLHCHIAWHASEGLAMQFVESESSIAIGMKDTQIFDNTCKNWNAYVPTEVFPQDDSGI

SEQ ID NO: 1735 - protein, 236 aa, Gibberella zeae PH-1
MSSLSRRACYKCGNVGHYAEVCSSAERLCYNCKQPGHESNGCPLPRTTEAKQCYHCQGLGHVQADCPTLRLSGTGTSGRCYNCGQPGHLARACPNPVGPGPMGRGAPMGRGGFPGGYGRGGFAGGPRPATCYKCGGPNHFARDCQAQAMKCYACGKLGHISRDCTAPNGGPLNTAGKTCYQCGEAGHISRDCPQKNAPGVGGVPGVGNVGNVGEIPAEVDIGSVPAPPVASIAPVA

SEQ ID NO: 1736 - protein, 439 aa, Bacillus clausii KSM-K16
MEQIAVVGTGYVGLVTGVALSDIGHSVTCVDIDEQKVELMQSGVSPIYEPGLSELMTKNIKAGRLSFTTKHQQAFAGADAIYIAVGTPQKEDGMADLRFIEAVADHIAEHLTHYAVVVTKSTVPVGTNDYIKSYIEKHTDVPFDVVSNPEFLREGSAVHDTFHGDRIVIGADSVIAGDLIEEINKPFGIPVFRTDIRSAEMIKYASNAFLATKISFVNEIANLCEKLNANVDDVARGMGQDKRIGDKFLNAGIGYGGSCFPKDTSALVQIAGNVEHEFTLLKAVIEVNYKQQRLLVEKAREHFGSLRGKTIAMLGLAFKPNTDDMREAASIILAQELILAGARVVAYDPIAMENARNVLPAAVDYADSAFAAIQGADTAFVVTEWDEICALTPGDFKANLKEPVVFDGRNCFNIETMKEAGLNYYSVGRPVVKTEKELV

SEQ ID NO: 1737 - protein, 532 aa, Ustilago maydis 521
MAKATSRSRPSAPSTHKPSKALLMSKPPGRSREWSATRRAAEDSLSIQIQYTLNALIALLVMHTLSSPSSLSLAHLSSHLHLPHSLHSIIPSWLRLPSLAPFASDLPNASQRGAHHPWSGLVGEAASLGPFRSDARGFGHPLTALHNFTRACLGLSYPVPDPTSSPIAAFQHHVHRLARDHTLTATAPWALLSGIPGHLYERGRNDALFVATLVLLFTLARALLMKFVLLPLGELAVPYPKKPRKSDRQSADALNDRAKALRTREKEVLRFAEQGFSLIYYTSSWSLGLVIASRESYWPLKTTEYWTDYPQFRLEPLFKFYYLASCAFYIQQLFVLHVEARRSDHWQMFSHHVITIALIAGSYLCSYHRVGNAILCLMDPSDIALNIAKMLKYAGWQTTCDIAFGLFMLSWLVTRHILYMRVLWSCAFDPISVMSFRPTNHLTGDYFNRTAYLLLIGLLCALQVILLMWFYMICRVAYRVVTKAGAVDSRSDAESSYEDDDLQSVEAAQLMAKTSAIEKTCNPTASKRSKRK

SEQ ID NO: 1738 - protein, 282 aa, Candidatus Pelagibacter ubique HTCC1002
MEIVTNIAPIALAIIMLGLGASLTVDDFLRVAKNPKDFFIGFICQLIVLPIVAYLLIITLGVPIEMALGVMLIAAAPGGVTSNVLTKFAEGDVALSISLTAVMSLLSIVTVPFIVINSINLFDITYVEREITMVSISLKMFFVVTVPVIIGMTIRHFTGDLVIKNLKFIQRFSIALFLLVFAAIYIEEWDKIVSFLTRAGLIALILNVTMMVIGFYVAKFFASGTPQQRAISLECGLQNGTLAVFVATQLFDNIIYMVPTAAYALVMMATSVIFVFILRKSN

SEQ ID NO: 1739 - protein, 132 aa, Helicobacter pylori
SNIKYELDKESGALMVDRVLYGAQNYPANYGFVPNTLGSDDDPVDALVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 1740 - protein, 608 aa, Mycobacterium smegmatis str. MC2 155
MGDTPALKRALSQRQLRMIAIGGVIGAGLFVGSGVVIGDTGPGTFITYGLAGVLIIMVMRMLAEMAVANPSTGSFADYSRNALGNWAGFSVGWLYWYFWVIVVGFEAIAGAKIIQFWIDVPLWLTALILLIAMTATNLFSVSSFGEFEYWFAGVKVAAILAFIGLGAFYVLGVWPDKDLDFSNLTAHGGFFPLGATAVTVGVVTVIFSMVGAEIATIAAAESSDPERAVAKAANSVILRIALFFVGSAFLLVTILPWNSDQTVASPFVAAFTEMGIPYADHIMNAVVLTAVLSCLNSGMYTASRMLFVLAARREAPPQLVAVTRRGVPATAILTSSVIGLICVIAAAFFPDTIFQFLLNSSGAVILFVYLLIAISQIVLRRRTDDSMLKVKMWLFPVLSILTAAAIFAILVQMFVQGGDNRSALVLSLASWAVVIVLFWLNRMFVSRRPQTPDVAPTSEHPHRVLVLANQTVESDELLDELRRIGADRDTTYYVVVPASPIDTGVANTHGPLDISEATQQAAQERLDSTLATLRSGDFEATGTLGEYRPLRALAKAVETFRPDQIVISTLPPEESVWQRFDVVDRARAEHHLPVTHVVSRVRATEPAP

SEQ ID NO: 1741 - protein, 244 aa, Arabidopsis thaliana
MEACLRCSRGSYLIEAMRPLSSSLRPSSSVSFSTGKPIKRAYDGLLLDAGGTLLQLSKPVHETYASLGQKYGLKTTPAEIKEGFKRVFSAPWPEKLRYQGDGRPFWKLVVSEATGCSDNDYFEDVYQYYANGEAWHLPEGAYETMSLLKDAGVKMAVVSNFDTRLRKFDAVIVSAEVGYEKPDERIFKSALEQISVDVNRAVHVGDDEGADKGGANAIGIACWLWGEDVQTFSDIQKRILVSEL

SEQ ID NO: 1742 - protein, 762 aa, Hordeum vulgare
MAILGELGTEILIPVCGVIGIVFAVAQWFIVSKVKVTPGAASAAAGAKNGYGDYLIEEEEGLNDHNVVVKCAEIQTAISEGATSFLFTMYQYVGMFMVVFAAIIFLFLGSIEGFSTKGQPCTYSKGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAANEIEPALKKQLIISTALMTVGVAVISWLALPAKFTIFNFGAQKEVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGLLFKYI

SEQ ID NO: 1743 - protein, 398 aa, Candidatus Pelagibacter ubique HTCC1002
MIKKAKKISSNKISQIHTGVLVLENKTIFKGVGIGYQGTATGEVCFNTSLTGYQEIISDPSYAGQIINFTFPHVGNVGTNKEDLESDKVWTKGVIFNSEITNPSNYRSLANLDLWLKKNKIVGITGLDTRGLTNYIRDKGAPKGTISFSSKRNFNISKLANITAKWSGLNNLDLAEQVTTKKNYIWSGFKTWKKETGYLKNKKSSLHVVAIDYGIKKNILRYFSDLNCKVTVVSCKTSAKDILKLKPNGIFLSNGPGDPAATGKYAIGIIKELIKNNLPIFGICLGHQILALTLGAKTKKMKLGHRGANHPVKNLIKDNVEITSQNHGFEIVRASLPKNIEVTHKSLFDNCIEGIRLKNKPVFSVQYHPESNPGPQDSVYLFEEFINNIKKNAKKKRS

SEQ ID NO: 1744 - protein, 240 aa, Oceanobacter sp. RED65
IEEDNPFLGWRGIRVTLDHPEIFLLQVRAMMKASVGLNNLRIMLPMITSVAEVEEALHLIYRAHQELVDEGINVVMPEVGVMIEVPAAVYQAKTLAGMVDFLSVGSNDLTQYLLAVDRNNPRVSELYTGLHPSVLIALQSVVEAGKSQNCQISVCGELAGTPAGAILLMAMGYDMLSMNAANLPRVKSVIRSISFDFAKDLLDTVMTMDNGQIIASEIELALSRLGQGRVFGPVSTEPQA

SEQ ID NO: 1745 - protein, 394 aa, Aspergillus oryzae
MASARGPRWQQFLQELVMVAGTKEEQRRKSAAILRRLDGGEESDEDSPRREGKRGRRQKRGDLALTQYEQAIAMDVVAPDDIPVSFEDIGGLDEIIEELKESVIYPLTMPHLYSSTSSLLTAPSGVLLYGPPGCGKTMLAKALAHESGACFINLHISTLTEKWYGDSNKLVNAVFSLARKLQPSIVFIDEIDAVLGTRRSGEHEASGMVKAEFMTHWDGLTSANSSGEPQRVVVMGATNRIQDIDEAILRRMPKKFPVVLPPAPQRLRILSLVLKDTKVDRENFDLDYLVKAMAGMSGSDIKEACRDAAMAPVRELIREKKAAGLQMNTVDPEEVRGLRTEDFFSRAGGVRIIPPPAQLQAPIKASSEKDWSTESEATSEVETRPSAEMVEPPE

SEQ ID NO: 1746 - protein, 396 aa, Haloarcula marismortui ATCC 43049
MHIDTAVVLAAGEGTRLRPLTRNRPKPMLPAANRPILEHVFDALVEAGIEKLVVVVGYKRDRVQDHFGPTYRGVPISYVSQTKQLGSGHALLQARSVVDGPVLVMNGDRLVDAATIEEVDTSYAETGNTSIAVLERQDTSRYGAVEVQDRDIVDIVEKPQHDEFRLINGGVYAFDGDIFEAIDETTRHAGELALTDTIELLLESDRVQAVEVDGMWVDATYPWDLLTVAREVLARGRVVESARDEQVWVDNSARVHDEATLQSPVVIGPDCEIGPDAVIGPNVALGRNTTIGANSVIQHTVLDADTRVDPSSTLIDTVTGQDVDLGVNTVVPGGPADVQVGTEVFEDQRLGAVIADRAVALGDVSFVSGSLVGPNARLATGVTVNGTVREGAEVVR

SEQ ID NO: 1747 - protein, 468 aa, Neorickettsia sennetsu str. Miyayama
MCHFFVRMSEKEFDVVVIGGGPAGYVCSIKAAQLGMKVACVEKRPSLGGTCLNEGCIPSKALLHSSYAYYSAKKCFDVLGVECSDVKLNLTKMMGNKSRIVMELSQGIEFLFKKNKVTRFTGTGSILANGDTKKKSVIIDKTETIHTKYVVLATGSEAAELPFAKCDEKSILSSRGALELDAVPKSMIIIGGGAIGLEMASIWSRLGTEVTLMEYADRIAAASDGEVSDYLLKSLTKQGIKFHLSSRITEIKKGKLLSATFEKDEKIGSISAEKILVAVGRRPYSANIGVELERNPSGFIKVDKNFQTSVPGVYAIGDTIPGVMLAHKAEEEGVAVAEILAGRTGHIGWIPSVIYTHPEVASVGKTEEELKVIGIKYKASKFPFAANSRAKTTNDTGGFVKMLVDEHDTVLGVHIVGPSASSLIAEAVLAMEYGASAEDIARTCHSHPDLNEAMKEAALGAFFKPIHF

SEQ ID NO: 1748 - protein, 251 aa, Haloarcula marismortui ATCC 43049
MKAVVLAAGEGTRLRPLTEDKPKGMVEVAGKPILTHCFEQLIELGADELLVVVGYKKQAIINHYEDEFDGVPITYTHQREQNGLAHALLTVEEHVDDDFMLMLGDNIFEANLQDVVNRQAEERADAAFLVEEVPWEEAGRYGVCDTNKYGEITEVVEKPEEPPSNLVMTGFYTFTPAIFHACHLVQPSNRGEYEISDAIDLLLHSGRTIDAIRMDGWRNDIGYPEDRDQAEERLQGEINPEIAAENIAASE

SEQ ID NO: 1749 - protein, 435 aa, Haloarcula marismortui ATCC 43049
MNLSIVGSGYVGTTVAACLADLGHEVVTIDIDEDIVDAINNGESPIHEPGLDELVAEHGGGRLRASTDYEEILDTELTMLALPTPSNDDGSIDLQFMEAGAASIGEALAGTENAAADPHLVVTKSTVVPNTTEDRLAPRIADAGLERGADFLVASNPEFQREGTAVADFLNPDKLVFGTDDDRATALLNDLYAPLREAADGDVPVVETGIAEAEMIKYANNTFLATKVSLINDIGNICKEFGVDAYEVADAIGLDDRIGEQFLRSGVGWGGSCFPKDTDAIIAAAQEQGYDPAVLSAAVELNDAQPERLLSLIDDHVDVSGKRIAVLGLAFKPGTDDIRNTRAVPVIEGLQERGADIVAYDPVATENMRERYPDIEYADSAAIALEGASGAVVVTGWDEFGALDAEFDEMAAPVVVDGRRSIKRRDGITYEGLTW

SEQ ID NO: 1750 - protein, 584 aa, Monilinia fructigena
MKSFTVFTALTAFFAQASASAIPATSSPIFPRQNTTSNITPTCAHSSTSRSCWGAYSIDTNWYDVTPTGVTREYWLSVENTTITPDGYTRSAMTFNGTVPGPAIIADWGDNLIIHVTNNLEYNGTSIHWHGIRQRRSLEYDGVPGVTQCPIAPGDTLTYKFQVTQYGTTWYHSHFSLQYADGLFGPLIINGPATADYDEDLGPIFLQDWAHQSAFEIWDTARLGAPPALPNTLINGTNTFDCSSSEDANCVGGGKKFELTFVKGKKYRLRLLNVGIDSHFEFAIDGHNLTVIATDLVPITPYTTDTLLIGIGQRYDVIVEANATAGDYWIRGNWGTSCSTNLNAANATGILRYDSSSTADPTSVGTTARGTCGDEPIASLVPHLALDVGSYSLVDEQLSFSAANYFTWTINSSSLVLDWASPTTLKIFKNESIFPTDYNVVALDKSSANDDWVVYVIEDLTGFGIWHPIHLHGHDFYIVGQEATVFNPATSPSSFNLVNPPRRDVAALPGNGYLAIAFKLDNPGSWLLHCHIAWHASEGLAMQFVESQSSIAVRMKDTAIFEDTCSNWNAYVPGELFAEDDSGI

SEQ ID NO: 1751 - protein, 403 aa, Neorickettsia sennetsu str. Miyayama
MPVKILMPALSPTMKEGTLAKWLVSEGEKIEAGQVIAEIETDKATMEFEAVDEGVLGKILIPAKTAGVKVNQPIAVLLDDGEGEKELKKFLSTIDKPTVTDNKAETSDGDKIKNNPSSLPADKQQGRVIATPLARKIASINGIDLSLIGSGSGPDGRIVKNDLLKLLDDAPQVQMHGHCTETSIPISPMRRVIAQRLVESKQNVPHFYLSVTCYLQHLLSAKKKFYDCLETKVTVNDFVIKACAFALDKNPAMNVSWEGEFIRQNQTIDISVAVAIPDGLITPIVFSADKLSLSSISDEVRELVDKAKAGRLQPREFQGGSFTVSNLGMYGIDEFTAIINPPQAAILAVGAARKVPTVSADAVVVSDVVTLTLSCDHRVIDGALAARFMQSLKKAIEDPVIML

SEQ ID NO: 1752 - protein, 144 aa, Glycine max
  misc_feature (58)..(58): Xaa can be any naturally occurring amino acid
  misc_feature (90)..(90): Xaa can be any naturally occurring amino acid
  misc_feature (132)..(132): Xaa can be any naturally occurring amino acid
AKPYAFHCSLYAVSRAPYVVRTRSAGDRVRFSRGFACPGHRSDRRLGRRMVGGLLDQXEKRVLETNVLRLVKVGTIRSLEQVYLHSLPMXEHQIIRTLGGPTLNDEVMNIMPVQKHTRAGKGTLVIVLLVVXDYNRHVRLGVKC

SEQ ID NO: 1753 - protein, 989 aa, Arabidopsis thaliana
MGLINQWFPLDTLATPERIRMACFDEFTSPFYMTMDSEGVLMPLVHEHLMMPWNDLRKGDCCGLSKAVSVGYYCKSCDFFAHKKCGESSEFIQHPSHPNHTLQLRSSEGCNSCNLCGRTISDLFYRCDLCDFDVDLYCAKYPPPEVIDIPETHHHKLNLHKELIEFNCDAKCGKITGAEFPYVCYECQLPFHVDCVWRPSELKHPSEVNHSYHSLHPLKLLSGQLPDNCDGKCRLCARKIDDRLFYHCSPCNFTLDLRCVLNPPQQSLLNLKAHDHQLTLLPRLLSFTCNACGLNGDRSPYTCVQCDFMIHQDCLDLPRVININQHDHRVSRTSVPGVGNSKGVLLPWFHRKHIMMPWNDMRKGDCCGSLESVTDGFYCKSCDIFIHKKCGESSGIIDHSSHPDHTLELNRYPNKSCNLCGRSKGVNVCYRCDHCYYQLDLYCAKYPPPEFIDIPETHHHKLTLLKERIEFDCDAKCGETGDGFAYKCPECDLFFHVDCVWHPPEVNHPLEVNHSYHPWHPLKLHTGQPPHYSDGTCRLCARNIDDRLFYHCSPCNFTLDLRCVLNPPPQSLLNLKAHDHQLILLPRLRSFTCNACGLSGDRSPYICIQCDFMIHQDCLDLPRLINVNRHDHRVSRTSVLGVVNSVCGVCHQKVDWTCGGFSCQRCSSYVVHSKCATRRDVWNGKELEGVPEEIEDIEPYVVIDDNTIQHFSHKEHYLRLHVNDVLCNDNKRCKACTHPIFLQSFYSCMDCDFLLHQNCAGFPRMKRHVLHNERLTLVTNETKLFQCAPCDRWSNGFRYQHGYKSLDLQCGSISEPFVHPSHPDHPLYHTLLDGRNEICDGCKKSWYYVLSCIEDDCRFVLCFKCLTLPQVVKHRVDDDPLLLCYGEKACGKYWCDICEKETNPETWFYTCKDHQSSMHTMCVLGDSVGIMPKSTIMGWYKYYEVVLNNSISRPVCEMCKSRCIFPTIMKILEASNEYVCSLACVLERG

SEQ ID NO: 1754 - protein, 445 aa, Burkholderia vietnamiensis G4
MTTKPIGDIAAHRLSSTQLSCEFADIAPLLDPTAAAAAASRCHYCYDAPCVQACPTQIDIPSFIRKIGNGNLKGAAMDILGANPLGGMCARVCPTEILCEGACVRNHQDAQPVAIGALQRHATDWAMATGAVRFTRAPDTGRHVAVVGAGPAGLACAHRLALAGHRVTLFDARAKAGGLNEYGIAAYKTVDDFAQREVEWLLSVGGIALQTGVALGRDVTLDALREGHDAVFVAMGLTGVRTLAIDGEQLSGVMNAVDFIEQVRQADALENVPVGRRVVVIGGGNTAIDAAVQSRKLGAQRVTMAYRRGVDAMSATWAEREFAQTSGVTLVTHAKPVRIAGEGGHVARVEFESASGERFAIEADMVLKAIGQTLVPAGIDAALLTADGTRIAVDAHGRTVLPDVWAGGDCAATDGIDLTVQAVQDGKRAAAAIDAALAQRDAKAA

SEQ ID NO: 1755 - protein, 132 aa, Helicobacter pylori
SNIKYELDKESGALMVDRVLYGAQNYPANYGFVPNTLGSDGDPVDALVLSDVAFQAGSVVKARLIGVLNMEDESGVDEKLLALPIDKIDPTHSYVKDIDDLSKHTLDKIKHFFETYKDLEPNKWVKVKGFEN

SEQ ID NO: 1756 - protein, 279 aa, Bacillus cereus G9241
MKNLQSTTTLHNGVEMPWFGLGVFKVEDGPELVEAVKSAIKAGYRSIDTAAIYGNEKAVGEGIRAGIKEAGISREDLFITSKVWNSDQGYETTLAAYEESLKKLELDYLDLYLVHWPVEGKYKDTWRALETLYKEKRVRAIGVSNFQIHHLQDVLADAEMKPMINQVEYHPRLTQKELQAFCKEQGIQMEAWSPLMQGQLLDNETLQEIAHKYGKTTAQIILRWDLQNEVVTIPKSTKEHRIIANADVFNFELTKEDMEKIDALNQNHRVGPDPDNFDF

SEQ ID NO: 1757 - protein, 455 aa, Bradyrhizobium japonicum USDA 110
MTASDAGTAPWTGRLTGRGAGVSVLVATAIVVADMIGVGVFTSLGFQVKDIPSGFSILLLWSVGGIVALCGVFSYSELGAMFPRSSGEYNFLGRAYHPAFGFLAGWVSATVGFAAPVALAAMAFGEYAKSVVPDLPPIPLAIGVVWLVSLVQLTGVRHSSTFQLISTILKVVLIVAFLVAGFIIGVPQPIAFTPQPGDLAHIVSAPFAIGLVFVMYSFSGWNAATYIIGEMNMPQQNLPRALLAGTLIVLVLYVALNAVFLYSTPVGALAGQLDVASVAGSAIFGSLGGRIVGAMICVGLISSISAMMWIGPRVMMTMGEDIPALRVFSRKSTSGAPAYAILFQLAVATLLLFTRSFEAVLDFIQFALLFCSFFTVAGVIKLRITDPDLPRPYRAWGYPFTPLVFLLVTAFMMYYLLTERPVQSLSGMFVMLSGLLIYAVFRRRPVAAGTSHNRE

SEQ ID NO: 1758 - protein, 204 aa, Zea mays
MATEIQGYYDDGTAVVSFDVHNIDTTLTNLGSVVEWWLGETYRLHHRGHIAGLDVEWRPARVPGPVPVAVLQICVDHRCLVFQILQADYIPDALSRFLADRRFTFVGVGISGDVAKLRAGYRLGVASAVDLRVLAADTLEVPELLRAGLQTLVWEVMGVQMVKPHHVRVSAWDTPTLSEDQLKYACADAFASFEVGRRLYEGDY

SEQ ID NO: 1759 - protein, 507 aa, Magnaporthe grisea 70-15
MAAESHAAAELELKDNTVIVVLGASGDLAKKKTYPALFGLYRNQFLPKDIKIVGYARTKMDHEEYIRRIRSYIKTPTKDMEQQLDDFCSLCTYVAGQYDKDESFYNLNDHLEDLEKNQSEAHRLFYMALPPSVFTIVSQHLKRCCYPTRGIARVIVEKPFGKDLASSRELQKSLEPDWKEDELFRIDHYLGKEMVKNILILRFGNSFLGATWNRHHIDNVQITFKEPFGTEGRGGYFDEFGIIRDVMQNHLLQVLTLLAMERPISFSSEDIRDEKVRVLRAIPAIEPKNVIIGQYGRSLDGSKPSYKEDDTVPKESRCPTFCALVAYIKNERWDGVPFIMKAGKALNEQKTEIRIQFKDVTSGIFKDIPRNELVMRIQPNESVYIKMNSKLPGLSMQTVVTELDLTYRRRFSDLKIPEAYESLILDCLKGDHSNFVRDDELDASWRIFTPLLHYLDDNKEIVPMEYPYGSRGPAVLDDFTASYGYKFSDAAGYQWPTTSAALHANKF

SEQ ID NO: 1760 - protein, 514 aa, Mycobacterium smegmatis str. MC2 155
MSEQEKAMTVYARPGADGAKMSFQARYDNYIGGEWVAPVEGRYFENPTPVTGQVFCEVARSSEADIDKALDAAHAAAPAWGKTAPAERALILNRIADRMEENLESIALAESWDNGKPIRETLNADIPLAIDHFRYFAGVLRAQEGSLSQIDEDTVAYHFHEPLGVVGQIIPWNFPILMAVWKLAPALAAGNAVVLKPAEQTPVSVLYLFSLIGDLLPAGVVNIVNGFGVEAGKPLASSNRIAKIAFTGETTTGRLIMQYASQNLIPVTLELGGKSPNIFFNNVLAQADDYQDKALEGFTMFALNQGEVCTCPSRSLIQSDIFDEFLELAAIRTKAVRQGDPLDTETMIGAQASNDQLEKILSYIEIGKSEGAKLITGGERAQLGGDLNGGYYVAPTIFTGNNKMRIFQEEIFGPVVAVTSFSDYDDAISIANDTLYGLGAGVWSRDGNIAYRAGRDIKAGRVWTNCYHQYPAHAAFGGYKQSGIGRETHKMMLDHYQQTKNLLVSYSNKAQGFF

SEQ ID NO: 1761 - protein, 176 aa, Burkholderia vietnamiensis G4
MPTRRHLLFAGATGVAALAALSSAGRRMLVGRAFAAPPGARGATASFDVTRSEAEWRRRLTPAQYTVLRDAGTEPPYSSPLNGEHRRGTFACAGCDLALFPSSTKFDSHTGWPSFWKPLDHAVATEADASYGMARTEVHCRRCGGHLGHVFDDGPPPTGLRYCMNGLALAFHPAAA

SEQ ID NO: 1762 - protein, 188 aa, Oryza sativa Japonica Group
MGDAQFYFLLPTRSVFATDAARRASAAARRAVPPPPSSSSDGDDGEEEREAAVAKRPRNGDAGSLAGRKSEKGSKGYRQSDNLQLLQLEEKDVISSTATVLSDLCGPQEWVPMDRLHEVMFEKYGDLWHHNRVRKYLTSEDWPKSETDGRPWHGLSLLLRKYPEHFVINIRMSGGRSIEFVSLVSLQP

SEQ ID NO: 1763 - protein, 340 aa, Mycobacterium smegmatis str. MC2 155
MASYVMPAEGAPQDRVWMAFPCEGYSLGDTEADRHEARSTWAAVAHAIAQFEPVTMLVDPAEIGAAKSYVSQDVELIEAPLNDAWMRDIGPTFVHAADGSVAAVDWTFNGWGGQDWARWDRDAEIGVTVAELASVPVVSSALVNEGGGIQVDGNGTVLLTETVQLDPGRNPGLTREQVERELARTIGGTDFVWLPRGLTRDSERFGTRGHVDIVAAIPTPGRLLLHTQRAEAHPDSLVCKEIRAVLEADGRFDIVEMPAPDTLTDAEGPVDYSYINHLVVNGGVIACAFGDPRDADAAAILAEQYPGREVVSVDARPLFARGGGIHCITQQQPAPRGKVS

SEQ ID NO: 1764 - protein, 512 aa, Mycoplasma hyopneumoniae 232
MQKNRKNVKKKLVLIIIDGLGLRFESQGNGFALAKTPVFDRLFQEYPNSLIAASGQEVGLPEGQMGNSEVGHLNIGAGFVVYTGISIINNALKTGKFFENEKFILAFRHSIKTGFPLQIMGLFSPGGVHSHQDHLFALIDFAANFGVKKLNLHLFGDGRDVGPKSIKPWIKMLNLKLKNYENYKIASISGRFYSMDRDKMFDRVELGYNALLGKAENTFTDPIDYVNFQYEKGVSDEFFEPAINLKVNKKDFLADDHPVIFFNFRPDRARQLSHLILQTDLYEQKPKNPIKTDVFVSMMKYEGINCLVAFEEMRVENPLGKLICMAGFRQLRLAETQKYAHVTFFVDGGVELELENSDRILIDSLKVQSYADFPQMSAVEITDKLLEVGQKYDFIIMNFANPDMVGHTGDLKATIKAVEILDFQIGRICKWAEEKNFDFFITADHGNAELTEDENGNPSTKHTTFPVMLISSDKTIKLKSGKLANIAPTILDYLGLDKHPDMDHDSLIIKDK

SEQ ID NO: 1765 - protein, 507 aa, Xylella fastidiosa Ann-1
MTIHNFDLLVVGGGINGTGIARDAAGRHLSVCLCEQHDLASHTSSASTKLIHGGLRYLEYYEFALVSKALGEREILLRQAPHIVRPLHFILPHQPHLRPTWIIRAGLLLYDHLGFSRRTLPRSRRLNLAKHPTGQPLKQELHTGFMYCDAQVQDARLVVLNAMDAAQRGARILTRTRCVRTRRDGAHWLTELEDPQGRQQQIRTRAIVNAAGPWAVTFLDHIAQQPHQHTLRLVKGSHIVVPRLFEHEHAYIFQQPDRRIVFAIPYEQHFTLIGTTDVNYVADPANPHIDAAETMYLCNAVNAYFRQQITPEDVLWSYSGVRPLLNDGHNNASKVTRDYQLEILGNSAPLLNVFGGKLTTYRKLSEEAVNQLCVALDHPYRAWTANGPPLPGGEHHDIAALQNTLRQHRPWLPTATAQRLIHNYGTYAETLLGNATNLHTLGIHFGADLYQAEVDYLRTHEWACSAEDILWRRSKLGLHLDAHGTQRLEDYLRSCSRIPDHADTTTQ

SEQ ID NO: 1766 - protein, 695 aa, Zea mays
  misc_feature (143)..(143): Xaa can be any naturally occurring amino acid
  misc_feature (162)..(162): Xaa can be any naturally occurring amino acid
MNLLAMATMSAACFLPWRRSHRCCASSLRASTVLFVLAVLVSDVGGRHHRHICPPYFSCGGLSDISYPFRRQGDPSGCGVESYELVCTDTDATIRIGSGTYTVLSINSTYSYFWVVDADLDIQSSCPLPRWDYHLFPFILRIXTHIVGGLNSAMIPLFLLIXDSVWAIFVNCSQPLENNDTDKYHRYEPVSCLSNSSFIYLATGYRYDGYVSAGDLKPSCGYLAMTPLGGPGMPVPWNTSYPDVVKFMRSGFALRFPFSYGDNIRECLANNMRTFLKDPRSSTGIKELIVDILTVVDIFWACVIYQLQSTNNNGVTTVLIGIIETIQYVSGVLKYTAVVCRFVLMPLAVFVFLVYKYWKTRITVDAVEKFLRMQQMLVPMRYAYTNIIAITGHFRDKLGQGGYGSVYKGVLQPGEVHVAIKMLGNSNCNGDEFISEVATIGKIHHVNIVRLIGFCSEENSRALIYEFMPHGSLDKYIFSSEKSLSWDKLNEIALGIARGLNYLHHGCDMQIVHFDIKPHNILLDNNFVPKVADFGLAKLFPKDDNFVPLSAMRGTIGYIAPEMVSRSFGVISSKSDVYSFGMLLLEMTGGRRNADPHAGSSSQAYYPSLVYSQLSQGDANEISEGVDMHELEKKLCIIGLWCIQMKPQDRPMMSEVIEMFEDGVDGIQMPPRPFFCDDEGDSYYSAISKLDTIEE

SEQ ID NO: 1767 - protein, 361 aa, Erwinia carotovora subsp. atroseptica SCRI1043
MKALAKLRPEEGIWMMDAPMPELGHNDIMIKIRKSAICGTDVHIYNWDEWSQKTIPVPMVVGHEYVGEIVAIGQEVNGFHIGDRVSGEGHITCGYCRNCRAGRRHLCRNAIGVGVNRPGSFAEYLVIPAYNAFRIPDNISDELAAIFDPFGNAVHTALSFDLVGEDVLITGAGPIGMMAAAVCRHVGARNVVITDVNAYRLELASKMGATRAVNVAEEKLTDVMIELGMTEGFDIGLEMSGAPSAFRAMLKAMNHGGRIAMLGIPHEPMSIDWGEVIFKGLFIKGIYGREMFETWYKMSALIQSGLDLSPIITHRFHIDEFQKGFDAMRSGQSGKVILNWDEAYTRHTSSCMCVDCATRHT

SEQ ID NO: 1768 - protein, 185 aa, Mycoplasma hyopneumoniae 232
MENKIILVDIEISKGSNIKYELDSKTKKLVVDRILYGDFVYPANYGSIPKTLDWDGDALDFLVYSNQKFLPGTQLNARLLGALEMIDDGEIDTKLIGVHNDDYRFDHIKSLDDLPQEWLDSIYYFFSNYKNWKRPGITKVSKFLKYDQALKEYKTCQELFNKYKDFKKSEFLKLMMEQFPEKYQK

SEQ ID NO: 1769 - protein, 371 aa, Legionella pneumophila str. Lens
MSFSTSTNLTPIEMQDDDLEKIQSQNNPSAINEVKTNTFVINLQQAIFGLETGSEAINLVSHKNTGFPFPAGEYKPRHFLTGTELAREEIQFILSQARSLKQNPGLYNQALANKSLVMIFEKPSFRTRLSFALAIQSMGGLVVESIANSRKQETPADMARVLNGYADFVMVRTHEDRFLQEMAEYSKIPIINGLSALHHPCQTLADLLSLEEQFGALEGLTLTYIGDGNNILHSLMLLAPQLGVTVHYCCPKSNQPNETIVKEAQSKAGKQMIYYFDKPEEAVKQADAVYTDVWTSMGFDNPEAGKIFKGFQVNETLMSHAKPDSVFMHCMPMERGKEVSATLPDSASSIIFRQSENRMHVQKALMLFLDQ

SEQ ID NO: 1770 - protein, 232 aa, Desulfitobacterium hafniense Y51
MQLRGDIRMIKIAPSILSADFAHLGDQVALVEKAGAEVLHIDVMDGHFVPNITIGPLVVKALRPYSQMRFDVHLMIEHPERFIEEFAKAGADHITVHLEATPHIHRAIQQIKGLGLTAGVSINPATPLDGIKYILDELDMVLIMSVNPGFGGQKFIPAVLPKIEVLHRHLDQMQSSCEIEVDGGINLDTAPAVVKAGANILVAGAAVFACADPARAVQELREAAQGYKGDPK

SEQ ID NO: 1771 - protein, 328 aa, Glycine max
MSKEVIATQSPAPFEYEILDSDAEVLRTVRASSNHTNPWIEPGRLKLRHRIGRGPFGDVWLATHHQSTEDYDEYHEAAAKMLHPIKEDHVKIVLESINELGPPPQGVASVSWLHGISVLNGRICIIMNLCEGSIGDKMAGLKEGRISLNDVLRYGINLAQGVQELHSKGSFILNLKPFNVLLNDNDQAILGDVGIPSLLLGSSFLSSDMAKRLGTPNYMAPEQWEPEVRGPISFETDSWGFGCTIVEMLTGNQPWYGCPVRRIYQSVVEKHEKPNIPSGLPSSVENILSGCFEYDLRNRPLMVDILSVFQRFVNIYIFIYFLKILLKL

SEQ ID NO: 1772 - protein, 284 aa, Aspergillus oryzae
MLHVPYTFQNTFVAVVGEFVGTFMFLFFAFAGGQVSNTPKPAEGAAPNTSNLLYLSLSFGFSLLVNVWTFYRVTGGLFNPVVTLALCLCGGMHPVRGVLVFASQIIAGIASAGVVSCLFPGPLSVGTRLGGGTSISQGLFIEMFLTAHLVFVVIMLAVVKQKSTFLAPVGIGLVLFVNQLVGTYYTGCALNPARALGPDVINRSFPGYHWIYWVGPLLGSLLASGFYGFLSIFHYETVNPGQDFNQWEAAAGPGPWHEEINKHSGAPNHSHLSGDQPTLHQDNV

SEQ ID NO: 1773 - protein, 293 aa, Bacillus clausii KSM-K16
MSKVKKAIIPAAGLGTRFLPATKAMPKEMLPIVDKPTIQYIIEEAIEAGIEDIIIVTGKGKRAIEDHFDHSFELEQNLFNKGKLDMLEKVQASSKVELHYIRQKEPKGLGHAVWCARKFIGNEPFAVLLGDDIVQAETPGLKQLMNQYDQTERSVIGVQPVPENETHRYGIIDPESQNGRLYRVSSFVEKPKQGTAPSNLAIMGRYILTPEIFTFLEKQETGAGGEIQLTDAIQTLNEQQSVYAYDFEGKRFDVGEKLGFVLTQLEFALEREELREPLLQKMREFISEKTAIN

SEQ ID NO: 1774 - protein, 510 aa, Vibrio sp. Ex25
MSAKKPLALVILDGYGYREDTASNAIANAKTPVMDALIANNPHTLISASGMDVGLPDGQMGNSEVGHTNIGAGRVVYQDLTRITKSIADGEFAETPALVEAVDAAVKAEKAVHIMGLMSPGGVHSHEDHIYAAVEMAAARGAEKIYLHCFLDGRDTPPRSAENSLQRFQDLFAKLGKGRVASLVGRYYAMDRDNNWDRVQVAYDLLTQAKAEFTAETAVAGLEAAYAREENDEFVKATAIKAEGEEDAIMQDGDAVIFMNYRADRARQITRAFVPDFDGFERAVFPAVNFVMLTQYAADIPLAIAFPPASLENTYGEWLSKQGQTQLRISETEKYAHVTFFFNGGVENEFEGEERQLVASPKVATYDLQPEMSSPELTEKLVAAIKSGKFDTIICNYPNADMVGHTGVYEAAEKAIEALDESVGKVVEAIKEVGGQLLITADHGNAEMMVDPETGGTHTAHTNLPVPLIYVGDKAVEFKEGGKLSDLAPTMLSLAGLEIPAEMTGEVLVK

SEQ ID NO: 1775 - protein, 316 aa, Thiobacillus denitrificans ATCC 25259
MSIDNLMVFSGNANPRLASDVVRHLNIHLGRATVSRFSDGEVMVEILENVRGKDVFVLQSTCQPTNDTLMEVMVMVDALKRASAARITAAIPYYGYARQDRRTRSARVAITAKVVANMLQGAGVDRLLTMDLHSDQIQGFFDIPVDNIYSSPILLGDIWKRNHPNLMVVSPDVGGVVRARAIAKRLECDLAIIDKRRPKPNVAKVMHIIGDVKDRTCIIMDDMVDTANTLCEAASALKEHGAQKVMAYCTHAVLSGSAAERVTNSALDELVVTDTIPLRDDARACKKIRQLSVAELLAETIRRISNEDSVSSLFIE

SEQ ID NO: 1776 - protein, 125 aa, Triticum aestivum
MAGGGDKLILRGLQFHGFHGVKQEEKKLGQKFVIDVDAWMDLAAAGDSDDISHTVSYSDIYRIAKGVVEGPSRNLLESVAQSIANTTLLKFPQISAVRVKVGKPHVAVQGVVDYLGVEILRHRNA

SEQ ID NO: 1777 - protein, 62 aa, Picea sitchensis
MDNHQSELAEELAERKFLFCAHPETLKETILHMDLGSLLPYPLSSPMAVVQSINKFLGFPDD

SEQ ID NO: 1778 - protein, 360 aa, Yarrowia lipolytica CLIB122
MASAASALPKRTLATNARTMFQPKEYGSKYTVTLIPGDGIGNEITDAVKTIFKTISVPIDWEVVNVTGVGENHLDGYEEAIRSINRNKVAIKGILHTPVEKHGHTSFNVALRRELDIFASLVLIKNIPGVQTRLDGIDMALIRENTEGEYSGLEHSPVPGVVESIKVITKRKSERIARFAFDFALKNNRHKVTAIHKANIMKLADGLFRNTCKEVSAEYPEIQYGDMIVDNASMQAVSWPQQFDVLVTPNLYGTILSNIGAGLVGGPGLVPGVNLGTEHAVFEPGCRHVGLDIKGRGTANPTAMILSSAMLLRHLNLDDFADVISKATYDVLAEGQVRTPDLGGNSTTDEFTMAVINKLQ

SEQ ID NO: 1779 - protein, 345 aa, Vibrio sp. Ex25
MTQANTNNAYGKDIAMTVIGAGSYGTSLAISLARNGANVVLWGHEPEHMARLEADRANHAFLPGVDFPESLIIESDLEKAVQASRDLLVVVPSHVFGIVLNSCKPFLREDSRICWATKGLEPETGRLLKDVAYDIIGENYSLAVLSGPTFAKELAMGMPTAISVASPDAEFVADLQEKIHCSKTFRVYANSDFIGMQLGGAVKNVIAIGAGMSDGIGFGANARTALITRGLAEMSRLGAALGAKPETFMGMAGLGDLVLTCTDNQSRNRRFGLALGQGKDVDTAQEEIGQVVEGYRNTKEVWMLSQRMGVEMPIVDQIYQVLYQGKDARLAAQDLLARDKKAEGK

SEQ ID NO: 1780 - protein, 273 aa, Vibrio sp. Ex25
MKHCEKQKVWNRIVSEAREMSEQEPMLASFYHATIIKHESFCAALSYILANKLNTASMPAMAVREVVEEAFSADPTITDCAACDICATVNRDPAVSMYSMPLLYLKGYHALQGYRVANWLWKQGRHALATYLQNQISVACQVDIHPAARIGSGIMLDHATGIVIGETAVIDNDVSILQDVTLGGTGKECGDRHPKIREGVMIGAGAKILGNIEVGEGAKIGSCSVVLQAVPPHTTVAGVPAKIVGRPKTDKPSLDMDQGFNGKSQSFIHGDGI

SEQ ID NO: 1781 - protein, 363 aa, Thiobacillus denitrificans ATCC 25259
MSLKCGIVGLPNVGKSTLFNALTQAGIAAENYPFCTIEPNTGVVEVPDPRLDELAKVVKPQRVVPAIVEFVDIAGLVAGASKGEGLGNQFLANIRETDAICHVVRCFHDENVIHVAGKVDPLSDVETIATELALADLASAEKALARYEKPARAGDKEAQHMVAALKPVVAALNEGRPARAAGLDAEGLARIKPLCLMTVKPTLYVANVDEDGFHDNPLLDALTAFAEKEGAPVVPVCAALEAELQELSPEERVEYLNELGWDEPGLNRLIRAAYALLGLQTYFTAGVKEVRAWTIHKGDTAPQAAGVIHTDFERGFIRAQTISFDDFIACQGEQGAKEAGKMRAEGKEYVVKDGDVLNFLFNV

SEQ ID NO: 1782 - protein, 666 aa, Magnaporthe grisea 70-15
MAPHVPFDTDQVRDKARKDLLYLLEGVRGKKNLVIEKSLAGPIGLIVKVSTLQDYGVDKFFFLERNCSAAHAEHVDIRTLWVYHTDAKIATDEIRRLHRESQTGHEFHVFWVPRRTTMSDKLLEEAGVLGDVNISELPLYFFPLERDVLSLELEDSFRDLFLANDPTPNYLLARALMGVQQRHGLFPRIIGKGDNARRVAEMLSRMRQELLAGEDVSDKIGLNPSTTMESVIIIDREVDPVTPLLTQLTYEGLIDEVFEIQHNQAEVDSTVVGVPPQSAAQNNSTNPTANSTGRKRKIQLDSSDKLFDQLRNANFATVGPLLNKIARRLQSDYDSRHATKTTAELKSFVQKLPGYQAEQASLKIHTGLAEEIISHARTDLFRKLLEVEQNLAYGFEPSLEAIEELIACDTPLPKVLRLLCIHSCLSGGILVKDFEFLKRLVLEGYGYQHLLTLHNLEKLQLFLSRTSPLAQMIPMTGASHGATGIKTNYTYLRKQLRLNVEEVNDNDPTDIAYTYCGYAPLSIRLVQCILQKQYLLSITKGGSGAVPAAAGVVGAQGWKGFDDAVKHARGPTFDEVQKGEDKAVKARALLSGSAEKRTVFVVLVGGITFTEIAALRFIAKKEEARLNIVICTTSIISGNKIMAAAIEKESFGKRADSIQTTVEQQA

SEQ ID NO: 1783 - protein, 371 aa, Nicotiana tabacum
MAKRTLPLLRHLLSSPSHGFSHSLTSTRSVTYMPRPGDGTPRAVTLIPGDGIGPLVTGAVEQVMDAMHAPVYFERYDVHGDMKSVPPEVMESIRKNKVCLKGGLKTPVGGGVSSLNVQLRKELDLYASLVHCFNLQGLPTRHENVDIVVIRENTEGEYSGLEHEVVPGVVESLKVMTKFCSERIAKYAFEYAYLNNRKVLTAVHKANIMKLADGLFLESCPEVATKYPGIKYNEIIVDNCCMQLVSRPEQFDVMVTPNLYGNLVANTAAGIAGGTGVMPGGNVGADHAVFEQGASAGNVGNEKILEQKKANPVALFLSSAMMLRHLQFPSFADRLKTSVKRVIAEGKYMTKDLGGNCTTQEITDAVIANLD

SEQ ID NO: 1784 - protein, 155 aa, Magnaporthe grisea 70-15
MAASFANKRLSKELIKIKESLPPGILLISADNFEEWLLDIKVLDNNPLYANETYRLKFRFSSSYPIEPPEVVFAKLPDRPIPIHPHIYSNGIICLDLLGQQGWSPVQNVESVCMSLQSMLTGNTKNERPPGDEEFVRSNRARPRDIDFYYHDNTV

SEQ ID NO: 1785 - protein, 449 aa, Prochlorococcus marinus str. MIT 9303
MAFAGADVSAMRWLYLRLRLEPPQDHQHSDLGHSLALYFLAFGALLLVAVLLDDLAARVRVPGILMVLILGLLVDNHLNVSADAADALPPLLSLVHADQITQAALVLVLFFGGLTTNWAEMRSVIPSALRLATFGALFTALLITLAMLGLGVAEGSVGWVVLFPQALFVGAMLSSTDASATFALLRPLAGRLPKPVLDLIETESGFNDPVAVVLAGVAMALAGGEGVAPAALVTVVLRQFLLGILLGFLGGSLTTQVLGSRRSLNTNSMLPVVSLALLMVLAGGTTLMGGSALLAAYVAGLVLGNGSSTDQLVLAEAHASFAKMAELLLFLCMGLVVSPEDVVRAAGEAFLLFLLMQVVRWLIVHSLLLRSSFSVGQRTFVCCAGLRGAVPIALAIQVWASSSVSWGKAMPPLALAVVLFGLLFQGFALVPIANRLGLASPVEAPLSAP

SEQ ID NO: 1786 - protein, 310 aa, Ustilago maydis 521
MAFTITIEKRSAPGKPASKGFPLTVSLSSQKATLAELKKQIASSSRKLTVERQRITTQDRKPLLDDDKSLVDLGISAGQTLYVKDLGPQIAWRTVFLTEYAGPILIHPLFYYFGPQIWKRDFVPSKMQTVAVSLAVAHYVKRELETLFVHRFSNGTMPLFNIFKNSTHYWFLSGFLLAPFVYSPWFSAASVAGTIQDNTTFIYSTAAVMVLAELANGYTHIILKNLRPAGTKVRKIPRGFGFELVSCPNYFFEFLAWAAFTVLTLNPASALFAAVSTAQMWVWAVKKHKNYKKEFGKEYPKRKAMFPFIA

SEQ ID NO: 1787 - protein, 254 aa, Triticum aestivum
  misc_feature (189)..(189): Xaa can be any naturally occurring amino acid
  misc_feature (201)..(201): Xaa can be any naturally occurring amino acid
  misc_feature (226)..(226): Xaa can be any naturally occurring amino acid
MGSYSTSEVLNAAAVGVHHPALRLHELDLKGSMSVEELPTTSGLENGHQAPFVIGVAGGASSGKSTVCKMIIDQLCDQRVVVVTQESFYYGLSDEEMVHVHDYNFDHPDAFDTDLLLSCMEKLKHGKAVDIPSYDFKTHKSVSCARKVNPSDVIILEGILLFHDSRVRDLMNMKIFVDTDADVRLTRRXRRDYIEKGRDIXPVLDQYSKVVKDAFEDFILPTKKFXDFIIPQGAITCGIDLSFSISALIWQMFL

SEQ ID NO: 1788 - protein, 328 aa, Prochlorococcus marinus str. MIT 9303
MTMTSPMPIAADITALVGCTPLVRLNRLPQVSGCHAEVLAKLESFNPTASVKDRIAGAMIHAAEEAGTIAPGRTVLVEPTSGNTGIALAMVAAARGYRLILTMPDTMSTERRAMLRAYGAELQLTPGSDGMTGSIELAKELVATIPEAYLLQQFDNPANPQVHERTTAEEIWNDCEGRLDGLITGVGTGGTLTGCARLLKQRNPSLRVFAVEPALSPVLAGGSPAPHRIQGIGAGFIPSVLDLSLIDEILPVSDDDAMEMGRRLAREEGLLSGVSSGAAVAAALQVGSRAEMVGKRLVVVLASFGERYLSTPMFSAASAVPAQRDGYL

SEQ ID NO: 1789 - protein, 342 aa, Kluyveromyces marxianus
MRGSHHHHHHGIQMVSIAINGFGRIGRLVLRIALERKNIDVVAINDPFISVDYAAYMFKYDSTHGKYKGEVSHDGSNLIINGKKVAVFQEKDPATLPWGKLGVDIAVDSTGVFKELDSAQKHIDAGAKKVVITAPSKTAPMFVVGVNEDKYNGEKIVSNASCTTNCLAPIAKIINDEFGIEEGLMTTVHSITATQKTVDGPSHKDWRGGRTASGNIIPSSTGAAKAVGKVLPELQGKLTGMAFRVPTTDVSVVDLTVKLVKAATYDEIKAAVKKVSEGKLKDVVGYTEDAVVSSDFLGDTHSTIFDAAAGIQLSPKFVKLVAWYDNEYGYSTRVVDLVEHVA

SEQ ID NO: 1790 - protein, 220 aa, Buchnera aphidicola (Cinara cedri)
MKKFLIIPSILSADFCYLGNELHKLLRAGCQLIHFDLMDNHYVPNFTIGPMILKSVKNNNIPVFFDVPLMASSGDSLIPLFADLNVKFISIHPETTNPFPRTIPLIKKIGCNVGLALNPSTSLNCLDYIINELDLILVMAVNPGFGGQVFLKNSFKKIKPIRYLINKKKSNILLSVDGGVNQSNILKIIDSGADYLVIGSAIFNFKNYLKTIKNFQNIFF

SEQ ID NO: 1791 - protein, 369 aa, Photorhabdus luminescens subsp. laumondii TTO1
MKSRAAVAFGPGRPLEVVEIDVAPPQAGEVLVKISHTGVCHTDAFTLSGDDPEGVFPVILGHEGAGVVVEVGEGVTSVKPGDHVIPLYTAECGECLFCKSGKTNLCVAVRTTQGKGVMPDGTTRFSYKGQPIYHYMGCSTFSEYTVVAEVSLAKINPEANHEEVCLLGCGVTTGIGAVHNTAKVQSGDSVAVFGLGGIGLAVIQGARQAKAGKIIAIDTNPAKFELARQFGATDCLNPNDYDKPIQQVIIEMTEWGVDHTFECIGNVNVMRAALESAHRGWGQSVIIGVAGAGQEISTRPFQLVTGRSWRGTAFGGVKGRSQLPKMVEEAMKGEIELKPFVTHTLPLERINEAFDLMHEGKSIRTVIHY

SEQ ID NO: 1792 - protein, 579 aa, Desulfitobacterium hafniense Y51
MSKILSNRYEIIEKIGSGGMAIVYKAKDLLLNRIVAIKILHEQFTADEEFVRRFRREAQSAASLSHANIVSIYDVGKDGETEYIVMEHIEGQNLKDIIRNYAPLSTEQTLELGIQIAEAIRHAHEHHIIHRDIKPHNILVTEDGRIKVTDFGIARAVSAATMTHTGDIVGSVHYLSPEQARGIQTNEQSDLYSLGIILYELLTGKVPYDGETPISIALKHLQELAVPPSKLNARVSPALENLVMRSIAKSPDQRYATAKDLLQDLRKVQAGLPVDKTVDEDQDLESTRVHSSLRAGVNSALASEEKEAGRKKAKVPLFRKRWPWVALLALVLIMGGGWVALSQWFNVGTTTVPPLVGKTIQEAGYFAEQKGLSLDPNTQEEYNNDMEKGKITRTDPEEGAVVKKERGIKVWVSLGPEQARIPNLKTGDITQEAAINFLESQGFKRDNIVAQEDQNSSLPKGIVVEQDPAPGSDWPKNGKITLTVSAGKVDEPKPMPNVISRSPADAKAILEQQYELKVIVDSENSTEYPQDVVMATDPKPGDMVKKGDTVRIIISRGPGPIAFNPVILGHVAKLDKIAQ

SEQ ID NO: 1793 - protein, 339 aa, Erwinia carotovora subsp. atroseptica SCRI1043
MNASDASMTVIGAGSYGTALAITLARNGHRVVLWGHNPTHIQALQAARCNQAFLPDVPFPDSLQLETNLAHALAASRNVLVVVPSHVFGDVLRQLKPHLRADARIVWATKGLEAETGRLLQDVAREALGETIPLAVVSGPTFAKELAAGMPTAIALASPDSEFADDLQQLLHCGKSFRVYSNPDFIGVQLGGAVKNVIAIGAGMSDGIGFGANARTALITRGLAEMTRLGAALGADPTTFMGMAGLGDLVLTCTDNQSRNRRFGMMLGQGMDVQSAQDSIGQVVEGYRNTKEVLALAQRYGVEMPITEQLWQVLYCGKDAREAALSLLGRTRKDETAKL

SEQ ID NO: 1794 - protein, 273 aa, Erwinia carotovora subsp. atroseptica SCRI1043
MSTEELALVWTNIKAEARSLADCEPMLASFFHATLLKHENLGSALSYMLANKLANSIMPAIAIREVVEEAYSADPHMIVSAARDIQAVCLRDPAVDKYSTPLLYLKGFHALQAYRIGHWLWSQDRKALAVYFQNQISVSFGVDIHPAARIGCGIMLDHATGIVIGETAVVENDVSILQSVTLGGTGKTSGDRHPKIREGVMIGAGAKILGNIEVGCGAKIGAGSVVLQSVPPHTTAAGVPARIVGRPESDKPAMDMDQYFNGINRGFEYGDGI

SEQ ID NO: 1795 - protein, 514 aa, Legionella pneumophila str. Lens
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWQRVEPVYNLLTQGKSERQFPDAETAIHFYYKNKISDEFVPPTLIGKEHSIQDGDAVLFFNFRADRARQLTSTFLDPSFKGFERKTLPKLSYFVSMTQYDKNLFTTTAFPPVPLNNTLGEVLSSHGLSQLRIAETEKYAHVTFFFNGGCESVFTNEERIMVPSPQVATYDLQPEMSAHELTKTLIAAINSQDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHA

SEQ ID NO: 1796 - protein, 300 aa, Photorhabdus luminescens subsp. laumondii TTO1
MNVSTARAMNYEETLLELQSALQQHLELVLPSGAPDDKVCAAMRESTLVSGKRIRPLLLLLIVLDLGENPWKTDFLQLASAIEIVHAASLILDDLPCMDNAEYRRGRPAIHRQYGESVAILAAVALLSRAFGLIVETNLSEYDKSAAVAILSHTVGLNGLVQGQFRDLNNTLCAGNYHAIATTNDLKTGLLFDTTFQLAAIAVNAPDIIRQALRHVSQHLGQAFQLLDDLSDDLNNTGKDMYQDKEKLTMVTLLGKSKVHKQLRRHIRYIDKYLAIVYRRNLASRYFIRHWFDKNIAMFN

SEQ ID NO: 1797 - protein, 373 aa, Oceanobacter sp. RED65
MKYFKLPDLGEGLHEAEIVEWHIKPGDQVAVDQLMVSVETAKAIVEVPSPQAGVVAAFFAEEGDTVHVGEALVEYEGEEDSGTVVGDLSKAPQGNSEQGFIVGSAYDPANSGANASVKATPSVRALAKRLGVDLSHLKPSGGDGRFTIEDVEKAAALNDEKGRSEVLKGVRKSMAKAMADSHANVVPVTLHDDVDIHQWKEGQDVTMRLVHAIAYACEVQPELNVWFDGEQMTRRMLNQVDLGIAVDTEQGLFVPVLRDIRNRNMFDLRDGLNALRQAVKERKIPPQEMQGASITLSNFGTLAGKYANPVVVPPMVAIVGAGGIRREAVVWEGEVCAHAIIPLSLTFDHRAATGGEAARFLKAMMQDLAKPEI

SEQ ID NO: 1798 - protein, 292 aa, Vibrio chagasii
RSFVFRAAQERNDIEVVGINDLIDVEYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNQATYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVNTSVFDAKAGVALTDKF

SEQ ID NO: 1799 - protein, 242 aa, Vibrio crassostreae
EGGNLIVNGKTVRVTAERNPEDLKWDAIDVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVQTSVFDAKAGVALT

SEQ ID NO: 1800 - protein, 464 aa, Oryza sativa Japonica Group
VRLASPYRIHQIFRFTTPRRLALAHRGDTYKARDEGQCHWRDKAGSATRREGGESEGGERRRRRLMASPAVVAFAVAVAVAALAAFCGTDPLRTGSMVDFPGFVPHVVELPDASEMPPHADTRERLRGAEIRFRGEVQGPESVAFDPLGRGPYTGVADGRVVRWDGARWVYFAHSSPNWTAELCGHKASPLDYLKDEHICGRALGLRFDRRTGDLYIADAYFGLLKVGPDGGLATPLATEAEGVRFNFTNDLDLDDDGNVYFTDSSIHYQRRHFMQLVFSGDPSGRLLKYDPNTKKATVLHRNIQFPNGVSMSKDGLFFVFCEGSRGRLSRYWLKGEKAGTVDLFAILPGFPDNVRTNDKGEFWVAIHCRRSIYARMVSRNVRLRKFLLSLPIPAKYHYLMQIGGKLHALIIKYNPEGEVLDILEDTTGQVVRAVSEVEEKDGKLWIGSVLMPFIAVFDYANAS

SEQ ID NO: 1801 - protein, 291 aa, Vibrio cyclitrophicus
GRFVFRAAQERADIEVVGINDLIDVEYMAYMLKYDSTHGRFNGTVEVEGGNLIVNGKTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVQTSVFDAKAGVALTDK

SEQ ID NO: 1802 - protein, 376 aa, Oryza sativa Japonica Group
MEPDTDKLQSLQINPNKETNLVAVFKNDYVDDEDDEDMDPQVTLGFIEEPEGPEDWHLLLPQHFPNKAGGVPAWLDPVNLPSGKSRCCDFCGEPLRFVLQVVFHLYDKLQVYAPIQCKETAYHRTLFVFMCPSMACLLLDQHEQGKDRAGEKVCSRCRKSSYCSKKHQELHWRAKHKNECHQISGSHNASAIMPDAGKVFAGNIWPEYMVVDETEKVSCFASCENRSELLMEQGQSEEDDMTASLMDQFEVDDDNRCWASFLERISREQDQVLRYCRESTAKPLWVVYSGSLTNAAKPSCIYCNGPLCYEFQIMPQLLHYFHVENEPDSLDWATIIVYTCKGSCDQNVSYMEEFVWVQLSPATTRTNQSTCPPAGL

SEQ ID NO: 1803 - protein, 476 aa, Arabidopsis thaliana; identical to SEQ ID NO: 1176

SEQ ID NO: 1804 - protein, 142 aa, Neorickettsia sennetsu str. Miyayama
MAYSDSVLNHYNNPRNVGTIDKNKKNVGTGLVGAPACGDVMRLQIEVDNNGCIVDAKFKTFGCGSAIASSSLATEYLIGKSIEEAEKIKNTEIASTLCLPPIKMHCSMLAEDAIKAAIKDFREKQVTSSTEEAGNENTENKS

SEQ ID NO: 1805 - protein, 357 aa, Nicotiana tabacum
MARKSFPILKQLIQQSTNRFFTTNASPRAVTLIPGDGVGPLVTDSVEQVMQAMKAPVYFERYEVRGDMKCIPEEVIDSIKKNKVCLKGGLKTPVGGGVSSLNVLMRKELDLSASIVHCFTFPGLPTRHEDVDIVVIRENTEGEYAGLEHEVVPGVVESLKVITKYCSERIAKFAFEYADVNKRKKVTAVHKANIMKLADGLFLKSCREVASKYPEIQYEEIIVDNCCMQLVSRPEQFDVMVTPNLYGNLIANTAAGLAGGTGVLPGGNVGLIKPVFEQGASPGNVGHEKILKLKKANPVALLLSSAMMLRHLEFPSFADRLETAVKRVIAEGKVRTKDLGGDSTTQEVVDAIIAALD

SEQ ID NO: 1806 - protein, 937 aa, Candida albicans SC5314
MKVVSNFIFTILLTLNLSAALEVVTSRIDRGGIQGFHGDVKVHSGATWAILGTTLCSFFGGLEVEKGASLFIKSDNGPVLALNVALSTLVRPVINNGVISLNSKSSTSFSNFDIGGSSFTNNGEIYLASSGLVKSTAYLYAREWTNNGLIVAYQNQKAAGNIAFGTAYQTITNNGQICLRHQDFVPATKIKGTGCVTADEDTWIKLGNTILSVEPTHNFYLKDSKSSLIVHAVSSNQTFTVHGFGNGNKLGLTLPLTGNRDHFRFEYYPDTGILQLRAAALPQYFKIGKGYDSKLFRIVNSRGLKNAVTYDGPVPNNEIPAVCLIPCTNGPSAPESESDLNTPTTSSIETSSYSSAATESSVVSESSSAVDSLTSSSLSSKSESSDVVSSTTNIESSSTAIETTMNSESSTDAGSSSISQSESSSTAITSSSETSSSESMSASSTTASNTSIETDSGIVSQSESSSNALSSTEQSITSSPGQSTIYVNSTVTSTITSCDENKCTEDVVTIFTTVPCSTDCVPTTGDIPMSTSYTQRTVTSTITNCDEVSCSQDVVTYTTNVPHTTVDATTTTTTSTGGDNSTGGNESGSNHGPGNGSTEGSGNGSGAGSNEGSQSGPNNGSGSGSEGGSNNGSGSDSGSNNGSGSGSNNGSGSGSTEGSEGGSGSNEGSQSGSGSQPGPNEGSEGGSGSNEGSNHGSNEGSGSGSGSGSNNGSGSGSQSGSGSGSQSGSESGSNSGSNEGSNPGAGNGSNEGSGQGSGNGSEAGSGQGSGPNNGSGSGHNDGSGSGSNQGSNPGAGSGSGSESGSNAGSHSGSNEGAKTDSIEGFHTESKPGFNTGAHTDATVTGNSVANPVTTSTESDTTISVTVSITSYMTGFDGKPKPFTTVDVIPVPHSMPSNTTDSSSSVPTIDTNENGSSIVTGGKSILFGLIVSMVVLFM

SEQ ID NO: 1807 - protein, 694 aa, Arabidopsis thaliana
MESLIEEEEESRFFDAHEEIASCSSPCKIESPSSISGEFRYDVWIKSPGNTEERREKFLKWMGLSSTVNESKSGNVYRLSSSVNESAVLMSLKSDDDEFSSSRCDSFSPSESVDRVVNESLCKEEGEVDSGMVLRNLGFVDDGDISSSLCSLSSSPVSDKIVKEHGEPKLLPDPMVAEEEREVSGIMKRVKEKWLSRLYKVRNKRSAGGDDNGGEVAVCGSRIERVKVKEYKKEAKELSALFKGQEIQAHEGAILAMKFSPDGRYLASAGEDGVLRVWSVVEDERCEEHDVPKIDPSCIYFEVSKLSELRPVAVEKDGITGSLMSPRKTTESACVIIPPKIFRVLDKPLHEFLGHSGDILDISWSKNNRLLSASVDNSVRLWQIGCEDCLGIFSHNNYVTSVQFNPVDDDHFISGSIDGKVRIWSASQCQVVDWADARGIVTAVCYQPDGQAVIIGTLTSDCRFYNVSGHCLQLDGHICLHNKKKSSNKRIIGFQFDSTDPSRVMVASADSQVRIISGRNVVHKYKGSRNAGNQISASFTADGKHIVSACDDSSVYVWNCVGHDPEQSSPGFFSHTKRLKIRSFEKFSADVSVAIPWCGFTPVLSGGSELSPSLFSLGREYVLDSPKGSATWPEEKLASSFSPVKAIRRSHYKFLRSSCRRTSESSHLWGLVIVTGGWDGRIKLFHNYGLPVPV

SEQ ID NO: 1808 - protein, 120 aa, Oryza sativa Japonica Group
MAAAAAMAMKDPSLWHKVAAISGVAALGLGTYGAHMFRPKNPAYKEVWHTASLYHLVHTAALLGAPITKRPDVFGGLLTAGIVLFSGTCYTVAYLEDRKYSSTAPLGGFAFIAAWASLLF

SEQ ID NO: 1809 - protein, 633 aa, Bacillus licheniformis ATCC 14580
MDLLSIKDPAFLKNLSNEELESLSAEIRRFLIETLSESGGHIGPNLGVVELTIALHKEFDSPKDKFLWDVGHQSYVHKLLTGRGKDFATLRQHKGLCGFPKRNESEHDVWETGHSSTSLSGAMGMAAARDLKGTNEYIIPIIGDGALTGGMALEALNHIGHEQKDMIVILNDNEMSIAPNVGAIHSMLGRLRTAGKYQWVKDELEYLFKRIPAVGGKLAATAERIKDSLKYLLVSGMFFEELGFTYLGPVDGHSYDELFENLQYAKKTKGPVLLHVITKKGKGYKPAETDKTGTWHGTGPYKIDTGDFVKPKAAAPSWSSLVSETVRKLAREDERIVAITPAMPVGSKLEGFASEFPERMFDVGIAEQHAATMAAGLATQNMKPFLAIYSTFLQRAYDQVVHDICRQNLNVFIGIDRAGLVGADGETHQGVFDIAFLRHIPNLVLMMPKDENEGQHMVNTAVKYDDGPIAMRFPRGNGLGVKMDKELKTIPIGTWEVLRPGTDAVILTFGTTIPMALAAAEELQKEGRSVRVVNARFIKPLDENMLKEILNEGLPILTIEEAVLQGGFGSSILEFAHEHQSYSPIIDRMGIPDQFIEHGSVAKLLEEIGMTKEDVIRRIRLLTPVKTHKGIGS

SEQ ID NO: 1810 - protein, 410 aa, Yarrowia lipolytica CLIB122
MASDKKRKASSKRLTKIKVAKVQDDGKVFLSDCGHLSIPKDAKFSSVSDNGETSIKGKSSRMRYTSVPVDHEKYCVAVISSKGLADLVPAESIELKAMSKQLAKRVAENTEQKSYREQRVNLGNEFGTLKAKKTLASLARNNIDSNELVDFEDDVVEAVATATANLPTQEQVSMAMDDARPIPKHNLETLDVNEIYPVEGYLTDEEAGYIRSEAILDEQDIGKRVDMLPYRTSQMVRDSLYKITDKTDETMYKTSLLYYLSLLIGFYRDRHVKKREDIKTRLNNPPEYLIDQMLYRYTTPLSGGHKSQRYHTYMVNSRNEAMLLCTIIILVLRLNNNVVDIPILSQEVGIKPSKLADVCRQVGCAIKNASLTHMDDIGRPRTEASHWKIASLKAPLKLPELAQRRRRAKK

SEQ ID NO: 1811 - protein, 127 aa, Thiobacillus denitrificans ATCC 25259
MAVAKADILDAIAGMTVLELSELIKEMEDKFGVSAAAAAVAVAAPAAGAGAAAAAEEQTEFTVMLNSAGEKKVEVIKVVRAATGLGLKEAKDLVDGAPKAVKEGVSKADADALKKQLEEAGASVEVK

SEQ ID NO: 1812 - protein, 484 aa, Bacillus cereus G9241
MGIVGQNGAGKSTLMKILMGEIIPDKGDIKWQPNIQIGHLDQYAEIDEGYTISQYLKRAFYDLYEMEKRMNKLYEESAMTGDENQLLKAAEIQGLLEARDFYSVDSITNKVAAGLGIDVIGMNRVIGELSGGQRAKVILAKLLLEEPNILLLDEPTNFLDKEHVEWLANYLMNFEGAFIVVSHDFDFLEKVTSCICDVEFGTVKKYYGKYSDFVRQKEHLRKDYIRQYYAQQKKIEKTEEYIRRNIAGVNSKIAQGRRKQLQRMERIAPPSFTYKPSIHFQELPISVQTVLEVNNLEVGYDFALLPKLNFSVMGGQKLVITGFNGVGKSTLLKTIVGNIASISGEFHFLEQIKIGYYEQDLHWSNDSLTPLQIISEQFPKLNRKEIRHHLAACGVKDTHVSQEIRTLSGGEQSKVKLCGLLLSPCNFLILDEPTNHLDAEAKEALQKALIKFKGSIILVSHEASFYLDWADSIFNIETGLVKGV

SEQ ID NO: 1813 - protein, 518 aa, Aspergillus oryzae
MLAQIAPLFGALCITFLVLQYLQRLYQQRKRAQSLGCQPAAQGPSGIFGIRSFVRLLNEVRHKRWVEYIAGQYGRYGNTYTQKALGKWMVSTIEPENIKALLATQFNDFGLGTRHREFYPLLGDGIFTLDGPGWSHARGLLRPQFTRDQVADLELMDGHISRMIDLIPQDGSSFDIQRLFFLLTIDSATHFLFGESVGALESSNSASLLGRSSVGSAQGFAEAFGTAQDYLTTRSRAMHFYWMVNPKEFREANQRVHEVVDHYVQLAIQSKNNPDKKSDRYIFAEALAADNDDPKVLRDNMLNILVAGRDTTASLLSSAFFYLSRNQDVWKKLRQTIIDEFGDSQNPKGEITQAKLKDIPYLRYVLNEVLRLLPPVPLNFRVAAKDTSLPVGGGPDGRSPVFIPKGQVVAYSVYAMHRRTDLYGPDSHSFRPERWEENGRRGWDYLPFNGGPRICLGQQYALTEASYTLVKLVQRFDTLECADPELKQPAILSTLTMSHDRGVKVRLSSSVPKCWFNQ

SEQ ID NO: 1814 - protein, 272 aa, Neorickettsia sennetsu str. Miyayama
MTLATLNEQFNFGIKLGIELEFYSSEKIGFFKELVSQHFSLIEGVSKERGDGQYEISTLPTGNISLLLNEINSFKSLVRGVADFSAKLRLDQPGSALHVHVSLHDKGSQKNITRLEPKLRSFIVGGFCHLMRSSMLCFAPSIESYRRFQYYDKFTPRFINWGFEENKSNAVRVTYDTIEHRVAGADAVPSKVLGQIMRAIKYGICNEVVPKAPNFGESQYAEAFQDRLPLSYSEAIIHGGEHGCFEGMMCMNSVGIQNHAGEVGVGKCLCCH

SEQ ID NO: 1815 - protein, 512 aa, Zea mays
MEATAPANLFYAAFLFLSVLYLAVTRRRTSRLPPGPTGLPLVGSLPFLDRNLHACFAGLAAKYGPVFAIRLGSKVEIVVTSPELAHEVLRDKDPVFSNRVIPDAGRAVAFDGVENIVGVPVGPKWRLLRRLCAQEMLSPAGLDSLYGLRRREFRSTLRYLYSQSQAGEPVDLGALMFVNMMNVVTSTLWGGTIGSESERAAIGKEFRALVAKLTELLGTPNLSDFFPVLAPFDLQGVRKKMERIRVRFDQIFDKIIQQRVNAQQDGSKMATDFLECMLKMEREGGDGKATFTMTDVKSLLLDMVVAGTETMSNTVEWAIAEMLQKPEVLRKVQEELDKVVSRDAIVEESQLPELRYLRMVIKETLRLHPALPLMVPHSPSEESTIGGFHVPAGCRVFVNVWAIHRNPLVWTEPLEFNPERFSGDDDGRRWDFTGRQFDYLPFGSGRRICAGIAMADKMTTYSLAMLLQAFDWKLPQGTELDLSEKFGVVMKKATPLMVIPKSRFPKPDLYCS

SEQ ID NO: 1816 - protein, 168 aa, Physcomitrella patens subsp. patens
MAFGVSKGMVAPLLVINFCLYFISADIAGSLLNKAFDRGSFVLGGGNTATSIFLAFVLIASMVGLASTLAGAHHLSVWRTESLAAAAAAATIAWTLTLLAMGVACKEIHIRYGRNKRLKTLEAFMIILSLLELLYLLALYAGAVTREGYNNAPGVKNPNYGTPAAAAV

SEQ ID NO: 1817 - protein, 552 aa, Ashbya gossypii ATCC 10895
MNKQNRRGLQLQLFPYSRSIAQRDTMRSIADQKTNWVVQKFGGTSIGKFPTNIVNDIVKVFSHDYGKNVAVVCSARSSYTKSEGTTSRLLMACDAAASYDETFQDIVRVIREDHVENASHHIKDAEIRVRLVEQTNDELDQVERYLQASQILGEVSNRTMDLVMSVGEKLSCLFLTALCEDCGVTAEYVDFSSIVPTDFRCAEGSLDNSFYALLVVAFKERLAQIVQANKEGKRIVPVITGFFGLLPMGLLNGVGRGYTDLCAALVAVALNADELQVWKEVDGIFTADPRKVPQARLLETVTPEEAAELTYYGSEVIHPFTMEQVIRAKIPIRIKNVQNPTGDGTVIYADNIAKKGESTPPHPPISVSSSFFEQRKRGATAITTKNDIVVLNIHSNKKTLSHGFLAQIFTILDNYKLIVDLISTSEVHVSMALPVPDSDSQRSLRNAVEELKKLGTVDLIKKMAIVSLVGKQMKHFIGIAGAMFTTLSEQNINIEMISQGANEINISCVIDEKNSVRALQSIHAKLLEPLAPTSSGAVLNGRLEQLKSLDLS

SEQ ID NO: 1818 - protein, 698 aa, Arabidopsis thaliana
MESLIEEEEESRFFDAHEEIASCSSPCKIESPSSISGEFRYDVWIKSPGNTEERREKFLKWMGLSSTVNESKSGNVYRLSSSVNESAVLMSLKSDDDEFSSSRCDSFSPSESVDRVVNESLCKEEGEVDSGMVLRNLGFVDDGDISSSLCSLSSSPVSDKIVKEHGEPKLLPDPMVAEEEREVSGIMKRVKEKWLSRLYKVRNKRSAGGDDNGGEVAVCGSRIERVKVKEYKKEAKELSALFKGQEIQAHEGAILAMKFSPDGRYLASAGEDGVLRVWSVVEDERCEEHDVPKIDPSCIYFEVSKLSELRPVAVEKDGITGSLMSPRKTTESACVIIPPKIFRVLDKPLHEFLGHSGDILDISWSKNNRLLSASVDNSVRLWQIGCEDCLGIFSHNNYVTSVQFNPVDDDHFISGSIDGKVRIWSASQCQVVDWADARGIVTAVCYQPDGQAVIIGTLTSDCRFYNVSGHCLQLDGHICLHNKKKSSNKRIIGFQFLLQFDSTDPSRVMVASADSQVRIISGRNVVHKYKGSRNAGNQISASFTADGKHIVSACDDSSVYVWNCVGHDPEQSSPGFFSHTKRLKIRSFEKFSADVSVAIPWCGFTPVLSGGSELSPSLFSLGREYVLDSPKGSATWPEEKLASSFSPVKAIRRSHYKFLRSSCRRTSESSHLWGLVIVTGGWDGRIKLFHNYGLPVPV

SEQ ID NO: 1819 - protein, 233 aa, Ashbya gossypii ATCC 10895
MTSVEVRRVLEQLLRDPCNQQCADCKNSAHPRWASWSLGVFVCIRCAGFHRSLGTHVSKVKSVDLDTWKEEHLQQVVRFGNNQQANKVFEGRLGGGSYVPDQSKMGQFIKTKYEVRKWYLEEGACEPALPEAAPAAASPLPVSVPMSPAGVGREASASPALAVSPAPASPPVYSANARPDLKKSILSLYAKPRQQSPGVASSASSLNSAAASAGVSYSAASLEDNELFKNVWT

SEQ ID NO: 1820 - protein, 142 aa, Bradyrhizobium japonicum USDA 110
MTVRSILNTKGHQIMSVEPDAKLAAAIKLLGEKKIGAVLVMNQSRLEGILSERDIVRVIGERGAGALDEPVSQVMTRKVVTCKETDTVAELMETMTTGKFRHLPVIDNGKVVGLISIGDIVKRRVQEYESEQEALRDYIKTA

SEQ ID NO: 1821 - protein, 387 aa, Clostridium perfringens str. 13
MAKRDYYEVLGLQKGASDDEIKRAFRKMAMKYHPDRNPGDKEAEENFKEVNEAYDVLKDPDKKAKYDQFGHAAFDGSGGFGGGGFGGFDAGGFDFSEMGGFGDIFESFFGGGFGGGSSRRRNAPQRGADLEYRLNITFEEAVFGCEKEISITRTENCETCHGTGAKAGTSPKTCPKCNGSGQIRVQRQTPLGSFVSTTTCDQCGGTGKVIEDPCPDCKGKGTVRKNRKITVKIPAGVDTGNIIPLRGQGEQGANNGPAGDLYIRVNVAPSKIFRREGSDIYYDYKISMAKAALGAEITVPTVDGNVKYKVPAGTQPGTKFRLKGKGVPHVNGGGRGNQYVHMVVEVPKHLNKEQEEALKAFMKASGESVDDIDEKDEGFFSKFKKKK

SEQ ID NO: 1822 - protein, 131 aa, Glycine max
  misc_feature (45)..(45): Xaa can be any naturally occurring amino acid
  misc_feature (72)..(72): Xaa can be any naturally occurring amino acid
  misc_feature (92)..(92): Xaa can be any naturally occurring amino acid
MGSAASPPRALDAATQEDLKRVSAHRAVDMVESGMTLGLGTGSTXAHALDRLGALLRSGALRAVAGVPHSLXTEAHAPRVGNPMFGFAEGPXIHLSSKGPKSQPELNLLKGPGGSFPPKKIQGPGPPFFFF

SEQ ID NO: 1823 - protein, 525 aa, Xylella fastidiosa Ann-1
MAYLIHMWPLRFNNRFIDVLPCDPEVSLRSRQVLEAWSRVEPTPVPMPCLLAYSSEVAAILNFDAEELVTPRFVEVFSGNALYPGMQPYAVNYGGHQFGQWVGQLGDGRVITLGELLGADGVYYELQLKGAGPTPYSRGADGRAVLRSSIREFLCSEAMHHLGIPTTRALSLIATGDTVIRDMLYDGHPAPEPSAIVCRVAPSFIRFGTFELPASRGDIDLLRRLVEFTIMRDYPHLHGAGETLYADWFAEICTRTAELVAHWMRVGFVHGVMNTDNMSILGLTIDYGPYGWIDNNDLDWTPNVTDVQSRRYRFGAQPQVAYWNLGCLARALAPLFSDAASLQAGLERFRATYLAAERRDAAAKLGFAACFDEDLELFDALRTCMHQAEMDMTLTFLGLADWEPNMPDSLSLWAEAFYDPVKRDAQAPMLRDWLQRYAARLSVDPLPVAERHERMRLANPRYVLRNYLTQQAIECAEQGDLTELHALLEVMRRPYDFQLGREVYAMRRPEWARSRIGCSMLSCSS

SEQ ID NO: 1824 - protein, 257 aa, Gibberella zeae PH-1
MADRGTSRGGGFASRGGDRGRGRGRGRGRGRGKNEEKEWQPVTKLGRLVKAGKINSMEEIYLHSLPIKEYQIVDNFLPKLKDEVMKIKPVQKQTRAGQRTRFKAIVIIGDSEGHVGLGIKTSKEVATAIRAAIIIAKLSVIPVRRGYWGTNLGAVHSLPTKESGKCGSVTVRLIPAPRGTGLVASPAVKRFLQLAGVEDAYTSSAGSTKTLENTLKATFVAVSNTYGFLTPNLWKETKLIRSPLDEFADTLREGKRY

SEQ ID NO: 1825 - protein, 183 aa, Zea mays
MALGALARLLRLAPTPRLARPFAAKVRASRPQEPELPSEDDNDFAGGELTAPTEGIGKPLAEVLKELGKRVPDSLVKTRVENNGFAIKYIPWHIVNKILNIHAPEWSGEVRSIVYSFDGKTVSVVYRVTLHGIDAEIYREATGTASVDDTSYGDPIQKAEAMAFRRACARLGLGLHLYHEDMS

SEQ ID NO: 1826 - protein, 378 aa, Triticum aestivum
HYRTSLYKKAGWYRSGIPGISSTHASGSISDDEAACIYAMQLAAAAVLPMTLKNAIELGMIEILVGAGGKMLSPSEVAAQLPSTANAEAPAIVDRMLRLLASHNVVSCEVEEGKDGRLARRYGTAPVCKWLSPDEDGVSLAPMVLLNDKVMLESWYHLKDTVLNGGLPFEKAYGMTAFDYQGTDPRFNRVFNEAMKTHSMIITKKLLEFYKGFDGVGTLVDVGGGVGATIHTILCRYPSIEGVNFDLPHVISEAPSFAGVHHIGGDMFKKVPSGDAILMKWILHDWNDEHCTTLLSNCYDALPAHGKVVIVEYILPVKPDETATAQRSFEADMIMLTHTPGGKERYLREYEELARSAGFASVKATYVYSNIWVIELNK

SEQ ID NO: 1827 - protein, 421 aa, Solibacter usitatus Ellin6076
MKLLITGVSHKTAPVEVRECLAFREETLPAALADLKACEGVSEAVILSTCNRVEISLTTEDAVDPREIVDNFLSRHKAVSSASIGPHLYRHEGRDAIHHLFRVAASLDSMVVGEPQILGQLKVAYAAAKDCGALCGWLDGLMSRSFSVAKRVRSETGIGQMAVSVSYAAVELARKIFGSLTNRTVMIVGAGKMSELAARHLRRSGASHVFVTNRTHERAVDMAKLFQGTPVEYARFTAMLPEVDILIASSGAPHYILHKDEMQRVISARRNKPMFLIDIAVPRNIEPAINDLDNVFLYDIDDLQEVVNSNLRERMKEADHAELLVTEEVDRMMARMKVAEVTPVIVSLQEQLEQIRSGEMEKVRRRFGPFTAQQEEALEALTRGIINKVAHGPISELRSQAGKPDGAPAIAAIRKAFHLQD

SEQ ID NO: 1828 - protein, 178 aa, Photorhabdus luminescens subsp. laumondii TTO1
MASRGINKVILIGNLGQDPEVRYMPNGGAVTNITLATSESWRDKQTGEMKEKTEWHRVVLFGKLAEVAGEYLRKGSQVYIEGSLQTRKWQDQNGQERYTTEVVVNMGGTMQMLGGRAGGGSFQDSQQSQGGGWGQPQQPQPQQQSQQFSGGGAPSRPAQSSAPQSNEPPMDFDDDIPF

SEQ ID NO: 1829 - protein, 289 aa, Vibrio cyclitrophicus
FVFRAAQERADIEVVGINDLIDVEYMAYMLKYDSTHGRFNGTVEVEGGNLIVNGKTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVQTSVFDAKAGVALTDK

SEQ ID NO: 1830 - protein, 231 aa, Vibrio cyclitrophicus
KTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVQTSVFDAKAGVA

SEQ ID NO: 1831 - protein, 463 aa, Pseudomonas putida KT2440
MDKQKQDLISQQDRGAVLHPFTQLKDFASGKAGDPTIIETAKGITITDATGREYIDGFAGLYCMNVGYGRTEVAEAISKQAHKLAYYHTYAAHTTEELARLSDRLVKMAPGKMSKVFYGMSGSDANETQAKLVWYYNNLRGKPNKKKIIARERGYHGCSVVSGSMTGMSFYHDHMDLPIAGILRTGAPHYYWGAEPGETELEFSARRARELEELILREGPDTIGAFIAEPVLGTGGITPPPEGYWAAVQPVLKKYDILLIADEVITGFGRTGAMFGCDKYGIEPDLITVAKGLTSAYAPLSASIVGEKVYKVMEEGADRVGAFSHGYTYSGHPIGVAAANAVLDIVEGENIPAHVDKVGQYFQKSMQETFSSLPIVGEVRGVGMMAAIEFVADPATKKRFDPALKVGARISKAARDRNLIARAMPHGEILGFAPPLVTTEQEVDRIISIAHEAVLSVLDELKV

SEQ ID NO: 1832 - protein, 233 aa, Vibrio cyclitrophicus
IVNGKTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVQTSVFDAKAG

SEQ ID NO: 1833 - protein, 207 aa, Solibacter usitatus Ellin6076
MSAHIIGVAGPSSSGKSELARQLAERLPGTSIVSLDSYYRGMEEIPLEERKKVNFDHPDSLDWELLHEHLVAIAAGRAFDEPVYSFADYERTTETRRIEPTEFLIVEGLFVLYWPELRKMLDTKVYVQTDSAVCFQRRLSRDVAERGRTPESVREQYERTVRPSAEWFVYPTEKYADLRVSGEEPFERSTAAVLKALHRAKAAAGGA

SEQ ID NO: 1834 - protein, 203 aa, Zea mays
  misc_feature (138)..(138): Xaa can be any naturally occurring amino acid
  misc_feature (153)..(153): Xaa can be any naturally occurring amino acid
  misc_feature (161)..(161): Xaa can be any naturally occurring amino acid
  misc_feature (183)..(183): Xaa can be any naturally occurring amino acid
  misc_feature (194)..(194): Xaa can be any naturally occurring amino acid
TVLHKLKSFASGSTKTEDHMHLSPYLSFVSGALAGCAATLGSYPFDLLRTILASQGEPKVYPTMRSAFFDIIKSRGIRGLYNGLTPTLVEIVPYAGLQFGTYDMFKRWMMDWNRRMLSSNNPINVDTNLSSFQLFCLXGLGAGTSAKLVCHPXLDVVKKRXQIEGLQRHPRYGAKFGATCIQXQWLDGLKQILXWLKGWHGLY

SEQ ID NO: 1835 - protein, 236 aa, Vibrio gigantis
VNGKTVRVTAERNPEDLKWDAIDVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGETQTSVFDAKAGVALT

SEQ ID NO: 1836 - protein, 234 aa, Vibrio gigantis
GKTVRVTAERNPEDLKWDAIDVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGETQTSVFDAKAGVALT

SEQ ID NO: 1837 - protein, 744 aa, Oryza sativa
  misc_feature (648)..(648): Xaa can be any naturally occurring amino acid
MGSACEAGTDEPSRDDVKGTGNGILENGHSHKPEEEEWRNGMGEDLPNGHSTPPEPQQTDEQKEHQVQIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANXVNGSFSGGHNGNNGQRGPSTAPNVGRPNMETVNGIVDENGAGGGNGSGSGSGNDLYQNGVCYREAALNKFRQKRKVRNFGKKVACFQLHAYQSHES

SEQ ID NO: 1838 - protein, 666 aa, Candida albicans SC5314
MISNRKRPRVLSTDGHSSVSNDTATNSTNLSDTPPFSHHHHHHHSQQSQQQQQQQMPILSDTSTDSSNSSFPFYKPLLKSSKIESSMFTNPFLSIHDRNGIQLPEYGDDDDNEEDEEDEISDNVLDNDDDDNYAIEDDDEEVDEDEIVDIEDDDDDIEEIDGFDNDDDIIFIEQRQLPKRNSDSLLYDTQALEAYNKFRSNKNNNNKKKLPPARIKKQRTNSLPQLPQAKCIYNKLPNYILQGPKLGNIRTNVIPHQLNLPPCVDESGHYIVKPNTLFANRFIIIKLLGQGTFGKVVQCFDKVKNEHVAIKIIRNIQKYRDAAKIELRVLSTLKKFDPDNTNHCIHLRECFDYRGHICIVTDLLKISLYDFLENNKYIGFPGSQIQSIAKQLIRTVCFLHDLGIIHTDLKPENVLLKDDSYHKLKITSSTMTSAYLALKNDKRPVKFSKILSLTDIYVIDFGSSIFDSEYHSSVVSTRHYRAPEIIFNCGWSFAIDLWSVGCILVELIIGEPLFKTHHDQEHLHMIQKISGETIDRKMVLMCKKQGHKVGEYFDDNCRLIELEEPKFIQSVAQLDRIDKFISKRLGINLDLNLSLEENYDLNRDNQEEDDDKDEEDDFDENKILFYYYFVDLLQSLLKINPQERITAEEAMNHPWFDLGTIDEGIV

SEQ ID NO: 1839 - protein, 469 aa, Vitis vinifera
  misc_feature (92)..(92): Xaa can be any naturally occurring amino acid
  misc_feature (115)..(115): Xaa can be any naturally occurring amino acid
  misc_feature (245)..(245): Xaa can be any naturally occurring amino acid
MALARRSKNLYSCGVLRYSLSLTSFSRGFASAGSDENDVVVIGGGPGGYVAAIKAAQLGLKTTCIEKRGTLGGTCLNVGCIPSKALLFFFHXYHEAKHSFASHGVKFPSVEVDLXAMMGQKDKAVANLTRGIEGLFKKNKVNYVKGYGKFISPSEVSVDTIEGGNAVVKGKNIIIATGSDVKSLPGITIDEKRIVSSTGALALSEIPKKLVVVGAGYIGLEMGSVWARLGSEVTVVEFAPDIVPXMDGEIRKQFQRALEKQKMKFMLKTKVAGVDTSGDLSTLEADVVLVSAGRSPFTAGLGLDKIGVETDKIGRILVNEKFSTNVSGVYAIGDVIPGPMLAHKAEEDGVACVEMIAGKAAHVDYDMVPGVVYTHPEVASVGKTEEQVKALGVEYCVGKFPLLANSRAKAIDDAEGLVKILAEKETDKILGVHIFGPNAGELIHEAVLALHYGASSEDIARTCHAHPTT

SEQ ID NO: 1840 - protein, 569 aa, Ashbya gossypii ATCC 10895
MSNSTAGHLQQDGGHMSQLARGGIRWMPEMQPATKQLRAPQYNFVRYCYRHNPDIQAAPTQVRCVRQEQQRREEWQARVGELSSEGERQVVQEAVRLFDSSNDKLRKLMLEGMLLKSCFPQLSFISTQLQKLIKIDFISALPEEVALKILGYLDCQSLCSAAAVCRRWQELADDDTVWYHMCEQHIDRKCPKCGWGLPLLHMKRARYIKSDKASASKGEGEDAPQSRMRPWKVVYRERFKVESNWRKGIYRIQEFKGHMDGVLSLQLTNKLLLTGSYDSTVAIWDLATGKLIRRLSGHTDGVKALRFDDQKLITGSLDKTIRVWNYVTGACVSTYRGHQDSVLSVDSFRKLIVSGSADKTVKVWHVESRTCYTLRGHTGWVNCVKLHPKSFTCFSGSDDMTIRMWDIRTNTCVRVFHGHVGQVQKVIPLTLGSDLIEDPKDAVVPPDATAPAHDPSVQAANFDHSLPYPTHLLSCSLDNTIKLWNVKTGACIRTQFGHVEGVWDIAADNFRIVSGSHDRSCKVWDLQTGKCMHTFVGIHAPVACVGIGDSEFVSGDELGCVKLYNFDTT

SEQ ID NO: 1841 - protein, 495 aa, Rhizobium leguminosarum bv. viciae 3841
MNLNQHSPHPDHDSFELSAFSRGLYIGGAWRPAAGEARIEVIDPSTEAVITAVPDATLADAAAAVEAAARAAESWRETPPRKRSEILRRCFELMVERSETIARLISLENGKALRDARGEVAYAAEFFRWNAEEAVRISGEFGLAPAGGNRIVVDYQPIGICVLITPWNFPAAMATRKIAPALAAGCTVILKPASETPLTAYALAALYEEAGVPPGVVNVMTTSTPGPVIAAMLADPRVRKLSFTGSTGVGRTLLAEAAKNVISCSMELGGNAPFIVFDDADIDAAIEGLMVAKMRNAGEACTAANRIYVQSGIHDAFAEKFTRRMAALNVGPGADTDTECGPMITRKAVEKIERLVTDAISRGARALCGGRTLADRGFFYPPTVLVDVSPASDMGCEEIFGPVAPLYRFESEAEVIAAANDTEYGLAAYIYTRDIGRGMRVASKVEAGMIALNRGLVSDPAAPFGGVKQSGLGREGGQHHGIAEFMEAKYIATSF

SEQ ID NO: 1842 - protein, 300 aa, Prochlorococcus marinus subsp. pastoris str. CCMP1986
MTEVINNIPDFEKYLTDTKKVVEEALDFSLGPENPEILRESMRYSLLAGGKRIRPILCLASCSLAGGEPSLAVPTAVAIEMIHTMSLIHDDLPAMDNDGFRRGRPTNHKVYGDAIAILAGDALLTRAFEMVSLRSPGVDSNRLLNVVGELSLVAGAPGLVGGQVVDLECEGKEVDLETLEYIHLHKTGALLKASVRTGAMIAGANEELLNALTTYAEGIGLAFQIIDDILDLTSSSEKLGKTAGKDLLADKTTYPKLLGMEESKKKAFDLVDQAKKAIEPWGLNAKYLISLADFITNRDR

SEQ ID NO: 1843 - protein, 773 aa, Arabidopsis thaliana
MSGFSSGNVNSRVVDILSGVVPLLKLICLTVIGLLLAHPKTQLVPRATFRLLSKLVFALFLPCLIFTELGESITLDNIVQWWFIPVNVLLSAVVGSLIGYLVVLICRPPPEFNRFTIVMTAFGNTGNLLLAIVSSVCHTKTNPFGPNCNSRGVSYVSFAQWVAVILVYTVVYHMMEPPLEYYEVVEEEGVEIEEINVENHDASRPLLVEAEWPGIEDKETEHCKTPFIARVFNSISSFSQTSFPEVDLGGEYGGESSSPRSIQCLAEPRVMRRIRVVAEQTPVKHILQPPTIASLLAIIIGSVPQLKSVVFGYDAPLSFITDSLNIMGSAMVPSVMLVLGGMLSEGPNESTLGLRTTIGISVARLLVLPLVGIGIVMSADKLGLISSADPMFKFVLLLQYSTPSAILLGAIASLRGYAVREASALLFWQHIFALLSLTFYIVIFFKLTVETTVQEKRVNFLECESFNYSFREKINHFGFVEESRSDFMEMSEWKFCAFKSQSKSRTMGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 1844 - protein, 885 aa, Gibberella zeae PH-1
MSRLSSSRSSSTLSLNLSFSSSIITPDSDSEIIGSVGNHISPLNSSDSFILVTGGLGFIGSHTSLELLKAGYNVIIVDDLRLKLPTLHFHKLDYRSKAMRFLLESYSTLIPTFSENSGEFIKIQSKISGVIHFAAFKSVSESIEKPVQYYRNNVCGLIDFIELLGKHNIHKFVFSSLATVYRSKAVKGKHLREEEVVYHETLYLDEFNNETLAELSVSELTSPYRCSKYFCEAVLADIAYTDPSWHIIALRYFNPIGCDPSGPLGEDPKGIPTNLFPVIAQVLTAIRDFIHVTDLARGHVAALSSDIESPFRTFNLGTGNGTTVAEAVKSLEGASLKNIAVNLVPRRIGDVGFCVAANDRAKKELGWTAKETIQQFAKDLWNYINQPETALSFSWRGDLSYGLCYKCKIIARPTDSAYASMSTGEESSITPLSHPILTSTQSSKNEVEDYLRDIPDGLYPQRAIMTDRERKSLVVRRLEQLFTGRDYIADTLKTPFVRPGGSFIMVGDVGDGQVTDQSPTHELPTDRHEPIREARILPLEQRVHTRGNDSHLRNSVSPSHPCKDSINTGGNDEDSVPATRPCDLDPDRAQVPCENMDYIRYLDLLPAELLSRQQSSQGVDLDAEGWVSLNLLYNLAQLHLINVTPDFVRSAVSENSTILQLSTDGHKVLWQGGSKDTSSSSYSSDYDTPETPFVGNIDKSEQRRDRQKTSCFTNNEPQLGGLGNDVPAFDPQVCARVESFRFFSVSSTNNIQILHQPHAANGSIPASASRISGKTGSNSNGVQDLMPDSNHPSSYIELDPVWTDDQQDIEQPLLEPCGLGVLPHDHFRVVVDTKRPKHDILQSSEPEFGRSKEGIKGSTHPKVATQISGSISGGSETKLQMILRH

SEQ ID NO: 1845 - protein, 560 aa, Medicago truncatula
MGLCFSSTKVVSGSNSNTTNNDNRKRNQSTTTDTTVTVTTATTAAQKQTAQRRKGGSNETAQKKNHHQHHRLKEKTGSKHVPCGKRTDFGYEKDFDKRFSLGKLLGHGQFGYTYVGVDKSNGDRVAVKRLEKAKMVLPIAVEDVKREVKILKELTGHENVVQFYNAFDDDSYVYIVMELCEGGELLDRILNKKDSRYTEKDAAVVVRQMLKVAAQCHLHGLVHRDMKPENFLFKSNKEDSALKATDFGLSDFIKPGKRFQDIVGSAYYVAPEVLKRKSGPESDVWSIGVITYILLCGRRPFWDKTEDGIFKEVLRNKPDFRRKPWPTISNAAKDFVKKLLVKDPRARLTAAQALSHPWVREGGEASEIPIDISVLNNMRQFVKYSRLKQFALRALASTLNEGELSDLKDQFDAIDVDKNGAISLEEMRQALAKDLPWKLKESRVLEILQAIDSNTDGLVDFTEFVAATLHVHQLEEHDSDKWQQRSQAAFEKFDIDKDGYITPEELRMHTGMRGSIDPLLEEADIDKDGKISLPEFRRLLRTASIGSRNVTSPTLRHRRI

SEQ ID NO: 1846 - protein, 354 aa, Blastopirellula marina DSM 3645
MQSKSTSRSLTERPTTDPTPLFEHFRGMHGSELLTAAVAHFNLFGRLNQAPADIETLRNELQLELRPAIVLLTALKAMGLLKEIAGQLSLTELAAEHLVPGGAFDCGDYVGLAAQSPGVLSMVHLLKTNRPLGSDDDDAGGAAFIYRDGMKSAMEVEDSARHFTLALAGRAKNVAPALADVVSLSDAKLLLDVGGGTGIYSHALLQKNPHLRAIVFDRPQVLKIAAQMGEAYGVNDRCEFVSGDMFADPLPEGADTILLSNILHDWDTPQCQQLVDRCAQILPPGGRLLIHDVFLNDALDGPLPIALYSASLFSFTEGRAYSGAEYRSMLEFAGLKPKPIVPTLVHCGVLAGTK

SEQ ID NO: 1847 - protein, 91 aa, Brassica napus
MEEAQPQQDSISDDRSPRRSYWRWRKQDFFPEFSFQSLSSYKSALSATCPRLADRLLARSSDAYEIDAARRESENPMRRCLTWWDLLWLSF

SEQ ID NO: 1848 - protein, 297 aa, Oryza sativa
MEGEEIGLVLARASDLRSRISACVAAAGAREPPEGEGEGGEAVKRLCDGEEGEEEEEVESLLGITNALESLERQLASLQDLQHQERYERETILSQIDRSRGCLLNKLKEYKGQDCEVIHEAASFAGEKIEHDDGLMLPPYSNHVTNSFVLDDLYPPSYLAKLKCMHNGLGSGGTNQDVTKTNRLENRNGSMPNGNSQGGIRSFVGWLAKTAVMVVGAVSIMKAAGYEPVIGRHSIKLDMAGLFSKEATSGKDQATVQCPPGKVMVLEDGRAHCVVKERVEIPFDTNLASPNASYGLG

SEQ ID NO: 1849 - protein, 490 aa, Pseudomonas putida KT2440
MKDLAPSALNKLRRNDLLETRAYIDGRWVTGEGSLDVTDPANDQVIAQVAHCDESWVDLAVEAASRAFDGWRNTLPTQRGAVLRKWAALMRENQEDLAVIMTCEQGKPLSESRGEINYGANFVEWFAAEGERCYGETIPSHLPNSQLVTKLQPIGVTVAITPWNFPSAMITRKAAAALAAGCPMIVKPAPETPLSALALARLAEEAGIPGGVFQVLTGDAPKMSARLLAASAVRAFSFTGSTEVGRILLRQSADTVKKVSLELGGHAPFIVFDDASIAEAVEGCIGAKFATSGQDCLGANRIYVHRNIYGQFVEEFTKATEKLRVGHGLEEGVDIGPMTRVTVANKCREQISNALSLGAKLTCGGIDNHLGSSFVLPTVLADVTDKMDIAFEETFGPVAAILPFDSEDEVVTRANNTEFGLAAYVYTNDLRRACRVSDRLEYGMVALNTPKFTGAPIPFGGWKQSGLGREGSKHGLAEYMELKYVCIGGL

SEQ ID NO: 1850 - protein, 330 aa, Mycoplasma hyopneumoniae 232
MNIDAKKNIILFGMENSLDLAKKISKITGIPLSGIERIVYADGEVLLKSKETIRNSTVFVVANTSRPVNENIMELLIFIDSLKRGYAQEIIVILSYYGYARQDRKSSGRQPITAKLVANLLEKAGLTKLILVDIHNPSIQGFFDFSVDEIHGQYILANELVGKNKDYVVVSPDHGGAVRARILAEILGKQTNVAVIDKRRTGANKSEVLGLIGDVDGKDCIIIDDIIDTGGTIINAANVVREKGAKSVVLAATHGVFSYGFEKFQENPNIDKVIITDSIDNKKLAKKFPKLLITSLAEFLSKSILACIFSTSITSIYEETKQKLIKKNLN

SEQ ID NO: 1851 - protein, 308 aa, Cyanidium caldarium
NGFGRIGRLVLRAAVEKGTVEVVAVNDPFIFPDAAYAAYMLQYDSTHGAFPGEVGSDGEHLVVNGKKLACFAIRDPAEIPWGSVGADYVVESTGVFTVTEKASLHVKGGAKKVVISAPSKDAPMFVMGVNHDAYTKDLTVVSNASCTTNLFGAAGQDHRRGVRHRDGPHEHHPRGDGHAKDGGWAELQRLARCRGAFQSIIPSSTGAAKAVGKVYPKLNGKLTGMAFRVPVPDVSVVDLTVTLKKETNYEEIKKAVKQASQSPHYKGIVAYTEHPIVSADLVHNPYSSVFDAEAGIMLSPTFVKLVSW

SEQ ID NO: 1852 - protein, 257 aa, Erwinia carotovora subsp. atroseptica SCRI1043
MNPLIIKLGGVLLDSEEALERLFTALVAYRQEHQRPLVIVHGGGCLVDELMKKLSLPVVKKNGLRVTPADQIDIITGALAGSANKTLLSWAKKHDINAVGLCLGDGDSTTVTQLDESLGFVGKAEAGSPALLNTLLSAGYLPVVSSIGITAQGDLMNVNADQAATALAQTLGADLILLSDVSGILDGKGQRIAEMTAEKAEQLIAQGIITDGMIVKVNAALDAARALGRPVDIASWRHAEQLPALFSGVAIGTRILA

SEQ ID NO: 1853 - protein, 313 aa, Cyanophora paradoxa
NGFGRIGRLVLRAAVEKGTVEVVAVNDPFIFPDAAYAAYMLQYDSTHGAFPGEVGSDGEHLVVNGKKLACFAIRDPAEIPWGSVGVDYVVEASGAFTAADKASLHLTGGAKKVVLSAPGKDVPMFVMGVNHDAHTKDLKVVSNASCTTNCLAPLAKIIDEAFGIEMGLMSTIHALTATQRRWTGRAPKRLARGRGTFQSIVPTSTGAAKAVGNVYPKLNGKLTGMAFRVPVAAGSVVDLTLNLKRATTYEDIKMVVKEASESQQYNGIVGYTEDSVVSIDIVHNSCSSVFDAGAGIMLSPTFVKLVSWYDNEW

SEQ ID NO: 1854 - protein, 251 aa, Erwinia carotovora subsp. atroseptica SCRI1043
MASEQEKTADFGFRTVAKDEKEVMVAEVFHSVAAKYDLMNDLMSFGIHRIWKRFTIECSGVRRNQRVLDLAGGTGDLTAKFSRMVGEGGEVILADINASMLKVGREKLRNKGIIDNINYVQANAEALPFPDDFFDCITISFGLRNVTDKNKALRSMYRVLKPGGRLLVLEFSKPVIKQLSTIYDAYSFHILPRIGEAVASDAGSYRYLAESIRMHPDQETLKGMMSDAGFDSVNYFNLTGGIVALHRGFKF

SEQ ID NO: 1855 - protein, 539 aa, Desulfitobacterium hafniense Y51
MEVIMLYDPLYHPYPSKRSLSFASRGMVATSQGLAAQAGLDILKKGGNAIDAAIATAACLTVVEPTSNGMGGDAFALVWTKGRLHGLNASGTAPASLSGHDLIKAGHQEMPQYGWIPVTVPGAPAAWAALSERFGRLPLTEVLKPAIDYAEQGYPVSPVLGQNWQIAYTKYAQELKGEEYESWFKTFAPQGRAPFIGEIWRSPDHARSLAQIAESKAQAFYKGDLADRIDAFSQKYGGHLRKRDLEEYQPLWVDPIHLNYRGYDVWEIPPNGHGLVALMALNILKGFQFSAKDSIETYHKQIEAIKLAYVDGRKYIADPRSMEVKISDLLSEGYALERRKLIGQTALLPEPGTPPKGGTVYLATADDEGNMVSMIQSNYMDFGSGLVVPGTGISLHNRGNNFSLDPHHANFLEPKKRPYHTIIPGFLTKDGSAVGPFGVMGGFMQPQGHVQVLMNTLDFHLNPQAALDAPRFLWVQDRHVQVERSLLSHIGDGLSRMGHEIEWSANTGLFGRGQMIWRNEHDVLVGATEPRTDGVVAAW

SEQ ID NO: 1856 - protein, 291 aa, Vibrio kanaloae
GRFVFRAAQERADIEVVGINDLIDVEYMAYMLKYDSTHGRFNGTVEVEGGNLIVNGKTVRVTAERNPEDLKWDAIDVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGETQTSVFDAKAGVALTDK

SEQ ID NO: 1857 - protein, 327 aa, Photorhabdus luminescens subsp. laumondii TTO1
MAKHIEFSSIGGPEVLQYCEFTPRAPADNEVQVENRAIGINYIDTYIRSGLYPPAQLPSGLGTEAAGIVTKVGSAVTTIKVGDRVVYAQSTLGAYSEVHNVAESKVAVLPDTISFEQAAASFLKGLTVYYLLRRTYKIQSGEPFLFHAAAGGVGLIACQWAKALGAKLIGTVGSEEKVQRAKDAGAWQVINYNCENIVERIYEITNGEKVGVVYDSVGKSTWLHSLDCLKRHGLMVSFGNASGPVTGVDLGILNQKGSLFVTRPSIAGYISTREELDEASKELFDLIASGKINVDVPENQKFSLSEAIRAHQILESRTTQGSSLLIP

SEQ ID NO: 1858 - protein, 292 aa, Vibrio lentus
GRFVFRAAQERNDIEVVGINDLIDVEYMAYMLKYDSTHGRFNGTVEVEGGNLIVNGKTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGEVQTSVFDAKAGVALTDKF

SEQ ID NO: 1859 - protein, 224 aa, Solibacter usitatus Ellin6076
MIEIVPSILSADFARLADEIARVERGGARMLHLDVMDGHFVDNLTIGPPVVESVRKNTSLHLDVHLMIENPERYVESFARAGANSISVHYEAVRHLDGVLGLIRKAGAMAGVVLNPATPVGVLEDVLGMADYVLLMSVNPGFGGQKLIPYVLDKVRKLDSMRREKKLALLIEIDGGVHKENLAEVVRAGCDWIVTGSAIFHSPDPEATMREMREIAAHATAVQC

SEQ ID NO: 1860 - protein, 472 aa, Burkholderia xenovorans LB400
MSTAYQPRASAAARLERLPFSGYHRTIFIIIAIAFFFDSVDLGTMTFVLGSIRTEFGLSSATAGLVASASFFGMVIGAAIAGLLADRFGRRPVFQWSMVLWGLASYLCSTAQSVEALIFYRVLLGFGMGMEFPIAQTLLSEFVPAASRGRLIALMDGFWPLGFIAAGVVSYFVLPTFGWRTEFALLAIPAVFVLIVRRMVPESPRWLEHRGRFGEADKILAEVEVKVMKAAGLSQLRPPAMLAEPPAAQGTGAFREIWSIAYRRRTIMVWTLWFFALLGFYGLTSWLGALMQQAGFAVTKSVLYTVLISLGGIPGFICAAWLVERWGRKPTCIASLAGSAVMAYVYGQTALHAQTPTLLICAGLAMQFFLFAMWAVLYTYTPELYGTGARATGSGFASAIGRVGSLIGPYVVGVVLPVFGQGGVFSLGAMCFVIAAAAVWILGIETRGLALETLVSEAVETDARGVLSPMRD

SEQ ID NO: 1861 - protein, 330 aa, Pseudomonas putida KT2440
MPAVTVREALIARDRIKHLVRETRMELSPSLSDFMKVPVYLKLECHQATGSFKLRGATNAIAGLTSQQRALGVVTASTGNHGRALSYAAAAAGVRATVCLSRLVPSNKVAAIRALGAAVQVVGNSQDDAQFEAARLAQEEGLTFIPPFDHQDVIAGQATLGLEIAEQLPSVSQVLIPLSGGGLFSGVSLALKALLPQVKTHGVSMRLGAAMAQSLEAGKPVNVEEVATLADSLGGGIGLRNQYTFELTRRFIDRVILLNEDSIADAMLHAYLEERLVIEGAGAVGIAALLTRQVEAQGPIVIVVSGGNVDMAQHQRIILEAVRDRRPARA

SEQ ID NO: 1862 - protein, 291 aa, Vibrio pomeroyi
GRFVFRAAQERNDIEVVGINDLIDVEYMAYMLKYDSTHGRFNGTVEVEGGNLIVNGKTVRVTAERNPEELKWDAINVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGETQTSVFDAKAGVALTDK

SEQ ID NO: 1863 - protein, 292 aa, Vibrio splendidus
GRFVFRAAQERADIEVVGINDLIDVEYMAYMLKYDSTHGRFNGTVEVEGGNLIVNGKTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKASASYEEICAAMKEASEGEMAGVLGYTEDQVVSQDFIGEVQTSVFDAKAGVALTDKF

SEQ ID NO: 1864 - protein, 489 aa, Burkholderia xenovorans LB400
MAVFAIQRLYIGGAYVDATSGETFDTLDPATGETLASVQQASAADVERAVQSAREGQREWAALTAMQRSRVLRRAVEILRERNDELAALETRDTGKPIAETLAVDIATGADVIEYYAGLATAIEGQQIPLRPTSFVYTRREPLGVCAGIGAWNYPIQIACWKSAPALAAGNAMIFKPSEITPLSALKLAEIYTEAGVPAGVFNVVQGDGRVGAMLAAHPDIEKISFTGGVETGKKVMSLAGASSLKEVTMELGGKSPLLVFDDADLERAADIAMSANFFSSGQVCTNGTRVFVQRGVLERFEALVLERVKRIRVGAPTNAATNFGPLASAAQLQKVLGYIESGKQEGARLMAGGKRLTEGHFGNGQYVEPTVFTGCHDDMRIVREEIFGPVMSILVFDDEDEAIARANRTAYGLAAGVVTGNLARAHRVIHRLEAGICWINTWGESPAEMPVGGYKQSGVGRENGLTTLEHYTRIKSVQVELGPYQPVF

SEQ ID NO: 1865 - protein, 291 aa, Vibrio tasmaniensis
GRFVFRAAQERADIEVVGINDLIDVEYMAYMLKYDSTHGRFNGTVEVEGGNLIVNGKTVRVTAERNPEDLKWDAIEVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKASASYEEICAAMKEASEGEMAGVLGYTEDQVVSQDFIGEVQTSVFDAKAGVALTDK

SEQ ID NO: 1866 - protein, 250 aa, Pseudomonas aeruginosa UCBPP-PA14
MTAPFKDHFSTGSANYAAHRPTYPARLVDELAALCPGTRLALDCGCGTGQLTVLLAERFERVVGTDASAAQIDKAQARERVEYRVSLAEDSGLAAASADLVTVAQAAHWLDLPRFYEEVRRVARADAILALVTYGVLHVDGPMEPLVQHFYHQVVGPYWPAERRHVEEGYRNLPFPFEERRLPDLAIEVAWTLDELLGYVGTWSAVKEAGKALGQDPGAAFVDELREAWGDPQTRYRVSWPLTVRAGVIR

SEQ ID NO: 1867 - protein, 399 aa, Burkholderia xenovorans LB400
MSSNRGVVYLGQGKVEVQSIDYPKMVDPRGRSIGHGVILKVVSTNICGSDQHMVRGRTTAEVGLVLGHEITGEVIEIGRDVETLKIGDLVSVPFNVACGRCPTCKAQHTGVCLNVNPSRAGGAYGYVDMGGWIGGQAEYVMVPYADFNLLKFPDRAQALSKIRDLTCLSDILPTGYHGAVMAGVKPGATVYIAGAGPVGMAAAASARLLGAACTIVGDMNEERLAHARKMGFQTVDLSKDATLGEQIEQILGKPEVDCAVDCVGFEAHGHGSSGSHEEAPAIVLNSLMEITRAAGAIGIPGLYVTDDPGAADAAARKGSLSIRFGLGWAKSHSFHTGQTPVMKYNQNLMQAILWDRLPIADIVNVTVVSLDQAPDGYRQFDGGAPKKFVIDPHGLLKAA

SEQ ID NO: 1868 - protein, 324 aa, Pseudomonas aeruginosa UCBPP-PA14
MPSRITLNANGGPEVLRLEQVQAQQPGPGEVWLEQAAIGVNPLDLGQRSGAVPIPLPSGLGLEGAGVVAALGPGVSGLAPGDRVAYATGPLGAYASARLYPAERLLKLPDTLAFEDAAALLFKGITAHYLLHATYPVGPGTRILLYGAAGAVGQLMAAWARHLGAWVIGVVSKAESVERARAAGCDEVLVFDAASLAAQVAELTAGRKVDVVYDPIGRATFEASLDSLRPRGLLVSFGATSGVPPAVEVATLNAKGSLFLTRPSLAAHTANPEEYRLRAQAVLRAHADGVIQPRVWRRYPLAEAAVAHTDLLEGRSQGALVLLP

SEQ ID NO: 1869 - protein, 261 aa, Bacillus subtilis
MHSLLIEKTAVVTGAAGGIGLEIAKEFAREGAAVIISDVNEQAGKEAAAKLTDEGCEAVSITCDVTNEKQVADMLQTVEKQFGRLDVLVNNAGIQHVAPIEEFPTEQFERLIRLMLTAPFIAMKHAFPIMKKQQFGRIINMASVNGLIGFHGKAAYNSAKHGVIGLTKVGALEGAAAGITVNALCPGYVDTQLVRNQLKDISATRNVPYERVLEDVIFPLVPQQRLLSVKEIADYAVFLASDKAKGITGQAVVMDGGYTAQ

SEQ ID NO: 1870 - protein, 507 aa, Prochlorococcus marinus subsp. pastoris str. CCMP1986
MSSTLSNPLRLGLRQERVISPQCLIIFGASGDLTHRKLIPALFELYLQRRIPSEFAIVGCARRPWSDQDFKEKMKGKLADQISDNEKEWEQFSNYLFYEPVDLQQSDHVVRLSKRLNEIDKLQATHGNNTFYLSVSPNFYGSGCKALKAAGLLDDPKKSRIVIEKPFGRDYSSAKKLNKIVQSCADESQIYRIDHYLGKETVQNILVMRFANTIFEPIWNRNYISSVQITSSETVGVEDRAGYYESSGALRDMLQNHLTQMLAVTAMEPPGKFEPEAIRNEKAKVLQASKLADENEPWNCCVRGQYAQGGNSLKRLKGYRDEDGVNLNSTTETYIATKVFIDNWRWQGVPFFLRTGKRLPKRLGEIVLTFKDVPVHLFESTIINPAPNQLILRIQPNEGATFKFEVKSPGSGMKARPVEMEFSYDESFGEPSDEGYVRLLADAMLSDPTLFTRSDEVEAAWKLYTPLIELMEDAPWKLPIHKYESMTWGPPESDQLLSKDNIFWRRP

SEQ ID NO: 1871 - protein, 306 aa, Vitis vinifera
MATQVVPAVIVGGGRVGRALQGMGSGDDLLVKRGDSVPLDFAGPILVCTRNDDLDAVLESTPKSRWSVHDFVYDLFNLADLVFFQNGMLEPWLQSKGLSDADQVLAYFAVSKLGEPPIDGKTDTNPEGLTAAYGKWASAVAGRLHAGGLSCKVLDKEAFQKQMLEKLIWISAFMLVGARHPGATVGVVEKEFRSEVSSLIGELASAAAVEKGIVFDEGMEDRLCAYSRAVSHFPTAAKEVKSCHQLKIANSHSRYVYVHVTEFWFVSCSNAHSSNGEMVGSIHSPKRQLQKENQIHAHYIQNGSKN

SEQ ID NO: 1872 - protein, 458 aa, Rhizobium leguminosarum bv. viciae 3841
MYSNSLIELDRAHLIHPVASYRGHEKLGVRVLASAKGATVTDASGKQLIDGFAGLWCVNAGYGHESIVEAAARQMRELPYATAYFGLGSEPAIRLAGELADRAPGDLNHVYFTLGGSDAVDSTIRFIRYYWHARGRPERDQFISVEQGYHGSSTVGAGLTALPAFHAGFGVPFDWQHKIPSHYAYRNPVGDNPEAIINASLAALKSKVEAIGPERVAAFYVEPIQGSGGVLVPPKGWMKAMREFCRSHDILFVADEVITGFGRTGPLFACTEDEVVPDFMTTAKGLTSGYVPMGAVLMADHVYETIAEGAGAAAVGHGYTYSAHPVSAAVGLEVLKLYENGLLENGLRAGARLMQGLDSLRDHPLVGDVRGRGMLAAVELVVDKVNKTPLPASAEPARRIFDRAWENGLVIRAFGNGVLGYAPPLCCTETEIDAIVERTRMTLDETLEDPDVRRALQA

SEQ ID NO: 1873 - protein, 316 aa, Bacillus cereus G9241
MPKKVLIFCDPGIDDTMALLLAFFINEIEIIGIVADYGNVPKEMAVQNAHFLNNETKNRNIKIFGGSERPLTGAPPAFFTDVHGKQGLGPIIPKGNVTNGEMENFFEVIPLIEQYKDELIIVSLGRLTSLAILFIMCKQLMKQIKSYYVMGGAFLHPGNVTPISEANFYGDPTAANIVLQSSPNMYIYPLNVTQYSIITPEMAEYIEAKGKAPLVKPLFDHYYYGYYKNALPHLKGSPFHDTMPILALLDNSMFTYHKSPIVVMTESSAQGASIGEFRSLVNQKPFIDWPGHQIAIDFDYNRFFKHFMSLMTGEQF

SEQ ID NO: 1874 - protein, 380 aa, Clostridium perfringens str. 13
MNCNKTIYTPGPTNLRENVRRARALKTTNPDVDLNFVEFYKETCDRFGEIINTKNDCYILSGEGILGLEAACASLTEKGDKVLVLDNGLYGRWFDGFVTMYGGEVTYFSGDYTKEIDVEALSKFLEKNNDFKYATVVHCDTPTGVLNPVDKICPLLKSYGILTVVDSVSAMVGEEFKVDKWQIDIALGGSQKAFSAEPGLTMVSISDDARKVMENRETPIIGFYCNLNIWKNYYKDKWFPYTMPISDIISLRIAIDNILEEGKEKVIERHRKIGEATRKAVKEYGLDLFLKNGYSNTVTAVEIPEEIGALNLRNHLNKEYNVLMSTSLDKYEDKLLRIGHMGENANIEDITYVLNTIDKALKDLGFSSEKHLDKLFIENI

SEQ ID NO: 1875 - protein, 431 aa, Bacillus cereus G9241
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGVKSFYNIKR

SEQ ID NO: 1876 - protein, 331 aa, Prochlorococcus marinus subsp. pastoris str. CCMP1986
MTSFITAVDNEEPTFNLTNSRLRLVSGTSNPKLAEEIASYLGIENVPLVSKRFADGELYVQIQQSIRGCDVFLIQPTCAPVNDSLMELMIMVDACKRASARQITAVIPYFGYARADRKTSGRESITAKLTANLLEKSGVDRVLAMDLHSAQIQGYFDIPCDHIYGSPVLIDYLESLKLEEVVVVSPDVGGVARARAFAKLMSDAPLAIIDKRRSAHNIAESLTVIGEVKGKTAILIDDMIDTGGTICSGANLLKKEGAKRIFACASHAVFSPPSYERLSSKDLFEQVIVTNSIPVIDNYEFPQLKVLSVANMLGEAIWRIHEESSVSSMFR

SEQ ID NO: 1877 - protein, 240 aa, Bacillus cereus G9241
MNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 1878 - protein, 253 aa, Bradyrhizobium sp. BTAi1
MDQTDQTTHFGFRDVPLGEKQTLVNDVFHSVAQRYDLMNDLMSAGLHRVWKDIMINTLNPPKSDAPFALLDVAGGTGDISFRAARKAGAGFHATVCDINGDMLEVGRQRALKQYLEDKVSFVEGNAEKLAFPDRSFDAYTIAFGIRNVPQIELALAEAYRVLKHGGRFLCLEFSTVEVPGLDKLYDLFSFNVIPQLGRAVTGDAESYRYLVESIRQFPRPNAFAEMISAAGFSRVSWQTLSGGIVALHSGWRL

SEQ ID NO: 1879 - protein, 394 aa, Bacillus cereus G9241
MNKKSIRDVDLKGKRVFCRVDFNVPMKEGKITDETRIRAALPTIQYLVEQGAKVILASHLGRPKGQVVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 1880 - protein, 358 aa, Triticum aestivum
MAVDLTPRQPAKAYGGDGGAYYEWSPAELPMLGVASIGAAKLSLAAGGMSLPSYSDSAKVAYVLQGKGTCGIVLPEATKEKVVAVKEGDALALPFGVVTWWHNTPESATELVVLFLGDTSKGHRPGQFTNFQLTGSSGIFTGFSTEFVGRAWDLKEDDAAKLVSSQPASGIVKLTAGQKLPVPVDADRKDMALNCLESKLDVDIPKGGRVVVLNTANLPLVKEVGLGADLVRIDAHSMCSPGFSCDSAYQVTYIVRGSGRVQVVGPDGKRVLETRIEGGSLFIVPRFHVVSKIADASGMEWFSIITTPNPIFSHLAGKTSVWKAISPEVLEASFNTTPEMEKLFRSKRLDSEIFFAPN

SEQ ID NO: 1881 - protein, 413 aa, Bacillus clausii KSM-K16
MDTYLSAKRTIMTPGPVEVDPRVLQAMSMPILGQFDPAFTNIMNQTMDQLRKLFQTENEWAYPVDGTSRSGIEAVLASLIERGDRVLVPIYGRFGHLLVEICERYGADVHKIECTWGTVFSEEEVINHIHAIKPNIVACVHGETSTGCMQPLAQIGKACREQGCLFVVDAVATIGGTDVLVDEWHIDAAIGGTQKCLSVPAGMAPITYNQRVEEVIARRKKVEQGIATKDDLDEPLRGTVVASNYFDLGMLQDYWSPRRLNHHTEATSMVYALHKGLAILLEEGLPHRFARHAYHEKALIAGLTAMGLELFVSHQHKLPMVTCVCVPVGLDADRVRAFMLHHFGVEIASSFGPLYGKIWRIGTMGYSCRKENILFVLAALEAALLHYGTKIETGKAVQAALSYYEQTEKSAMA

SEQ ID NO: 1882 - protein, 377 aa, Porphyra purpurea
MAFVSTASPAVVGRSPSPALCGARSTFATGAPVVAPSAPRAVAAGMSAAMMSAAAMNKKAPVADATGLIGNTPLVQLHKIPDAAGCVANIFAKLESMEPCSSVKDRIGRGMIMDAEAAGKITPGKTVLVEPTSGNTGIALAFIAASKGYKLILTMPDSMSIERRMVLRAFGAEVVLTPAAGGMKTAVSKAEAIAAETPDSYILQQFANPSNPKAHYETTGPEIANAIDCDVFVSGVGTGGTITGAGRYLKEKNPETRVVAVEPVESPVLSGGKPGPHKIQGIGAGFVPAILDTTVYDEVVTVTSAESITMARRIALEEGLLSGISTGAALAAALEVGKRPEMQGKNIVFIAPSFGERYLTSALFDEQREEAYAMKAE

SEQ ID NO: 1883 - protein, 372 aa, Ralstonia eutropha JMP134
MAGHGSCGVLVLDAAACGIDRVALATGRTPRGRDCKEADMWNFRKGRSNEGGDLSQYEQQGQGRSPSEESRGSGSEDWGQEWGEDWRGGSSGSSQGGAWHQQDTPAGQPRGGWGEQSYGAADMGGQGHPYSGTYGGYRPQAQDSGYREYEQQSRQRGGRMGQGGYDSGNYEGSFDSSSGSSAYGQGGGGDERRMQGGRGGRAMHWDEGAARDRGQRGGQPSYGSGYYGDSRSGGQSFSGGQRVYQDDGRDSGGRGRSSGMSGGARRPVGPKGYRRPDERVHEDVCERLAMNPYVDVSDVSVQVSNGVVMLEGTVKERREKYVIEEIAEAVFGVTEVENRLRVQRNEGTERAGPVAGHLEGADTSPQRTLNKS

SEQ ID NO: 1884 - protein, 545 aa, Porphyra purpurea
MKFHGSYQQDDRELRKRGAEKAYQFMLRLKMPAGEFPAAMYRELDDLSTELGNTTLRATTRCTFQMHGILKKNLKSVFSRILNAGGSTIGACGDLSRNVMCTPAPIDAPEYVAARHLSRMLAELFAPQTGAFSEIWLDGEKAASLEYWKKDLDMGAVGQLMREDANDTHLTFPGHEEPIYGDQYLPRKFKIGVTVAGDNSIDIYTQDIGVVVVMNADNTEVEGYNLTVGGGMGRTHKKETTFARTGDHLGYVPAADIYTACKAIIAAQRDHGNREVRANARMKYLVDKMGIDAFRTLVEGYYGKSFEEYRQLPAWEFKDWLGWYDQGNGKAFLGLFIENGRIKDEGTFRLKTALRKIVDDFGYDFVVTPNQNVLIRDVPNERKADLDSLLTEHGITLPADVNINHRLAMACPALPLCGLAVTEAERHMPTVIDRVNSVLAEADLADMPVVMRMTGCPNGCARPYMAELGFVGSGPQAYQLWLGGCPDQTRLAYPYDEKVKDADIEATLRPLLAAYKEDRTDGESFGAFTARWGKDALHKYVAEHA

SEQ ID NO: 1885 - protein, 335 aa, Xylella fastidiosa Ann-1
MTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSRARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 1886 - protein, 394 aa, Oryza sativa
MAPPAPATARRPMAAVRCSAAKRSYNVTLLPGDGIGPEVVAVAKDEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNSSSIENSRTDEKLLSVFREGVYDIHSPRIPSTEEIADRINKMLAVLDTNIL

SEQ ID NO: 1887 - protein, 345 aa, Photorhabdus luminescens subsp. laumondii TTO1
MYQSKEIEKTFKFSEKDKETVKYSLNRFSVAPMLDWTDRHCRYFHRLLSRQTLLYTEMVTTGAIIHGKGDYLAYSEQEHPIALQLGGSDPQALAHCAKIAQERGYDEINLNVGCPSDRVQNGRFGACLMGEAELVADCVKAMQDVVNVPVTVKTRIGIDEQDSYQFLCDFIDIVVQHSGCNIFTMHARKAWLSGLSPKENREIPPLDYPRVYQLKKDFPQLTIAINGGIKSLEEAKQHLQHVDGIMIGREAYQNPSILAQVDHELFDASMPVVNTVAVVKALYPYIEQELSKGTYLGHITRHILGIFQGIPGARQWRRHLSENAHKPGADISVVEQALAMVTERM

SEQ ID NO: 1888 - protein, 95 aa, Glycine max
  misc_feature (54)..(54): Xaa can be any naturally occurring amino acid
ASSKISFPVVTTDNRAGAGMVAPFTGLIFMAGFPTIKTNIDITSIASNGGRVQXFQVWPPAGNKKFETLTFLTDLDNAQLSNEVKYLLKKGWIPC

SEQ ID NO: 1889 - protein, 729 aa, Erwinia carotovora subsp. atroseptica SCRI1043
MLYQGESLYLNWLEDGIAELVFSAPGSVNTLDTRTVASLGKALDVLAEQPNLKGLLLRSDKPAFIVGADITEFLSLFAAPAEKLHEWLVFANSIFNRLEDLPVPTLSAINSYALGGGCECVLATDFRLATPDARIGLPETKLGIMPGFGGTVRLPRLLGADSALEIIAAGKDVSAADALKVGLVQAVVANEKLIPAAIKMLKQAINGELDWLGYRRPKLEALKLNKIEAMMSFTTAKAMVLQTAGKHYPAPMLAVKTIEAAATMTRDEALQLETQHFVQLARSNEARALVGIFLNDQYVKGKAKKLVGETPVPQQAAVLGAGIMGGGIAYQSAFKGVPIRMKDINEKPLALGMNEAAKLLNKQMERGKLDGMKMATILANIHPTLDYAGFERTDIVVEAVVENPKIKASVLAETESHISESTILASNTSTIPIAVLAAALKRPQNFCGMHFFNPVHRMPLVEIIRGPKTSDSTIASVVAYASKMGKTPIVVNDCPGFFVNRVLFPYFAAFSLLLRDGADFREIDNAMEKKFGWPMGPAYLLDVVGIDTAHHAQAVMAEGFPQRMAKDYRDAIDVLFEHQRFGQKNGQGFYRYQTDSKGKQRKEQDDAVDALLKNISQPKKAFSAEEIIARMMIPMINEVARCLEEGIVASPAEADMALVYGLGFPPFHGGACRYLDTLGSERYVEMAQQLAHLGAIYQVPDGLQQKARSNEGYYPSVAPHADVSHGQPA

SEQ ID NO: 1890 - protein, 484 aa, Comamonas testosteroni
MKDIQNFINGAYVSTGRSFDKHSPLTGKVIAKVHEAGRNEVDAAVTAARTALNGPWGRMSVAERVEKLYAVADGINRRFEEFLAAECADTGKPRSVASHIDIPRGAANFKIFADVVKNVPTEFFEMATPDGRGAINYGHRGPVGVVGVICPWNLPLLLMTWKVGPALACGNTVVVKPSEESPQTAALLGEVMNEAGIPPGVYNVVHGFGPDSAGEFVTSHPGVDAITFTGETRTGEAIMKAAAKGARPVSLEMGGKNAAIVFADCDFDAAIDGTLRSAFVNSGQVCLGTERVYVERPIYERFVAALKQQIEGWKIGVPEDDDTKLGPLISKEHQAKVLSYYQLAVQEGATVVTGGGMPDLGAQYADGAWVQPTIWTGLPETARVIKEEIFGPCCHIAPFDTEEEVLTKANDNVYGLASAIWTQDLARAHRVAQRMHVGISWVNSWFLRDLRTPFGGAKQSGIGREGGVHSLEFYTELKNVCIKL

SEQ ID NO: 1891 - protein, 171 aa, Thiobacillus denitrificans ATCC 25259
MARTAPTSNEERGDGLREKMISVNRVTKVVKGGRIMGFAALTVVGDGDGGIGMGKGKSREVPVAVQKAMEEARRKLVKISLKNGTFHHTVVGQHGASRVLIQPASEGTGIIAGGAMRAVFEVMGVQNVLAKCLGSTNPYNVVRATIDGLMKMSTPSEIAAKRGKSVEDITG

SEQ ID NO: 1892 - protein, 262 aa, Aspergillus oryzae
MSASLFSLSGKTAIVTGGTRGIGQAMAFALAEAGADIVLIQRDESNTSTRDEIISRIGRKAWIHVAELSSRDAIKGVIPALTSQGLKPEILLNCAGIQRRHPSEQFPDEDWDEVIQVNLTSVFTLCREFGAYLLARDASEFPTGRRGSIINVASLLSFQGGITVPAYAASKGGISQLTKALSNEWVSKGINVNAIAPGYIATDMNTALINDSNRNAGIMARIPAGRWGSPDDFKGVIVFLASQASSYVSGEVICVDGGWMGR

SEQ ID NO: 1893 - protein, 418 aa, Burkholderia xenovorans LB400
MRDHATLQLSPEPAPDHAASRVTQPRFWETLPARWNSDTDDTLVCCQVRQETHDVKSFLFRAPSGRAFVFEPGQFITLELEIDGEPINRCYTISSPPTRPHTISITVKRVPGGKVSNWLHDNLHAGAEVRVLGPAGEFTCARHPARKFLFLSAGSGITPLMSMSRAHHELGEDSDIVFVHSARTPDDIIFARELDLIASNQAHFRTAFVCERLGARTNWPGVTGFLTLPLLKLIAPDFLEREIFICGPAPYMQAVRKLLDEGGFDRRHYHEESFSFGTVSEVAAQLTTAHVADALQSASAPVTAGSFTEAREEAAGFTPASAPTPADVEAETRFKVSFAKSHREIECGSGQNVLDAAKKAGVRLPASCTQGMCGTCKVKLVSGEVAMKHAGGIRQREIDQGMVLLCCSKPLTDLVVDK

SEQ ID NO: 1894 - protein, 526 aa, Rhodospirillum rubrum ATCC 11170
MIGRRGTSRSWRRFLGNPTSWVGLAGAGRRRRVLPTHPPADHAGRSRLFQARAVLAEAIAIAGAPFMAYQTINPFDGSVVQTFQEFSDSELASALDSAADCFAGWRQTSFAERAAIAHKAAGLLREQSGDYARLITLEMGKRIEEAEGEVALSADIIDYYADHAEAFLKPQPLKPESGEAVIESSPLGVLFGVQPWNFPYYQLARFAAPNLMAGNVVMVKHAGCVPQCAQAFEKLWRDAGAPAGAYTNLVISYDQVNAVIDDPRIKGVALTGSADAGKSVAARAGQNLKKSTMELGGSDAFIVLEDADLDKTVEWAVWGKMNNMGQCCVAAKRFLVVDSLADRFLEKFQAALAGLKAGDPMDRATTLAPLSTEGALTKLVEQVDKAVSDGATLVMGGKRLDRPGFFMEPTILTDIAPDTAAFREEFFGPVALFFRVKDEDEAVALANDSDFGLGGSVFTQDVARGKRVAERIETGMVFINQPTWTAPDLPFGGINISGYGRELSGLGIQEFVNKKLVRVALIDAAA

SEQ ID NO: 1895 - protein, 176 aa, Bradyrhizobium japonicum USDA 110
MAIYELDGQAPDLPADGNYFIAETATVIGRVRLKPGASVWFGAVLRGDNEWIEIGEGANVQDGSTCHTDLGFPLVIGKNCTVGHNVILHGCTIEEGALIGMGSIVMNGAKIGRNSIVGAGSVITEGKEFPERSLIIGSPARVMRTLDDAQVQRMGSAAKFYVANGPRFTKGLKRIG

SEQ ID NO: 1896 - protein, 464 aa, Clostridium perfringens str. 13
MLFGKNELGSQFETPIFGTVESNESIPKYELAKKSIAPQVAYRLIKDDLLDEGNARQNLCTFCQTYMDDEAVKLMAETLEKNAIDKSEYPQTTDLENRCVNILADLWHAPKDESFMGTSTVGSSEACMLGGMAMKFRWRNRAKALGMDVTSRKPNLVISSGYQVCWEKFCVYWDIEMRLVPMDEEHMSINVDKVLDYVDDYTIGVVGILGITYTGKYDDIKALDKKLEEYNKTAKLTVPMHIDAASGGMFAPFIEPELEWDFRLKNVVSISTSGHKYGLVYPGIGWVLWRDKEYLPQELVFDVSYLGGKIPTMAINFSRSASQIIGQYYNFLRYGFEGYRQIHQRTKDVAMFLASELEKTGLFQIYNNGENLPIVCYKLRDDVNVDWTLYDLADRLLMKGWQVPAYPLPADLQDTIIQRIVCRADLSHNLAELYLRDLKAAIEDLNNARVLNQKSKTGVQGFTH

SEQ ID NO: 1897 - protein, 175 aa, Rhodospirillum rubrum ATCC 11170
MPNLNAASEPEIATHTIAVLVDNESGVLARVIGLFSGRGYNIESLTVAEVDVDEQLSRITLVTSGTPMIIEQIKAQLGRLVPVHKVSDLTVEGPHVSRELALIKVAGTGEKRVESLRIADIFRARVVDSSNESFVFEIVGKTEKINAFIGLMEPLGLIDVARTGVAAIARGGQPF

SEQ ID NO: 1898 - protein, 291 aa, Yarrowia lipolytica CLIB122
MSNSAKAAVVPPAPTAEDIARANAGSKEEPVFQAKNFLSKFRLDGKVAIVTGGARGLGFSMAEGLCSVGLKGIAILDVQQDLGLDAIEKLHKAYGVQAQFYKADVRDEESVNEIIDRVVHDLGSVDVVVNSAGVADLVHAAEYPADKFRRVIDINLNGSFLVTQAAARHMIKQGTGGTVVFIASMSGSIVNWPQPQSAYNASKAAVKHLSKSLAAEWAVHNIRCNSISPGYMDTALNRAYNTLFEEWKDRTPLGRLGDPDELTGACIYLASDASSYVTGSDIIIDGGYTII

SEQ ID NO: 1899 - protein, 317 aa, Bradyrhizobium japonicum USDA 110
MFQRVGGFRGARCCSLSGKPVRTLSPRLCYRTNKTSPFERADPMAVHQVNPGGKLASLDPIWDRIRSEAEDIVHREPELATFIYSTVLHHSRLEDSVIHRLADRLDHSALSGDLVRQTYDEALRDDPDLGNAFRADLVAVYDRDPATSRFIDPLLYFKGFHAIQTHRLAHWLWLKGRKDFAYYLQSRASAVFQTDINPAARIGRGIFLDHATGFVCGETAVIEDDVSILHGVTLGGTGKENEDRHPKIRHGVLIGAGAKILGNIEIGHCARIAAGSVVVKPVPHNVTVAGVPAKIVGEAGCAEPSRTMDQMINAMGL

SEQ ID NO: 1900 - protein, 124 aa, Candidatus Pelagibacter ubique HTCC1002
MTKKINKDLTAEQKLVLFEDGTETPGTSELNHEKREGSYHCANCGEKLFDSNAKYESGSGWPSFYQSLPDAFETKTDTLLGYERVEYHCKKCGGHHGHIFEDGPKPTGKRYCNNGVCLTFKPKN

SEQ ID NO: 1901 - protein, 191 aa, Synechococcus sp. RS9917
MPDTAISSHWGQPRVDPQAWVAASAVVMGDVEIAAGASLWPMAVARGDMAAIRIGARSNVQDGAVLHGDPGAPVQIGEDVTIGHRAVVHGATLENGCLIGIGAIVLNGVTVGEGALVAAGAVVTKDVPPRSLVAGVPAQVKRELPETAVEEQRQHAHHYAALAAQWRDQNTAMLQNQTVSTSLPTHSPSCP

SEQ ID NO: 1902 - protein, 451 aa, Pseudomonas viridiflava
MDAALARLESWRQAQSERLSHCAPVQIRGRIAGVNGILLNSYMPRARIGDLCEISRADGSEVMAEIVGFDRQHTLLAALGPLGGIAIGAPVRPLFQPHSLVVGEFLLGAVLDGFGRSLSGDGPSAFALSGAVGAQPVIRDAPPATERPRIDTPLSTGLRSIDGLLTLGEGQRVGIFAGAGCGKTTLLAEMARNTPCEAIVFGLIGERGRELREFLDHELDEELRQRTVLVCSTSDRSSMERARAAFTATAIAEGFRQQGKSTLLIIDSLTRFARAQREIGLASGEPAGRGGLPPSVYSLLPRLVERAGRTHDAAITALYSVLIEQDSMNDPIADEVRSLLDGHIVLSRKLAERGHYPAVDILTSLSRTMSNVVGTEQVHGATQVRRLMAAYQQVEMLIKLGEYQPGNDPLTDFAVQSRDRIMGFLQQSLRDPVSLDETLDHLIQVTADVPR

SEQ ID NO: 1903 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLR

SEQ ID NO: 1904 - protein, 450 aa, Arabidopsis thaliana
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKYKSVAVLTSPKLLDTLF

SEQ ID NO: 1905 - protein, 301 aa, Solanum tuberosum
MRMLRWMCVHTKRDKIRNEDIRDKNVCSDFPKLIDANGIRKSRPSTVAPQVNGHGIDSMSKFFLDFGYERREELRFPAKKLKAFWFSPPKVSTSSHGSGVNGPLPRIFISELLVDQLSPEAQEVIKKYTNISHCGKEYAALASAFGILTWEKPSYSEFQQLTRESEYAAWTLVNGYALNHVTISTHRLASNLRSIGNLNQFIGENGFNLNSEGGILKVSPDGLLLQSSTVADSTSFEFSDGITEAVPCSYIEFAERLVLPQYKDVPTEKVEEFHRRDGFEVGNADKIFESTSKDQLTRRAA

SEQ ID NO: 1906 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPSGDKGEFIEKVRRALYLGKIVSYAQGFSQLR

SEQ ID NO: 1907 - protein, 460 aa, Arabidopsis thaliana
MNSASAHDLRLLEVDKEKQDPKSPRGALEACLTRCSISSASSSSDDPPPNREAIDNADADTDVQCKNHRASSNWGKFFKLWKRRSMKRLSSFPPLSGAAPPIIKQNKSADPNMNGMVLHDIYDFQSSLQNFSISDIEIATDNFSPENIIGRGGYADVYQGILPEGKLIAVKRLTKGTPDEQTAEFLSELGIIAHVDHPNTAKFIGCCIEGGMHLVFRLSPLGSLGSLLHGPSKYKLTWSRRYNVALGTADGLVYLHEGCQRRIIHRDIKADNILLTEDFQPQICDFGLAKWLPKQLTHHNVSKFEGTFGYFAPEYFMHGIVDEKTDVFAFGVLLLELITGHPALDESQQSLVLWAKPLLERKAIKELVDPSLGDEYNREELIRLTSTASLCIDQSSLLRPRMSQVVELLLGHEDVVMTPREAKIKMMQRTYSEELLDSVEYNSTKYLGDLDRIREVALAS

SEQ ID NO: 1908 - protein, 603 aa, Solanum tuberosum
MNSKEEGAYRLFSEPSPRYYDEKKVFQKSNLFHMLPKGIPVPPSGPSRRHNGDATVAPIQWMKPCNMSSLKGVQLTFQQLPKELKRPFQLDKYQLPSIRRRFDKANFFVLQNMGLGGDGEKGESWDVEKSKGKKKKEVTEEETGCWTKLWFIGSCISSRSKVDSSISGISTHCDKSTYVLTSCIALAESKSTNTSRDQPVAPIISSTTTSNAESNSSTSKLEEELKVSSRLRKFAFNDLKLATRNFRPESLLGEGGFGCVFKGWIEENGTAPVKPGTGLTVAVKTLNHDGLQVLSIWQAEVNFLGDLVHPNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKARPMMSDVVEALKPLPNLKDMASSSYYFQTMQADRVGSSPSTKNGVRTQGSFSRNGQQHPRSLSIPNGSHASPYHQQFPQNSPKPNGKT

SEQ ID NO: 1909 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLR

SEQ ID NO: 1910 - protein, 122 aa, Arabidopsis thaliana
  misc_feature (58)..(58): Xaa can be any naturally occurring amino acid
MASSMLSSATMVASPAQATMVAPFNGLKSSAAFPATRKANNDITSITSNGGRVNCMQXVWPPIGKKKFETLSYLPDLTDSELAKEVDYLIRNKWNSFVLNSELEHGIFCTREQRVNLTPGYL

SEQ ID NO: 1911 - protein, 431 aa, Triticum aestivum
LLRPTRSDVCKMIIDQLCDQRVVVVTQESFYYGLSDEEMVHVHDYNFDHPDAFDTDLLLSCMEKLKHGKAVDIPSYDFKTHKSVSCARKVNPSDVIILEGILLFHDSRVRDLMNMKIFVDTDADVRLTRRIRRDTIEKGRDIIAVLDQYSKFVKTAFEDFILPTKKYADIIIPRGADNSVAIDLIVQHIRTKLGQNDLCKIHPNLYVIQTTYQIRGMHTIIRDAATTTHDFIFYADRLIRLVVEHGLGHLPFREKQVITPTGSVYTGVDFSKSLCGISVIRSGESMENALRACCKGIKIGKILIHREGDDGKQLIYHNLPKDIAKRHVLLLDPILGTGNSAVQAISLLLEKRVQEANIIFLNLISAPQGVHVVSKRFPRVKIVTSEIELGLNDDFRVIPGMGEFGDRYFGTDDYQSSTPFFADDKNRVGLL

SEQ ID NO: 1912 - protein, 107 aa, Brassica napus
  misc_feature (11)..(11): Xaa can be any naturally occurring amino acid
  misc_feature (28)..(28): Xaa can be any naturally occurring amino acid
  misc_feature (58)..(58): Xaa can be any naturally occurring amino acid
MGKKGRACVVXLGRSPRMQYHALSLACXGSIPHEAVLKHPSIHIHTMAQLRFINLLPXNPPFVPTLIAVKWASSWRRAAFLVDWHNFGYTLLALSLGRNNVFVSLYR

SEQ ID NO: 1913 - protein, 334 aa, Synechococcus elongatus PCC 6301
MIIRTPSSPANRSVMRIAQNITELIGRTPLVQLNRIPVADGCLARIVVKLESFNPSASVKDRIGISMILEAERKGLIAPDRTTLVEPTSGNTGIALAMAAAARGYRLILTMPDTMSSERRAMLRAYGATLELTPGIEGMAGCIQRAQEIVASHPEAYMLQQFKNPANPKIHRETTAEEIWADTDGTVDILISGVGTGGTITGVAEVLKERKPSFQAFAVEPANSPVLSGGRPGPHKIQGIGAGFVPEVLATQLIDEVVTVSDDEAIAYGRRLAREEGLLSGISSGAAVAAAVQVARRPENTDKLIVVILPSFGERYLSTPLFQEPELVSVSSNG

SEQ ID NO: 1914 - protein, 489 aa, Rhizobium leguminosarum bv. viciae 3841
MENRMNGLRDSSLLRQQGLIDGEWRGAAAGHTIEVIDPATQHVLGTVPDMDGADTRAAIVAAEKAFGPWRAKTNAERGALLEAWHDLMLDNIEDLALILTREQGKPLTEARGEIRYGASFIRWFSEEARRIGGTTIPSPTADRRIVVLKEPVGVSAIITPWNFPNAMITRKVGPALAAGCTVVVKPSDLTPFSALALGVLAERAGIPKGVINIVTGMPAGIGDELMANQTVRKISFTGSTRVGSLLMRGAADSVKRLSLELGGNAPFIVFDDADLDLAVEGAIASKFRNGGQTCVCANRLLVQSGVYEAFAAKLSARVSAMKVGAGTDAGTDIGPMINKAAIEKIRRHVDDAVEKGARILATAGFMPEGDQYAVPMVLGGATTEMQLASEETFGPVAPLFRFDNEEEAIRIANATPFGLAAYFYTGSLKRSWRVAEALEFGMVGLNTGAISTEVAPFGGVKQSGLGREGAQCGIEEYLEMKSFHIGGLA

SEQ ID NO: 1915 - protein, 347 aa, Rhizobium leguminosarum bv. viciae 3841
MKTYKIALLPGDGIGRDVTAAAWAVLEKAARLNGFSLDATSYPWSCDYYLENGSMMPADGIEILRSFDAILLGAVGWPRKVPDSVSLHGLLLPIRKAFVQYANIRPHRLLPGVQGPLRSDGFNILCIRENTEGEYSGAGGRVHQGTDNEVAVETSIFTRKGVERILRFGFEQARARRGKLASVTKSNAQKYSMVFWDEITQRLSAEYPDVEVTSYHIDAMAARMVMAPDSLDVVVASNLFGDILTDLGAAIQGGLGFAASANINPDRSAPSMFEPVHGSAPDIADLGIANPIAAIWSGAMMLEHLGEPAAAARVMASIEATTARGIGSIPGKDKTDAITASVLSALG

SEQ ID NO: 1916 - protein, 548 aa, Yersinia pestis biovar Microtus str. 91001
MKNINPSQTAAWKALQQHFEQMKDVTISSLFAKDDQRFNRFSATFDDQMLVDFSKNRITSETLEKLQDLAKETDLAGAIKSMFSGEKINRTEDRAVLHIALRNRSNTPIVVDGKDVMPEVNAVLAKMKQFCDRVISGDWKGYTGKAITDVVNIGIGGSDLGPYMVTEALRPYKNHLNMHFVSNVDGTHIAEALKPLNPETTLFLVASKTFTTQETMTNAHSARDWFLSAAGDPAHVAKHFAALSTNAKAVGEFGIDTNNMFEFWDWVGGRYSLWSAIGLSIALSVGFEHFEQLLSGSHAMDKHFAETPAEKNLPVLLALIGIWYNNFFGAETEAILPYDQYMHRFPAYFQQGNMESNGKYVDRNGHPVDYQTGPIIWGEPGTNGQHAFYQLIHQGTKLIPCDFIAPAISHNPLSDHHAKLLSNFFAQTEALAFGKSLEDVEAEFAAAGKTPEQVAHVAPFKVFEGNRPTNSILLREITPFSLGALIALYEHKIFTQGVILNIYTFDQWGVELGKQLANRILPELADDQEVTSHDSSTNALINRFKNWR

SEQ ID NO: 1917 - protein, 184 aa, Zea mays
TSRTARSGSPPAAAAEKRHLHTRACTDRLEKCERDKSRVLVHCMTGKNRSAAIVAAFLMKSRGWRLAQSFQWVKDRRPQVQLTDASQKELLEYELKLFGPSTQTLVPTESFASLGFGYTKPAGDMQTPVFNQTTMPSIFERFNPNDRPANFTFGVERKAEANPQDNNSDGRVNPTSTENLMDSS

SEQ ID NO: 1918 - protein, 327 aa, Gibberella zeae PH-1
MVTLPSPFSDIDRVQLLFNRPTDIEPLSRLTESVNNNVKLWIAREDRNSGLAFAGNKVRKLEYVLADALAQGADTVVTTGGIQSNHMCQTSAAAARLGLKVALYPADRVASNDAEYKYLGNIQANAILGAETFPVDTAEETVITTLKDRGQKPYSIPPGASSHPLGGLGYARWAFELLEQEKKIGVTFDTIALVAGSCSTLGGLLAGLKLAQKEQIPGSKKRLIGFSVLHKSKKDVEALVLKTSRTTASKIGISPNEITADDFEINTSYIGDGYGQLNDSTAEAMKKLARKEGILTDPVYTGKAFTGLLDLAKTGYLNVSTTIVLNI

SEQ ID NO: 1919 - protein, 120 aa, Populus trichocarpa x Populus deltoides
MAKWSSWFLISATILILMAMGLSSTVQGSGDHHLGWIPATRSSVCKGSIAECMAEDGEEFEMDTEINRRILATTKYVSYGALQRNNVPCSRRGASYYNCQRGAQANPYSRGCSRITRCRS

SEQ ID NO: 1920 - protein, 128 aa, Populus trichocarpa x Populus deltoides
MARLNSFFLISATVLILMVMGWPSTVQGNGDHHHHHLGWIPTTATTRSSICDKGSLAECMAEEDGEEFGMDTEINRRILATSRYVSYGALQKNNVPCSRRGASYYNCKNGAQANPYSRGCSRITRCRG

SEQ ID NO: 1921 - protein, 472 aa, Vibrio vulnificus CMCP6
MTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 1922 - protein, 164 aa, Schizosaccharomyces pombe 972h-
MLFPRVVPFQSLRTAFQKKTFLPVSSAGNVFTPRFQLQAIRSIWIRSEETPNENALKFLPGLDILPPTIGSCEFMRGQGTVNSPLAQKLFDIDGVDSIFFGKDFITVSKGAGTEWAQMKPEVFSVIMEHLSNGSPVLSEEPLKGASDTQILESDSQIVAMIKEL

SEQ ID NO: 1923 - protein, 392 aa, Prochlorococcus marinus str. MIT 9303
MKAMILAAGKGTRVQPITHVIPKPMIPILQKPVMEFLLELLKEHGFKEVMVNVSHLAEEIENYFRDGQRFGVEIAYSFEGRIEEGELIGDALGSAGGLKKIQDFQQFFDDTFVVLCGDALIDLDLSEAVKRHRAKGALASLVTKRVPKDQVSSYGVVVTDENDCVQAFQEKPSTDAALSDTINTGIYLFEPEIFEHIPSDQPFDIGSDLFPKLVEMGLPFFALPMDFEWVDIGKVPDYWRAIRSVLQGEVRQVGIPGKEVRPGIYTGLNVAANWDKINVQGPIYVGGMTRIEDGATIIGPSMIGPSCCICEGATVDNSIIFDYSRIGAGVQLVEKLVFGRYCVGKNGDHFDLQEAALDWLITDARRQDLVEPSPQQKAMAELLGTDLTSAPS

SEQ ID NO: 1924 - protein, 539 aa, Enterococcus faecalis
MAYQFKLPDIGEGIAEGEIVKWFVKPGDTINEDDTLLEVQNDKSVEEIPSPVTGTVKNIVVPEGTVANVGDVLIEIDAPGHEDNDAAPAAPAQEQTPAQPAAVPTTEAAGGFFQFKLPDIGEGIAEGEIVKWFVKAGDTINEDDSLLEVQNDKSVEEIPSPVTGTVKNIVVPEGTVANVGDVLVEIDAPGHNSAAPAAAAPATNAPKAEASAPAASTGVVAAADPNKRVLAMPSVRQYAREKNVDITQVTATGKGGRVIKADIDAFVSGGSQAAPATEAAATEAAPKAEAAAPKAAPKAFTSDLGEMETREKMTPTRKAIAKAMVNSKHTAPHVTLHDEVEVSKLWDHRKKFKDVAAANGTKLTFLPYVVKALTSTVQKFPILNASIDDAAQEIVYKNYFNIGIATDTDHGLYVPNVKNANTKSMFAIADEINEKAALAIEGKLTAQDMRDGTITISNIGSVGGGWFTPVINYPEVAILGVGTIAQEPVVNADGEIVVGRMMKLSLSFDHRIVDGATAQKAMNNIKRLLADPELLLMEG

SEQ ID NO: 1925 - protein, 132 aa, Helicobacter pylori
SNIKYELDKESGALMVDRVLYGAQNYPANYGFVPNTLGSDGDPVDALVLSDVAFQAGSMVKARLVGVLNMEDESGMDEKLLALPIDKIDPTHSYVKDINDLSKHTLDKIKHFFETYKDLEPNKWVKVKGFEN

SEQ ID NO: 1926 - protein, 314 aa, Geobacter sulfurreducens PCA
MSTMIATRDAYGQTLAELGEENGSVVVLDADLSGSTKTSVFAKKFPDRFFNMGIAEANMVGTAAGLAAAGKIPFVSTFAIFAVGRAWEQVRQSLAYPKANVKVVATHGGITVGEDGGSHQSVEDIAIMRAVPNMTVIVPADGPETARAIRAAAAHRGPVYVRLGRNKVPTVTSTDTPFEIGKGVQLADGTDLTFVTTGLMTAQALAAAELLSQEGISARVIHMATIKPLDGEILQRAAQETGAIVTAEEHSIVGGLGGAAAEFLAENCPVPLKRVGINDRFGLSGKAEELLKYFGLMPADLAEAGREVLTRKRP

SEQ ID NO: 1927 - protein, 252 aa, Triticum aestivum
MGPCGRVVPHSGRVPPPIPGAHGRRPPRVGGQDLALDRRGGHTPAPPLSEGSTYLDHTGPLPIGLAGTSVAPFQGLKCKGGLPVSRRLPRAVASGRFSTGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGTPPPPHSRQAIYKVPLQFCQL

SEQ ID NO: 1928 - protein, 270 aa, Glycine max
  misc_feature (79)..(79): Xaa can be any naturally occurring amino acid
MAVTGSHLLDDSPPAFSSVISLRYALPEILANGASHSVNLKFQTLGHFVNVCGSLSDDVGSRLHFVCLDKRKYVTRPEXALRANSETKGSLNDGEDIVFGNEVFEMWKMGKDRLALPLLIDLCEKAGVDLPPCFMRLPMELKLLILERLPGVDLAKVACTCSELRYLSTSNELWKKKYEEEFGKEGDRKGWLFKDLFALSWETKKRCRAVPFRRRGISRNIIFSPNHFGMPPVWGGEYGVQPVFGVPFPRYQLWRNIIPSRTLTLGDFNI

SEQ ID NO: 1929 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGPQAQPAGDKAEFIEKVRRALYLGKIVSYAQGFSQLR

SEQ ID NO: 1930 - protein, 432 aa, Xylella fastidiosa Ann-1
MTLWVLGLNHQTAPMELRERASFVGDALPHALDSLRNLPNVNEAALLSTCNRTELYAETTNAQMLLNWLEQHRPGLQNHLYQYRDAAAVRHLFRVATGLDSMVLGESQILGQVKDSWSMARTHGTLGNTLDRLFQHSFSVAKHARTNTRIGTNPVSIASTAVRLAQDAFSPLNESTVLLIGTGETIQLAAKHLSEGRVQRLLIANRTHAKAQMLASQHGGYALPLTELNLHLAEADIIFSATAAPTPIVTQSNVESALHIRKRKPMLLFDLAIPRDIETEVGTLTDAYLYTIDDLERAVEENRHSRREAAETAEAIIELQVKRYMDTLQAHAHQAPLRRLRTFGTTTRDELLTRARRQLANGRPAEEVLEQLAHGLTNRLLHPPTAALREAALANNTELVHAAEQLFPEKPGYHHPTLQTTIVKTDETDPAS

SEQ ID NO: 1931 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLR

SEQ ID NO: 1932 - protein, 156 aa, Triticum aestivum
MADRGTSRGGGFASRGGDRGRGRGRGRGRGRGKNEEKEWQPVTKLGRLVKAGKINSMEEIYLHSLPIKEYQIVDNFLPKLKDEVMKIKPVQKQTRAGQRTRFKAIVIIGDSEGHVGLGIKTSKEVATAIRAAIIIYELMGAGNWCRGVTNQLCFIA

SEQ ID NO: 1933 - protein, 244 aa, Glycine max
  misc_feature (46)..(46): Xaa can be any naturally occurring amino acid
  misc_feature (126)..(126): Xaa can be any naturally occurring amino acid
MEVIRVLAAAIVVAVLAAALPADAGDDNRVFAPCTDTRVQRSDGFXFGIAFAPKDKFFYNNNNSVQLSPCDTRLSLSSANSQISVFRPKVDEISLLTVNSSSFVADSYGYMVAFAGHRYAARSPPXAFVANGTYTVTSFTLVLEFKRGRLQNLYWKRDGCSKCSSNSKAVCLNNQDCALQTSTCKSHGGTVDCSIGIQLAFSGTDRHLAVLNSWYEVKNLRQYSLYGLYSNLRDSLTSQYDKFF

SEQ ID NO: 1934 - protein, 423 aa, Idiomarina loihiensis L2TR
MTISALGINHKTASVDLREQVAFSAEQLDAALQAVRNLQGVEEAVIVSTCNRTELYCRGEVSGDLLLGWLTGFHKLAPNALENHHYHFQGEQAITHLMSVASGLDSLVLGEPQILGQVKQAYQAAKRQASVGGILERLFQQTFRVAKTVRNETAVGQNAVSVAYAAVSMARHIFANLQKSKVLLIGAGDTSELVAQHLKQQGVTEILVANRTLQRASEMAERVGATAHSLSELSELLPQADIVVSSTASTLPIVGKGSIEKALKKRRHRPMLLIDLAVPRDIEEQVNELDDAYLYTVDDLQSIISENIRNREQAAREAQVIIQQQTKEFNDWLKSLNSVELVREYRTHTKTLADEQLKKALAQIEQGKDPAEVLQRFSHRLVQQLTHKPTSLLKSAGENNDQYTLAVLQQLWSEPSSDSSKGK

SEQ ID NO: 1935 - protein, 214 aa, Escherichia coli
SGGEEGALKGPSIMPGGQKEAYELVAPILTKIAAVAEDGEPCITYIGADGAGHYVKMVHNGIEYGDMQLIAEAYSLLKGGLNLSNEELATTFTEWNEGELSSYLIDITKDIFTKKDEEGKYLVDVILDEAANKGTGKWTSQSSLDLGEPLSLITESVFARYISSLKDQRIAASKVLSGPQAKLAGDKAEFVEKVRRALYLGKIVSYAQGFSQLR

SEQ ID NO: 1936 - protein, 312 aa, Idiomarina loihiensis L2TR
MKLFAGNATPELAQKIADRLYIKLGEASVGRFSDGEISVAINENVRGSDVFILQSTCAPTNDNLMELIVMVDALRRASAGRITAVMPYFGYARQDRRVRSARVPITAKVVADFLSSVGVDRVLTVDLHAEQIQGFFDVPVDNVFGTPVLLEHMRQQNFDHPVVVSPDIGGVVRARAFAKLMDDTDLAIIDKRRPSANVSQVMHIIGDVKGRDCIIVDDMIDTGGTLCKAAEALKSHGAKRVFAYATHPVFSGNAVQNIKDSEIDEFIVTDSVPLSDAMKATGKVTQLTLSGMLSEALRRVSNEESISAMFDY

SEQ ID NO: 1937 - protein, 128 aa, Vitis vinifera
MRTALSVWYKLRNIEETEAAKKLLQDKRLMGRTKTEFNIPSSYSADYFQRGRDYAEKLRRECHFLLLTRYEIFAEHPELYKDKGVQDNGGGSRLPDASTEVAGRRQAATDEFMLDRFRKRERHRVMRR

SEQ ID NO: 1938 - protein, 189 aa, Triticum aestivum
  misc_feature (26)..(26): Xaa can be any naturally occurring amino acid
  misc_feature (53)..(53): Xaa can be any naturally occurring amino acid
WASSAPSVSPFPGVKSTAGLPSSRRXNGASLGSVSNGGRIRCMQVWPIEGIKXFESLSYLPPLSTEALLNQVDYLIRSKWVPCLEFSKVGFIFREHNASPGYYDGRYWTMWKLPMFGCTDSTQVINEVEEVKKEYPDAYVRIIGFDNMRQVQCVSFIAFEPPGCEESPPPPPAHLRQAIYEVPLQVCQV

SEQ ID NO: 1939 - protein, 374 aa, Clostridium acetobutylicum ATCC 824
MANKDYYEVLGLEKGASDDEIKKAFRKLAIKYHPDKNRGNKEAEEKFKEINEAYQVLSDPDKKANYDRFGTADFNGGGGFGDFSGGFGDFGDLGDIFNSFFGGGFSGGSSRARKDAPQRGNDMEYSISLTFEEAVFGVEKSINITRSENCETCGGTGAKKGTSPKTCDKCGGTGTIRVQRNTPLGSFVTQSSCDKCGGRGTIISDPCHECHGAGHVRKKRKISVKIPAGVDTGNVIPLRGQGEHGKNGGPAGDLYISIKVTPHKKFKREGFDIYIDTHISFPKAALGTDMTVPTIDGDVKYTIPAGTQSGTVFRLKGKGVQRVNGGGRGNQYVKVIVDTPKALNDKQREALKMFMEASGEAKSEKKSGFKRFFE

SEQ ID NO: 1940 - protein, 520 aa, Oryza sativa Japonica Group
MAILLLVALFYRIKKQAAAMAAKRKQQPKLPPGLATMPVVSNMHQMLMNKPVFRWIHRLLDEMDTEILCLRFGRVHVIAVASPEMAREVLRKKDAMLASRPSSFVSRTFSFGYKNTIMSPAGDQWRKMRQVLTSEILSPAMERRMLGRRVEEADHLVNYVYSHCNDGTVDVRHVTRHFCGNIIRKLVFGRRHFNSGDGNIGPGRDEEAHIDALFTALDYHGAFSVSDYFPTLVGLDLDGHEEVVNGLMNTFNRLHDPIIMERIEEWKSLRTKGDKRREVADFLDVLISLEDAQGKPFLSVDEIKAETLEIILATVDNPSNAVEWALAEMVNNPKVMKKAVDELDMVVGRERLVEESDIHNLTYLKACIREAFRLHPYHPFNPPHVAIADTTVAGYMIPKGSHVMLSRIGLGRNPRAWDKPLEFQPERHLKNTGTVVLAEPELRFVSFSAGRRGCPAVSLGTSITMMLFARLLQGFSWSIPPGGDRIELQESATSLQLSKPLFMQAKPRLLLHLYEADVLN

SEQ ID NO: 1941 - protein, 168 aa, Glycine max
MMLRAAGKRLIGAPGIRPAAAGDSSGAAMAVAARRGYHERVVDHYSNPRNVGAFDKDDADVGTGLVGAPACGDVMKMQIRVDQASGRIVDACFKTFGCGSAIASSSVATEWVKGKQMEEVIAIKNTEIAKHLSLPPVKLHCSMLAEDAIKAAVKDYEAKKTKAAKAEE

SEQ ID NO: 1942 - protein, 275 aa, Hordeum vulgare subsp. vulgare
MAAAPPAPAPAFRLGFVGAGNLAESIARGVAASGVLPASAVRTAPHRRPERAAAFASLGATILASNAQVVDDSDVIVISVKPQIVKQVLVELKPLLSEEKLLVSIAAGIKMKDLQDWSGQRRIIRVMPNTPSAVGQAASVMCLGETATENDENRVKSLFSAIGKLAAEEKFDPVTGLSGSGPAYIFLAIEAMADGGVAAGLPRDLALGLAAQTVLGAATMVSETGKHPGQLKDQVTSPAGTTIAGVHELEKGSFRGTLINAVVAATTRCRELSKN

SEQ ID NO: 1943 - protein, 295 aa, Candida glabrata CBS 138
MAKKLTGEELRKIEQHLIEFLKTDIGPILKNASGTKFDSYDEKVNDVDLVTVVDKKVETLIRKFAEENYPEIKFIGEESLSKDERFDLEDPTFIVDPIDGTTNFIHGFPFSCTSIGVAQGGKPVIGCVYNPHLNQLFHASLGNGAYLNDEPINIEKRTLSLKKSIIGLEGGSEREDGKGTNFTKKFDTYRKLLSDRGAFIHGFRSLGSAAMNICYVSIGYMDAYWEGGCWAWDVCAGWCILNEAGGKIVGGNPGQWNIPINNRSYLAVRGGLVDDDEQEKFIQDFWGFVEGALKY

SEQ ID NO: 1944 - protein, 200 aa, Fusarium proliferatum
VAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASEN

SEQ ID NO: 1945 - protein, 273 aa, Picea sitchensis
MGTLGKVIYMAGFLIRETGQAIDRFGCRLQGNHGFQEQLSRHRTLMNIFEKAPSLHRDVFVAPSAAVMGDVKVGQGSSIWYGSVLRGDVNSIMVGSGTNIQDNTLVHVAKTNISGKVLPTIIGNKVTIGHGAVLHGCTVEDEAFVGMGATLLDGVVLEKNAMVAAGSLVRQNARIPSGEVWAGNPAKFLRKLTDEEIEFILQSALNYQNLAEMHARENAKSYDEIEAYKVLRKKLARQSDDYDSHLGVVREFPPELVVPDRVIEGKLPAREPY

SEQ ID NO: 1946 - protein, 133 aa, Zea mays
KTQNSQRETTLALLRHPDCCISAYSSVVDVKRSIDNGEKRFNQLSIEERGKFDEETLVNVNSIKRNKGGSQRSSGFSNEYIVITILVAAEGVHKVPVINSSNDLKTALQKMGAIPSRKILVFLASFFLSLVIS

SEQ ID NO: 1947 - protein, 562 aa, Moritella sp. PE36
MSDKKLAVNERIKTESNFLRGTIAEGLADQITGGLSDDDMQLTKFHGFYQQDDRDIRAERQKQKLEPRHSFMLRARVPGGICTPEQWLEIDRIASDLTIYGSIRLTTRQTFQYHGILKPQVKPLIQALGSVNLDSIAACGDVNRNVMCTPNPVESALHQEAYAWAIRLSDDLLPNTNAYAELWLDGEKVHSNEVEPMYGPTYLPRKFKIAVAIPPHNDVDIHANDLNFVAIGDNGKLAGFNILVGGGMGTTHGDVNTFPRLADDFGFVKPEDAVEIAKAVLTVQRDWGCRTDRKRARLKYTLEDHGVDKFRAEVELRSGIKFETPKAIEFTTRGDRFGWIKGIDNKWHLTLFIENGRIIDTETHPIKTGLVEIAKIHQGDFRMTANQNLIIAGVAEQDKEQIERLARLYGLYSDEISQQRLNSMACVALPTCALAMAEAERYLPSLVTKVEGLLTKHGIPDEHFVMRMTGCPNGCGRPFLAEVGFVGKGPGKYNMYLGAKNNGMRLNKMYRENIGEAEILAILDTLIAEWASNALPDERFGDFVVRSDVIKPVIIAARDFHG

SEQ ID NO: 1948 - protein, 342 aa, Yarrowia lipolytica CLIB122
MFHALGSIASVVFPIFASYRAIKSHDMTYATPWLKYWVVMGIEQALENTFGVVLSVLPLYSLARLVFFAWLVLPQSQGAVRLYDEKVEPFLDRYNTQIEDFFANGHTYVRDYGLQYLSVLVKWLTGKGFDTEAAKSTSANPAPATPVVPQSYMDSVMGYIKSNSPATGGKITRLFDMYRAAGAVGGAVGSREVTETVEIPSSLPHSEQLGLIDKERSRLLAALSSLDARGSLLKSDTKSKSNASLASGVNITASDYSPLLASSSDTEFDVVKSEDVLGLDGNVKDERPNSRGWFWQRHYSKVGEANKAGYEKLVDPPSEPPVSGASMARESEEEEPLIPSNL

SEQ ID NO: 1949 - protein, 164 aa, Moritella sp. PE36
MRRIISVLTENESGALSRIVGLFSQRGYNIESLTVSTTDDDTLSRLTLVTNGDRAVVEQIMKQLNKLIDVLKVSDLTEGAHIERELLLIKVKAAGFVRAEVKRTSDIFRGQIVDITDSLYTVQLTGDSDKLDSFIKTIASQTEIVEVVRSGVCGIARGERCLKA

SEQ ID NO: 1950 - protein, 471 aa, Herminiimonas arsenicoxydans
MRRNRKAKIVATLGPASGDLETITALYEAGVDMFRFNFSHGSHEDHRARHEIVRGLEKKYGAPISILADLQGPKIRLGTFAGDSAVLKVGEQFVLDRDETPGDATRVYLPHPELFAAVAAGQNLLLDDGKVRLNIVSNKDNRIVTTVAVGGKISNRKGVNVPDAILPIPAMTAKDLVDLEFALSLGVDWVALSFVQQVSDITEARAIIGDRAGIMSKIEKPAAMLDIDAICNASDSVMVARGDLGVELPAEQVPRAQKEILKASRKYGKPVIIATQMLESMTESPVPTRAETSDVASAIYEGSDAVMLSAESASGKFPVKAVAMMDRIIKEVEADPAYLCLIDAQQVPPLPTPEDAICHALREVVKTVNAVATVTYTNSGHTSMSVARMRPTAPILSITPNVNTARRLALVWGIHSTIGKDVGSVDEMVAAAVATAVREGFAKTGERVTVSAGLPFGESGTTNLLHIATVK

SEQ ID NO: 1951 - protein, 322 aa, Xylella fastidiosa Ann-1
MPTIQDERNLMVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISAIGADRVLTIDLHADQIQGFFDVPVDNVYASPLLLADIWRAYGTDNIIVVSPDVGGVVRARAMAKRLGDTDLAIIDKRRPRANVATVMNIIGEVNGKTCVLVDDLVDTAGTLCAAAVALKQNGATKVVAYITHPVLSGPAVDNINNSELDELVVTDTIPLSDAARECRKIRQLSVAELLAETIRRIAFGESVSSLYVD

SEQ ID NO: 1952 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGYKAEFIEKVRRALYLGKIVSYAQGFSQLR

SEQ ID NO: 1953 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLLALPTDKIDPTHSYVKDIDDLSKHTLDKIKHFFETYKDLEPNKWVKVKGFEN

SEQ ID NO: 1954 - protein, 89 aa, Sonneratia caseolaris
NIKGFMIQGGDPTGTGKGGTSIWGKKFNDEIRESLKHNARGILSMANSGPNTNGSQFFITYAKQPHLNGLYTVFGRVIHGFEVLDLMEK

SEQ ID NO: 1955 - protein, 119 aa, Synechococcus sp. RS9917
MNLQPGPRVERPWGWYEDLLEGPGYKLKRLWIRDGQRLSLQRHQHRSENWTVAAGRGELFCEGHWHPATPGATLHIPCGAIHRARAGQGDLLIIEVQHGTDLRESDIERLEDDFGRVIG

SEQ ID NO: 1956 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQTFTKWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLR

SEQ ID NO: 1957 - protein, 435 aa, Ralstonia eutropha JMP134
MPPPEHCAPAIARACTSPDGWRGMLRFAGPGYLVAVGYMDPGNWATDLAGGSAYGYRLLWVIAMSSCMAVLLQILASRLGLVAGMDLAQACRHRSPRLSALAQWVLCEIAICAADLAEVLGTAIALNLLFGLPLAWGVALTVFDVLLVLVLQQRGYRRLEAFVISMVALVLCCFILMLLISRPAWPDVAAGLVPYGPTMRDPSALYIAIGIIGATVMPHNLYLHSAAVRTRALDGSPQDLRRALRFIAIDTVIALSLAFVINAAILITAAGVFFKAGRTDVAEIQEAYRLLSPLTGAAWASVVFGVALLASGQCSAVTATLAGQVVMEGFLRTRLPPWLRRLATRCVAIVPALVVAILYAERGIAQLLLASQVILSLQLPFAAIPLVRSTSSCALMREHVNPRWLAVLAWIAVAVIVSMNATMLWMLAGSPAAGG

SEQ ID NO: 1958 - protein, 376 aa, Desulfitobacterium hafniense Y51
MIYFDNSATTLIKPPEVGEAVAYAINHFGNASRSFYDAAMTASREIYRTRAAIAALVGSAEPLNIAFTSSSTESLNLVIGGLVKQEDAVITTVTEHNSVLRPLYLKGCRLDFIDCDENGVLQWDAFEELIRPETRFLICTHGSNVTGNITEVKRLYDLCRAHDLTMILDVSQTMGLIPVSGDMADVLCFTGHKGLFGPQGTGGIIVNRRLPFEIVKTGGAGVHSFAMFQQNEMPDVFEAGTLNSHSLYGLQKGVEFILHTGIEAIHSRENRLTQLFVEGIKEIEGLRLYGDFSGGNRLPVVSLNIEGLPASDLAGLLWEKYGIATRAGSHCAPLLHQRFKTVETGMVRFSFSYFNTEEEIATGSRALKTIAEEYGR

SEQ ID NO: 1959 - protein, 640 aa, Arabidopsis thaliana
MSSTFRAPAGAATVFTADQKIRLGRLDALRSSHSVFLGRYGRGGVPVPPSASSSSSSPIQAVSTKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCRRPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 1960 - protein, 603 aa, Synechococcus sp. RS9917
MTQSATHGSELSCSVDLSAATIDETSQASETHTPPDAATDARSGFDGFGFSEALLRTLASKGYQAPSPIQRAAFPELMLGRDLVGQAQTGTGKTAAFALPLLERLQPEGPGPQVLVLAPTRELAMQVAESFKAYAAGHPHLNVLAIYGGSDFRSQIHSLKRGVDVVVGTPGRVMDHMRQGTLNTSHLRSLVLDEADEMLRMGFIDDVEWILDQLPEERQVVLFSATMPAEIRRLSKRYLREPAEITIKTQEKEARRIRQRCITLQNSHKLEALNRVLEAVTGEGVIIFARTKAITLTVSENLEATGHDVAVLNGDVPQNQRERTVERLRKGTVNILVATDVAARGLDVERIGLVINYDMPFDSEAYVHRIGRTGRAGRSGEAILFVTPRERRFVNNLERATGQPIEPMQIPSNAEINQARLDNLRQKLTAVATGDGAERQADEGPLLQELLQRVAQEHSLSMEQLALAALTLAVGDQPLLVQGDESWLQNANRGRTREDRLGSRGGDRGDRGDRRRQERPSRPPEDNMERFRVEVGHRDRVKPGNLVGAIANESGLQGRMIGRIQIFESHTLVDLPKGMPQDVFQSLKHLKVMNRELQIRPFT

SEQ ID NO: 1961 - protein, 363 aa, Idiomarina loihiensis L2TR
MGFRCGIVGLPNVGKSTLFNALTKAGIEAANFPFCTIEPNTGVVPVPDPRLDKLAAIVNPERVIPTTMEFVDIAGLVKGASKGEGLGNQFLANIRETDAIGHVVRCFEDDNIVHVSGGIDPADDIDTINTELALADLDSVDKSLYRLSKKAKGGDSQAKAEIAVLEKLKPALDEGQMARSVELSKDERATIRSYNLLTLKPTMYIANVNEDGFENNPHLDKVREIAATENAVVVPVCAAIESEIAELDEADKEEFLSELGQDEPGLNRVIRGGYELLNLHTYFTAGVKEVRAWTVKVGSTAPQAAGRIHTDFEKGFIRAEIVGYDDYIANNGEQGAKDAGKWRLEGKEYIVKDGDVIHFRFNV

SEQ ID NO: 1962 - protein, 363 aa, Xylella fastidiosa Ann-1
MGIKCGIVGLPNVGKSTLFNALTKAGIAAANFPFCTIEPNVGVVPVPDPRLNQLAEIVKPQKLLPTVIEFVDIAGLVAGAASGEGLGNKFLAHIREVDAIAHVVRCFEHGEIIHVTGKVDPLADIEIIDTELILADLDTVEKACNRIMRAAKGGGKEAIARKSVLERLQVALNEGKSARSAGLDEDERALVRDLFLLTLKPVMYIANVLENGFQDNVYLEALRVRASSDNAQLVPISAVIEEELAQLEDVDRDAFLVDLGLEEPGLNRVVRAAYALLGLQTYFTAGVKEVRAWTVKSGATAPQAAAVIHTDFEKGFIRAETIAFDDFIKYKGEAGARDAGRMRLEGKEYRVQEGDVLHFRFNV

SEQ ID NO: 1963 - protein, 214 aa, Escherichia coli
SGGEEGALKGPSIMPGGQKDAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLR

SEQ ID NO: 1964 - protein, 524 aa, Oryza sativa Japonica Group
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLSLRYADTLSLCSVSFRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 1965 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGKIVSYAQGFSQLR

SEQ ID NO: 1966 - protein, 502 aa, Aspergillus nidulans FGSC A4
MLAYSRYPRAIITPDTGNKFSIHPNDIGINNVIHPSDSRLQAPQHRIGSKRKLPTYSSRGFGLAGLGVGARLAQQGLRRGADLIRRRMLIDVEITHKDDSYPWFLNWMTQYQQSQLSASRSQASGSGFVDSLLTKLTPRMRQLSVDTKTVKHSNGAINTHFTLVPGLGRHVLRYKNTFIFVNRMRESKAQELTTGRPWETMTLTTLYSHRHVFEDLFAEAHAYVVKANEGKTTIYRADTATWTPFGDPRRKRTLDSVILDKGVKERIVEDVKDFLATESWYHDRGIPYRRGYLLYGPPGTGKSSFIQAVAGELDYDIAILNLSERGMTDDRLNRLLTIVPKRTLVLLEDVDAAFSNRRTQTDEDGYRGANVTFSGLLNALDGVASAEERIVFLTTNHVERLDEALVRPGRVDMTVRIGELTRYQATCFWERFYGDLDSTGSYKQAFLERLYELGLIENENGERLDPPQSTSAAALQGLFLYNKGNMQGAIAMAEGLTYRIQE

SEQ ID NO: 1967 - protein, 693 aa, Nicotiana tabacum
MTTSFGAAINIAVADDPNPKLQIHNFSGLKSTSNSLLLSRRLHVFQSFSPSNPSSIVRAVSTPAKPAAVEPKRSKVEIFKEQSNFIRYPLNEEILNDAPNINEAATQLIKFHGSYMQYDRDERGGRSYSFMLRTKNPGGEVPNRLYLVMDDLADQFGIGTLRLTTRQTFQLHGVLKKNLKTVMSTIIKNMGSTLGACGDLNRNVLAPAAPFAKKDYMFAKQTADNIAALLTPQSGFYYDVWVDGEKVMTAEPPEVVKARNDNSHGTNFPDSPEPIYGTQFLPRKFKIAVTVPTDNSVDIFTNDIGVVVVSNEDGEPQGFNIYVGGGMGRTHRMETTFPRLAEPLGYVPKEDILYAVKAIVVTQRENGRRDDRRYSRLKYLLSSWGIEKFRSVTEQYYGKKFQPCRELPEWEFKSYLGWHEAGDGSLFCGLHVDNGRVKGAMKKALREVIEKYNLNVRLTPNQNIILCNIRQAWKRPITTVLAQGGLLQPRYVDPLNLTAMACPAFPLCPLAITEAERGIPDILKRVRAIFERVGLKYSESVVIRITGCPNGCARPYMAELGLVGDGPNSYQIWLGGTPNQTSLAKTFKDKLKVQDLEKVLEPLFFHWRRKRQSKESFGDFTNRMGFEKLGEFVEKWEGIPESSSRYNLKLFADRETYEAMDALASIQDKNAHQLAIEVVRNYVASQQNGKSMD

SEQ ID NO: 1968 - protein, 325 aa, Burkholderia xenovorans LB400
MAVFDVDEIVAALQTVRQQWREVQKRSLEPGGRELPGREALAEIVDTLKGVLFPMRLGPPDLRQESENFYVGHALDAALHALLSQARLELHYRSRHQPPPAATIEAQAGIAVRAFAARLPAIRSLLDSDVLAAFHGDPAAGSVDEVLLCYPGVLAMIHHRLAHELYGLGLPLLARIVAELAHAQTGIDIHPGAKIGAGFFIDHGTGVVIGETAVIGERVRLYQAVTLGAKRFPRDAQGHLEKGHARHPIVEDDVVIYAGATILGRVTLGQGSVIGGNVWLTQDVAPGSHVTQAVSRSEGTGTAVSAERTPRGHTDTVPVAAGAAT

SEQ ID NO: 1969 - protein, 411 aa, Pseudomonas putida KT2440
MALIVQKFGGTSVGSIERIEQVAEKVKKHREAGDDLVVVLSAMSGETNRLIDLAKQITDQPVPRELDVIVSTGEQVTIALLTMALIKRGVPAVSYTGNQVRILTDSSHNKARILQIDDQKIRADLKEGRVVVVAGFQGVDEHGSITTLGRGGSDTTGVALAAALKADECQIYTDVDGVYTTDPRVVPQARRLEKITFEEMLEMASLGSKVLQIRSVEFAGKYNVPLRVLHSFKEGPGTLITIDEEESMEQPIISGIAFNRDEAKLTIRGVPDTPGVAFKILGPISASNIEVDMIVQNVAHDNTTDFTFTVHRNEYEKAQSVLENTAREIGAREVIGDTKIAKVSIVGVGMRSHAGVASCMFEALAKESINIQMISTSEIKVSVVLEEKYLELAVRALHTAFDLDAPARQGE

SEQ ID NO: 1970 - protein, 490 aa, Valdivia gayana
SGSGVSTLEKKNSGRIAQIIGPVLDVAFPPGKMPNIYNALVVKGRDTGGQPINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIGESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLK

SEQ ID NO: 1971 - protein, 682 aa, Burkholderia xenovorans LB400
MESVLPHDVPTAPPGGVPAGLPDPATLTSLANAFFSALPGNAPQSGATPGLAGTLPFTAPATSEISNPAPAGSPLAGPGGTGTGVPGAALPQGHVPGANLLPSSPMHVLALGNRAPALAPHATAQNGLPDSVVTIAPALDPRFGGAALGVPEAHGAQRPSAGGAAPLAPAAPVSSASTSPFYFLGESGQPHSATTASPDIVVPVWSEVSAQSFGLPGVDQPLAEQRFPYDRPAAPHAAAPSKPAEHTGGSHYFLNLGEPSRSPGHAHGVPHAGPSAHPPFDVNAIRRDFPILQERVNGRQLVWFDNAATTQKPQAVIDRLAYFYAHENSNIHRAAHALAGRATDAYEAARSKVQRFIGAGSPEEIIFVRGTTEAINLIAKTWGVKHVGEGDEIIVSHLEHHANIVPWQQLAAQTGAKLRVIPVDDSGQVLLDEYRKLLNDRTKIVSVTQVSNALGTVVPVKEIVELAHRAGAKALVDGAQSVSHMRVDVQALDADFFVFSGHKVFGPTGIGVVYGKRAILEDMPPWQGGGNMIADVTFERTLFQPPPSRFEAGTGNIADAVGLGAAIDYVQRVGIENIARYEHDLLAYATSVLQPVPGVRLIGTARDKASVLSFVLEGYETEEVGQALNEEGIAVRSGHHCAQPILRRFGLEATVRPSLAFYNTCDEVDALVSVVRRLSSRR

SEQ ID NO: 1972 - protein, 334 aa, Aspergillus oryzae
MTAKVGINGFGRIGRIVFRNSFSHENTEVVMVNDPFIEVQYAAYMLKYDSTHGNFEYDVHIDGDSIVVNGKKVKFYAEKDPAKIPWKDAGAEYIIESTGVFTTVEKASAHLQGGAKKVIISAPSADAPMYVMGVNEKTYAGADVVSNASCTTNCLAPLTKVLHERFGVVEGLMTAVHAYTATQKLVDAPSKKDWRGGRAAAQNLIPSSTGAAKAVGKVIPELQGKVTGMSIRVPTSNVSVVDLTCRLEKGASYEEIITAIKEAAQGELKGILDYTEDDVVSSDMKGNPHSSIVDIKAGISLNPNFLKIVSWYDNEWGYSRRVLDLTAYIASVGK

SEQ ID NO: 1973 - protein, 78 aa, Vibrio vulnificus CMCP6
MSNLEERVKKIIVEQLGVDESEVKNEASFVDDLGADSLDTVELVMALEEEFDTEIPDEEAEKITTVQAAIDYVTANAQ

SEQ ID NO: 1974 - protein, 248 aa, Vibrio vulnificus CMCP6
MTDLLNLSGKVALVTGASRGIGRAIAETLVARGATVIGTATSENGAAAISEYLGENGKGFALNVTDAESVESVLKAINDEFGAVDILINNAGITRDNLLMRMKDDEWNDIMDTNLTSIFRLSKAVMRGMMKKRDGRIINVGSVVGTMGNAGQANYAAAKAGVIGFTKSLAREVASRGVTVNTVAPGFIETDMTRALNDEQRATTLANVPAGRLGDPREIAEAVVFLASPAAAYITGETLHVNGGMYMV

SEQ ID NO: 1975 - protein, 207 aa, Fusarium culmorum
VAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKS

SEQ ID NO: 1976 - protein, 391 aa, Candida tropicalis
MCTSANNRLDQLTQILHPENLLNPTNASHPESSLRPDHPFKIAVVGSGNWGTTIAKIVSENAVARPHLFSHFVNMWVFEEKIDGTNLTEIINTRHENIKYLPGVKLPKNLIAVPDIVKAVKGADLIVFNLPHQFLPRILKQLKGHVPKTTRAISCLKGLEVNANGCKLLSTVIEEELGIACGALSGANLAPEIARGNWSETTVAYRVPADYRGPGKDIDKLVLKALFHRPYFHVNVIDDVAGVSIAGALKNVVALAVGFVEGLGWGDNAKAAVMRVGLLETIKFAKLFFNDAEIDTFTGESAGVADLITTCSGGRNVKVGRYMAETGCAAEEAEKKLLNGQSSQGIVTTKEVHEFLTNVNKLEEFPLFEATYQITFGSESIENLPNLLNNY

SEQ ID NO: 1977 - protein, 714 aa, Escherichia coli CFT073
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIIANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSTKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIDSLTATSERSRRLSPPAFRYQLTELARKAGKRIVLPEGDEPRTVKAAAICAERGIATCVLLGNPAEINRVAASQGVELGAGIEIVDPEVVRENYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 1978 - protein, 435 aa, Oryza sativa Japonica Group
MAAAATAAVPLDEAKAKEVLRQVEFYFSDSNLPRDNFLRKTVEESEDGLVSLALICSFSRMKKHLGLDLDVKQETMPEETVLAVAEVLRRSSALRVTEDGKKVGRSIELSKLDEIMEQVDSRTIAASPFPYNVKLEDVQSFFAQYGKVNSVRLPRHIADKRHFCGTALVEFSEEEEANAVLKNTLVFAEADLEIKPKKEFDTEREAKKEAYEKSQPTKNGHDEGYPKGLIVAFKLKIIQIDGGMAENGGDKEGETDDANKSRTGHDEKIPENSDIKEDLSDDVEKSKEAAAQSVKKGESPSENADDPISREDFKEEFGKFGTVRYVDFSIGEDSGYIRFEDSKAAEKARALAAISDEGGLIMKGHLVTLEPVSGQAEKDYWSAIKGGQGKYRDNRSNRGRDWKNNRGGRHFGGKRGRHSDGHERANKARKVDAAA

SEQ ID NO: 1979 - protein, 365 aa, Moritella sp. PE36
MTVTKHNIAVLPGDGIGPEVMAEAIKVLAAVQSKFNLEFTYDFNDVGGIAIDNHGTPLPTSTLTACENSDAILFGSVGGPKWEGLPPQEQPERGALLPLRGHFKLFCNLRPAKIYAGLEKFSPLREDISSNGFDVVVVRELTGGIYFGLPKGNKGEGADETGFDTMLYSRAEVERIARIAFEAAKLRGKKVTSVDKANVLATSVLWRKVVIEIAQEYPEVELEHIYVDNAAMQLIKDPSQFDVLLCGNLFGDIISDECAMITGSMGMLPSASMNDSDFGLYEPAGGSAPDIAGKGIANPIAQILSAAMMLRYSLKQEEAAQAIEQAVSFVLEEGYATGDLHSAANAKPVQNTAQMGDLIAAKVGA

SEQ ID NO: 1980 - protein, 171 aa, Prochlorococcus marinus subsp. pastoris str. CCMP1986
MEILNELISTYKDHPKEGIDFKDVLEIVQHPIVFKELILKMASSKIVSNAEALISIDARGFIFGSAISFQVSKPMIFARKPGKLPGELIKKKYTLEYGENSLSIQKKSLNNFYSFAIIDDLLATGGTVNCVSNILKDNGKKITGLLTVVELIELEGRSKFDFPVESWLKCK

SEQ ID NO: 1981 - protein, 297 aa, Pseudomonas putida KT2440
MTASPLLTAFLPLALGIIMLGLGLSLTLADFARVVKYPKPVVVGLVCQILLLPLVCFLIANGFGLESALAVGLMLLAASPGGTTANLFSHLAHGDVALNITLTAVNSLIAILTMPLLVNLSLSWFMASDQAIPLQFAKVMQVFAIVLLPVALGMLIRHFAPAFAARMEKPMKLVAALFLAFTIVLALAKDWQTVVEYAPVVGLAALLFNLLSLTVGYWVPRLLNISKRQAIAIGMEIGIHNGTLAIALALSPSLLNNATMAVPAALYSLIMFFTAAGFGWWVSRGHVAAEPKGETVN

SEQ ID NO: 1982 - protein, 388 aa, Herminiimonas arsenicoxydans
MNIHEYQGKEILRKYGVTTPKGFPCFSVDEAVQAAEKLGGKVWVVKAQIHAGGRGKGGGVKVAKSLDEVRKYANDILGMTLVTHQTGPEGRLVKRLLIEEGADIKKELYVGMVVDRGSQRVALMASSEGGMDIEHVAEHTPEKIHKVFIDPFKGLLDSEADDIARKIGVPEGSIPQARAFMQGLYKAFDETDASLAEINPLIVTGDDRIVALDAKFNFDSNALYRHPEIVEMRDLDEEDPAEIEASKFDLTYISLDGNIGCLVNGAGLAMATMDVIKLYGGSPANFLDVGGGATTEKVTEAFKIMLKNPDIKAILVNIFGGIMKCDVIAQGVIAAAKQVDLTVPLVVRMAGTNEELGKKILAESGLPIITANNMAEAAEKVVNAAQGK

SEQ ID NO: 1983 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMNKTLKPRAVTVFVIGFWILDVANNMLQGPCRALLADLCNGDTRRMRSANALYRFFMAVGNILGNAAGSYNNLYKLFPFSKTHACDLYCANLKSCFIISIVLLIFITVLALTVVREKQWSPDEADEEPPSSGKIPVFGELLRALKDLPRPMLMLLAVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPCKDAAAKLTLSGPYH

SEQ ID NO: 1984 - protein, 537 aa, Blastopirellula marina DSM 3645
MLHFFQSQQQNFKNDILSGLTVALALVPEAVAFAFVAGVSPVIGLYSAFFLGLLTAIFGGRPGMISGATGAMAVIVVSLVAMHGIEYLFPAVILCGILQIAFGLTRLGVLIRMVPHSVMLGFVNGLAIVIGMAQFGSFQTINDLGVLTYLRGPVLWIMLALTALTMAIIWLLPKFTRAIPSSLAALLLVTIASVVLNQTLDTSLAAKNQDHVVMTVGDMLVTNAKSKAADAARGGEPTDGHGPAVVVADAELTPEVAAAIASVTPETTGLSGGLPQLFFLQYMLPPLTLATLWIILPYSLVLAAVGLIESLMTLSLVDEITETQGSGNRECVGQGIANVVCGLFGGMGGCAMIGQSLINVNSGGRGRLSGITAAVCLLAFVLFLAPWIEMIPMAALVGVMFMVVIGTFEWASIQTFGKVPISDYFVMLVVAGYTAVMHDLATAVILGVIVSALVFAWQHSKNIGADIKVNELGGKVYQLHGPLFFASVSSFKKLFDPENDPDDVVIDFYYTRVYDQSGLEAITGLTEKYEQQGNIWC

SEQ ID NO: 1985 - protein, 445 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPLADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGVRVIQSSY

SEQ ID NO: 1986 - protein, 693 aa, Synechococcus sp. RS9917
MLVGISMLVPPIVRKTGLPDLVGLLIAGILVGPNLLNWLQPGGETVNLFSDIGAIYLLFIVGLEIDLDEFNRVKNRSLTLGILHFLFGMATGTGIGIVFGFPLIPSILMGTLIATHTPLGYPIVRSYGAQRDESVVVSVGSTILTDIASLLVLAIAMGLGKGSLSAPSVISLIASVCLFAVLVVASIRTIGEKIFKSSLNDENRIFLAVLLTLFIASLGAELAGVEKIVGAFLAGLAINSVLPEGKAKQQIIFVGGALFIPIFFIHLGLLIDLNSLRQSISEFELTALMVFGVIACKGIVSFITGKLFGYNGNQVVMMWSLAMPQVAATLAAAFVGYEAGLLSASVLNGVLAMMVVTASLGPALTARSVTQLVEPDDDTNSYFVPSKRSVVASASGNASGDDLTDPPRAVDRRPLKIVVPVANPATEYGLLSMASRLLTGGSDHSGQLLPMALVCPSLEEARGSLTRAVATARERLAQATAIGATLGVPTHCLLRLDEDIAGGMSRSALEQGADLLLIGTGQPDKLRQWLFGDLVDGVCRSAHCPVVVVNLAGRDPEELQRILVPIKDLSASAREQFELAQRLLNHGGDGASGVITLLHIVDPRFNRHDRQWIERELRRWHPPGDSHDRIRIELVPGPGIDQTIERSSRHHDLVILRSQRRRVAGLPIPASDRTSGLIRQLACPTMVISEPLL

SEQ ID NO: 1987 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLR

SEQ ID NO: 1988 - protein, 494 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVVPLADATLINGKGRYLGGPAVPLAVINVQQGKRYRFRMISIACDANHHFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHPHGHSFDVVRSADNTTYNYENPVRRDVTSVAIGNQTTIRFVTDNPGPWFLHCHIDLHLEL

SEQ ID NO: 1989 - protein, 164 aa, Brassica napus
MFSAIGSLLRLIFKNLDVIAGPIISLVYPLYASVRAIESRTGGDDKQWLTYWALYSLIKLFELTFYRLIEWIPLWQYAKLALTCWLVLPGLSGASYLYENYVRSFLLSPHSANVWYVPVKKDDDDLAAAAGKFTPGEPTEKHASSVDTSAKYVGGSAFDDTYVY

SEQ ID NO: 1990 - protein, 490 aa, Ipomoea aquatica
MRINPTTSGSEVSTVEKKNLGRIVKIIGPVLDVAFPPGKMPNIYNALVVQGRDNEQTNVTCEVQQLLGNNRVRAVAMSDTDGLMRGMEVSDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 1991 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRRALYLGKIVSYAQGFSQLR

SEQ ID NO: 1992 - protein, 518 aa, Lentinula edodes
MFYFSSFLLLGPIGGALAAIGPVTDLHIVNSFIQPDGFNRSGVLAEGVFPGPLITGNKGDNFQINVIDELTNGTMLLSTSIHWHGLFQKTTNWADGPAFVNQCPIAANDSFLYNFNVPDQAGTFWYHSHLSTQYCDGLRGPLVVYDPQDPYVDLYDVDDDSTVITLADWYHVPAPQAGAVPTSDATLINGLGRSVNGPADAPFAVVNVVQGSRYRFRLVSISCDPNFLFSIDGHTFTVIEADGVNHEPIVADSIQIFAAQRYSFILTANQTADNYWIRANPNNGHTGFAGGINSAILRYSGAPVADPVTTQTSANLLQETSLVPRENPGAPGNATANGVNVDLNLVLSFVGGRFEINGVSFVPPTVPVLLQILSGATTAAELLPSGSVYTLPLNSVIQLSFNTVAVAAVGGPHPFHLHGHTFDVVRSAGSTEYNYINPPRRDVVSTGAAIDNVTIRFTTDNAGPWFLHCHIDWHLEAGFAIVFAEDAPDVAAVNPVPDAWNQLCPTYDALTPAQLGGN

SEQ ID NO: 1993 - protein, 490 aa, Ipomoea wrightii
MRINPTTSGSEVSAVEKKNLGRIVKIIGPVLDVAFPPGKMPNIYNALVVQGRDNEQTNVTCEVQQLLGNNRVRAVAMSDTDGLMRGMGVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 1994 - protein, 431 aa, Candida glabrata CBS 138
MAKKSNAKRLATKKANAATVASNAATDATEKKPESRKYNFLIRTIWTFIMIGGFFAVLASGHIWCVMLILLCQIAIFMECIAVTSGSSRERDLPLTKTLNWYFLITTIYYLEGSSLFRFLEPAFYKYTLLRMVVEHHKFICYCFYVFGVVLFVCSLRKGHLKFQFASLCITHMVMLFVVAQAYLVTKNVLNGLFWFLLPCGLVIVNDIFAYLCGITLGRTKLIAISPKKTLEGFLGAWFFTALASIILTRLLSPYMYLTCPVQDLHTNFFSNLTCDLNPVFLKQDYKTPPFIAEKYGINVITVKPIYFHALNLATFASLVAPFGGFFASGLKRAFKVKDFGHSIPGHGGITDRVDCQILMGSFTYLYYTTFINERGITIESIISTILINFNEKQIIEIVLRLNKKLLESGLLEKKEFKSIGQIYSKCADRL

SEQ ID NO: 1995 - protein, 293 aa, Arabidopsis thaliana
  misc_feature (16)..(16): Xaa can be any naturally occurring amino acid
  misc_feature (31)..(31): Xaa can be any naturally occurring amino acid
  misc_feature (56)..(56): Xaa can be any naturally occurring amino acid
KEKLRNKNQTYNNTKXIMLCCACLCCDCAAXKDASYTTITTATLQSDLHQNAKWPXTPQQCTKLPTALSNALVHYVTSEITPQQTGDVGSVSKRVLDKKSPCNFLVFGLGHDSLMWASLNHGGRTLFLEEDEAWIETVTKKFPNLESYHVVYDTKVKDSNKLMELKRTEDCKAVSDPRDSKCALSLKGFPADVYETQWDVIMVDAPTGYHDEAPGRMSAIYTAGLLARNRYDGGETDVFVHDINRPVEDEFSVAFLCGGYMKEQQGRLRHFNIPSHRASFGTPFCPADISRRF

SEQ ID NO: 1996 - protein, 490 aa, Ipomoea quamoclit
MRINPTTSGSEVSAVEKKNLGRIVKIIGPVLDVAFPPGKMPNIYNALVVQGRDNEQTNVTCEVQQLLGNNRVRAVAMSDTDGLMRGMEVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 1997 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLR

SEQ ID NO: 1998 - protein, 256 aa, Oryza sativa Japonica Group
MDEWVRQAEVWVGQAERWIRQQPPEQVYVAVAVVAVTVLLLVAVSCLKSSKANTIVLSGLSGSGKTILFYQLRDGSTHQGTVTSMEQNNDTFVLHSELERRGKVKPVHVVDVPGHARLKPKLDEVLPQAAGIVYVVDAQDFLSTMHAAAEYLYDILTKATVVKKRVPVLIFCNKTDKVTAHSKEFIKKQLEKELNKLRESRNAISSADITDEVKLGNPGEAFNFSQCQNKVTVTEGAGLTGNVSAVEEFIREYVKA

SEQ ID NO: 1999 - protein, 548 aa, Lentinula edodes
MFLINVVFGFWLLCVPTSLRLVSGVEIVKSHPRDNIWHEKTDHHDQLFIVNKDIAPDGFQRSTVLAGRTPQDASFPGPLIAGRKGDRFTINVTDLLTDPTMDRSTSIHWHGLSQKTTNYADGVAFVSQCPIATNHSFLYDFGVPDQAGTLWYHSHLSVQYGDGLRGPIVIYDPEDPHQDLYDVDDESTIITIADWFHLTSLQLLAALVVPNADATLINGNGRYVGGPDTPLTVINVEHGKRYRFRLIDMSFDAFHGFSIDNHNLTIIEVDGINTLPHTVNFIEIYPAQRYSFVLNANRPISNYRIRALSNTGVGAQNFTNGVNSAILRYVGAPEEEPQTSQPLSSDVMIFREGDLHPLENPGAPGNPYPGGADLVLNFTLGFDAEMVLFSMNGVVFESPTVPVLLQILSGAHHAQDLLPKGGVHTLPPNKVIEINFFGGDAPAGPHPFHLHGHAFDVVRTSDSSEYNFKNPVRRDTTLVAMKNQTTIRFVTDNAGPWFLHCHIDLHLSLGLAVVLAEDTRDTKKDDMIPADWKGLCPIYNSLTPSQLP

SEQ ID NO: 2000 - protein, 361 aa, Myxococcus xanthus
MALTLPDAQPPTGLLPLEQAWLQLVQTEVETSLAELFELPDEAGLDVRWTQALTQARAYTLRPAKRLRPALVMAGHCLARGSAVVPSGLWRFAAGLELLHTFLLIHDDVADQAELRRGAPPLHRMLAPGRAGEDLAVVVGDHLFARALEVMLGSGLTCVAGVVQYYLGVSGHTAAGQYLDLDLGRAPLAEVTLFQTLRVAHLKTARYGFCAPLVCAAMLGGASSGLVEELERVGRHVGLAYQLRDDLLGLFGDSNVAGKAADGDFLQGKRTFPVLAAFARATEAERTELEALWALPVEQKDAAALARARALVESCGGRAACERMVVRASRAARRSLQSLPNPNGVRELLDALIARLAHRAA

SEQ ID NO: 2001 - protein, 490 aa, Ipomoea coccinea
  misc_feature (172)..(172): Xaa can be any naturally occurring amino acid
MRINPTTSGSEVSAVEKKNLGRIVKIIGPVLDVAFPPGKMPNIYNALVVQGRDNEQTNVTCEVQQLLGNNRVRAVAMSDTDGLMRGMEVIDTGAPISVPVGGSTLGRIFNVLGQPVDNLGPVNTNTTSPIHKSAPAFIQLDTKLSIFETGIKVVDLLPPYRRGGKIGLFGGXGVGKTLLIMELINNIAKAHGGLSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 2002 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVNVILDEAANKGTGKWTSQSALDLGEPLSLITESVFARYISSLKDQRVAASKVLTGPKAQPVGDKAEFIEKVRRALYLGKIVSYAQGFSQLR

SEQ ID NO: 2003 - protein, 293 aa, Glycine max
MLRRNIRLRREYLYRKSLEGKERLLYEKKRKIREALQEGKPIPTELRNEEAALRREIDLEDENTAVPRTHIDDEYAYAAEKDPKILLTTSRDPSAPLQQFVKELSFVFPNAQRMNRGGQVISEIIESCRAHDYTDVVLVHEHRGVPDGLIVCHLPFGPTAYFGLLNVVTRHEIKDKKAIGTMPEAYPHLILDNFSTKLGDRTANILKHLFPVPKPDTKRIVTFSNQSDYISFRHHIYEKHGGPKSIELKEIGPRFELRLYQIKLGTVDQAEAQIEWVIRPYMNTTKKRKFLSN

SEQ ID NO: 2004 - protein, 406 aa, Pseudomonas putida KT2440
MSVEQAPVQRADFDQVMVPNYSPAAFIPVRGEGSRVWDQSGRELIDFAGGIAVNALGHCHPALVKALTEQANTLWHVSNVFTNEPALRLAHKLVDATFADRAFFCNSGAESNEAAFKLARRVAHDRFGPQKHEIIATVNSFHGRTLFTVSVGGQPKYSDGFGPKITGISHVPYNDLEALKAQISDKTCAVVIEPIQGESGVVPADKAYLEGARKLCDEHNALLIFDEVQTGVGRTGSLYAYQHYGVIPDILTSAKSLGGGFPIGAMLTTTELAKHLAVGTHGTTYGGNPLGCAVACAVLDVVNTPETLAGIKAKHERFKTRLEQIGQQYNLFSQVRGVGLLLGCVLTEAWKGKAKDVLNAAEKEGVMVLQAGPDVVRFAPSLVVEDADIDEGLDRFERAVATLTKG

SEQ ID NO: 2005 - protein, 301 aa, Synechococcus elongatus PCC 6301
MSSEFIEAGAADRVRILSEALPYLQQFAGRTVVVKYGGAAMKQEELKEAVMRDIVFLACVGMRPVVVHGGGPEINAWLGRVGIEPQFHNGLRVTDADTMEVVEMVLVGRVNKDIVSRINTTGGRAVGFCGTDGRLVLARPHDQEGIGFVGEVNSVNSEVIEPLLERGYIPVISSVAADENGQSFNINADTVAGEIAAALNAEKLILLTDTRGILEDPKRPESLIPRLNIPQSRELIAQGIVGGGMIPKVDCCIRSLAQGVRAAHIIDGRIPHALLLEIFTDAGIGTMIVGSGYHEAHQPWQ

SEQ ID NO: 2006 - protein, 470 aa, Triticum aestivum
MGLSSAVTWWEEWQLRLLPPVYTECKCEDYVRAAKRCVVDTPVYTECKCDMNRMFVDQYAPYSVRIEGLTSVLKLDYKDAYSELQKGLGKTFDGMYTRVGSINTGLGAGSFLLLPFLALASIVLFATSGKDGQNEKDIRVTYILLCSTTVLELWYPLLLFLYLLDPCIFNFFNGPFEGWHDMASQHNIMSLCVRKKKPTFLMKVATFNFLRELVNQHLYIQQVPIAYQITGTVRRHMEDGWKEYIRDPASYKSFSALRGQLALRMHHHQLAWSLKMPFDESVLVWHVARDLCFYQPNTSAQCQQGEAKQRGREISNYMFYLLLIRPEMLMLGAKSYLVTLASDKIVENSKGLLEPTEESLAREIFNLSPSAPDMVSNACKLAKALMELGGDERWTLIQGVWVEMLCYSASRCRGYLHAKSLGDGGECLTYIYLLWSFMGMETLADRHHMSEPLPFDSQGRHGQSAEGDMP

SEQ ID NO: 2007 - protein, 99 aa, Synechococcus elongatus PCC 6301
MATYKVTLVNAAEGLNTTIDVADDTYILDAAEEQGIDLPYSCRAGACSTCAGKVVSGTVDQSDQSFLDDDQIAAGFVLTCVAYPTSDVTIETHKEEDLY

SEQ ID NO: 2008 - protein, 565 aa, Candida glabrata CBS 138
MNINDIKELVDQVSVEDVVNCVVNKTTRYLDDTPWYNILKDYVFLIVLYKFVKKIYYYLAGYGLLKSMQLLYKSVANWIFQRLLESPLLRGSVNKEVSKAVAGMEKELIKNDDQLADFEVLPKEGLSSESINSELDKLNSILPHTSWEQGRVSGAVYHGGKELIKLQSEAFEKYCVANQLHPDVFPAVRKMEAEVVSMTLKMFNAPETGCGTTTSGGTESLLLACLSAKVYGLKHRGITEPEMIVPVTAHAGFDKAAYYFGIKIHHVDLDPVTYKVDLKKVKRLINGNTVLLAGSAPNFPHGIVDDIEGLGKLAQKYKIPLHVDCCLGSFIIAFMEKAGFNDIGSFDFRVPGVTSISCDTHKYGFAPKGSSVIMYRNSELRKHQYYVDSKWTGGLYGSPTLAGSRPGALVVGCWSTMIHMGESGYKDSCTRIVSTARKLKDHIRNKLPQLEVLGDPKLSVVSFSSNKLNIYELADRLAKSGWHLNALQKPAALHLAITTLSVPTIDTFIETLTEAVEQMSADPTSTPSTEGTSALYGVAGSVKTTGVADKLITAFLDTLYKVKSD

SEQ ID NO: 2009 - protein, 95 aa, Yersinia pestis biovar Microtus str. 91001
MEEKFGVSAAAVAAGPAAAVEAAEEQTEFDVVLASFGENKVAVIKAVRGATGLGLKEAKDLVESAPAVLKEGVNKDEAETLKKSLEEAGASVEIK

SEQ ID NO: 2010 - protein, 237 aa, Triticum aestivum
SAPQDAATMQSAENLVFGETIKGGPAATMQSAAMRNERMGVVGHDQATDATAEQGVTVSETRVPGGRIVTEFVAGQVVSQYLAPDGADPARGAAGDDTKMTIGEALEAAGYAAGDRPVEHSDAAAIQAAKVRATGQDVYIPGDLAAQAQSAADANLWAARDEEKAKLGEVLSNATAKLVAHKERNATAKLVADKEVESDDAARVASAETRNKDDKTVRPGGIAASVAAAARLNKQDA

SEQ ID NO: 2011 - protein, 519 aa, Vibrio vulnificus CMCP6
MFEFPQFSKHSVKNDVLSGLTVALALVPEAVAFAFVAGVDPMVGLYAAFIVGLVTSIFGGRPGMISGATGAMAVVMVSLVSSHGVQYLFAAIMLAGILQIAAGLFKLGKFIRIVPHPVMIGFVNGLAIVIFLAQLGQFKMADAAGGLTWLPQDQMLLMLGLVALTMAIIHFLPKLTTAVPSSLVAIVTVTGLVIGFDLETRTVVDFLRTMSGDEGATLAGSLPTFALPMVPFDLETLQIIFPYAVILAAIGLIESLLTLTVLDEMTNTRGQSNRECIGQGMANMTCSVFGAMGGCAMIGQSMINVNSGGRGRLSGIVAAVALLMFILFAAALIEMIPLAALVGVMFMVVIGTFEWATFKLARRVPKQDFFVIVLVTVVTVMTDLAVAVAVGVIASALMFAWNHAKHIYTDTRINEEGSKEYKIHGPIFFGSTANFLELFNAQQDPSDVIVDFADSRVTDHSAIEAIETLAERYSAVGKTLHLRHLSPDCRKLLDKAGSLVEINVKEDPSYKVATDVLAG

SEQ ID NO: 2012 - protein, 469 aa, Corynebacterium diphtheriae NCTC 13129
MTEHYDVVVLGAGPGGYVAAIRAAQLGKKVAVVEKQYWGGVCLNVGCIPSKALLKNAEVAHIFNHEAKTFGISGDVSFDFGAAHKRSRQVSSGIVKGVHYLMKKNKITEIDGLGSFKDAKTIEITEGNDAGKVVTFDDCIIATGSVVRSLPGVTIGGNIVSFEEQILKEEAPKSMVIVGAGAIGMEFAYVLVNYGVDITIVEFMDRVLPNEDADVSKEIAKQYKKLGVKLLTGYKTTAITDNGDNVTVEVESKDGSKKDSLTVERCMVSIGFAPRVEGYGLENTGVKLTERGAIEIDDFMRTNVDHIYAIGDVTAKLQLAHVAEAQGVVAAEVIAGAETQELGDYMMMPRATFCNPQVASFGYTEEQAKAKFEGREIKTATFPFSANGKAAGLAETAGFVKIVADAEFGEIVGAHMVGANVSELLPELTLAQRFDLTCEEIGRNVHTHPTLSEAMKEAAEGIMGHMINL

SEQ ID NO: 2013 - protein, 383 aa, Synechococcus elongatus PCC 6301
MRGGGSSTVKIADFRRSPMTRSYRITLLPGDGIGPEIMAVTVDILRAIGRQFDLNFEFEEALIGGSAIDATGEPLPEATLATCRNSDAVLLAAIGGYKWDSLPRSQRPETGLLGLRAGLGLFANLRPAAILPQLVDASSLKREVIEGVDLMVVRELTGGIYFGEPKGCFADEQGRQRAFNTMVYREDEIDRIGRVAFDIARKRGKRLCSVDKANVLEVSQLWRDRMTLLGSDYADVELSHLYVDNAAMQLVRWPKQFDTIVTGNLFGDILSDIAAMLTGSIGMLPSASLGAEGPGVFEPVHGSAPDIAGQDKANPLAQVLSAAMMLRYGLDEPEAAARIEAAVNQVLDQGYRTGDLYSEGMTLVGCKGMGDALLAALESPVSA

SEQ ID NO: 2014 - protein, 280 aa, Streptococcus agalactiae 2603V/R
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 2015 - protein, 213 aa, Vibrio vulnificus CMCP6
MSEKSQCVIVGIAGASASGKSLIASTIYNELRAKVGDHQIGVITEDCYYNDQSHLSMEERVKTNYDHPNALDHDLLCEHLEKLMKGESVEVPEYSYTEHTRTENTTTMTPKKVIILEGILLLTDPRLRDLMHATVFMDTPLDICLLRRVKRDVEERGRTMESVLKQYQKTVRPMFMQFIEPSKQYADIIVPRGGKNRIAIDVLKAHIAKLLKA

SEQ ID NO: 2016 - protein, 150 aa, Glycine max
  misc_feature (114)..(114): Xaa can be any naturally occurring amino acid
  misc_feature (120)..(120): Xaa can be any naturally occurring amino acid
KSKASFPTRRHNNDIHSIASNVERVQSMQAWPPDGRQKCETLSYLPDIDHAQLATEVEYLFRKGCIPCMEFELEHGFVHREHDRSAGSFDGGSWTTCKMPTFGCTEASQVFKEXLYRVRXACPYGFIRIIGIVNVRRVQGIGFFADKPTG

SEQ ID NO: 2017 - protein, 567 aa, Prochlorococcus marinus subsp. pastoris str. CCMP1986
MSRKSELLKGEETKNFSEFSQLADFSLMNSLNADPHSTKDGNDHRARSVNSGHYVPVTPTPIPEPIYVSHSKTLFKELGLSSDLTKDKNFCRFFSGDIEVAEYPMRPFGWATGYALSIYGTEYTQQCPFGTGNGYGDGRAISVFEGLFNGKRMEMQLKGGGPTPYCRGADGRAVLRSSVREFLAQELMHALGIPTSRSLTLYVSGTEIVRRPWYTEGSRYFEPDIMVDNHAAITTRVAPSFLRVGQLELFARRVRSNSHDDAFNELKIIVQHLIDRNYRDEIDPSYSFNEKVIRLANLYRGRLISLVTNWMRVGYCQGNFNSDNCAAGGFTLDYGPFGFCELFDPRFQPWTGGGEHFSFFNQPFAAEINFKMFCSSLLPLLLENKEDIEKLEKIKNDFSKFMSKEMQLMWAKKLGLEKYDETLTNELFNLMVNSKVDFSIFFRKLSHIPDNISFLKDSFYLPSSEELDKEWFIWLKKWQDCINKQGDLKEISKSMKQVNPKFTWREWMIVPAYQEAEEGNYNKIKELQTIFKNPYEEESLEIEQKYNRLRPREFFNKGGVSHYSCSS

SEQ ID NO: 2018 - protein, 363 aa, Arabidopsis thaliana
MTITNLPSDLLEEIFSRFPLNSMRAVRLACKTFYTLSKCKSFAKLHFGKETTTTKEGESQMILLMDYNLYLISVVVDGDPYIECKDTRLVVWNPYWGLTRWIEPRYSHHLIGCARFSYALGYVGNISCRSHKLLRFIDYFFHGPELEWYEIYDFESGLWTTLDVTPHWCISLGSHGISIKGNTYWSAITRNSRSHGLTIYDHDHIICFDFTSERFGPLLPLPLNAEYYGDVILSSVKEEKLAVLQQQNRANPYMFDIWITINIEPGHVLWTKFLKVDMETVMETPFKSSESFFIDEKNKIVMSFDETLNPYTISIFGEAGYYRVVNLEQHANTWSRSQMCTYVPSLLQIKQLPLIQVEKCFII

SEQ ID NO: 2019 - protein, 611 aa, Nicotiana benthamiana
MPAWWGKKSTKNKETQSKEKERDKYVKPRSFDEVLCRNSPRNSKDLNLGGSGSGFSGSGFSGFDSGSSLDKAHPLPRPSVGNDQGVVLGCGSVSVSSTSSSGSSDGPVNTTDQAQFDILFRGNGDNRLSPLSRSPVRSRGTTTTSSPLHPRFSSMNLDSPTGKLDNDVSSESHQLPLPPGSPPSPSALPNPRTCGVAEGSNVNMSKWKKGKLLGRGTFGHVYLGFNRENGQMCAIKEVRVVSDDQTSKECLKQLNQEIILLSNLSHPNIVRYYGSELDDETLSVYLEYVSGGSIHKLLQEYGAFREPVIQNYTRQILSGLSFLHARNTVHRDIKGANILVDPNGEIKLADFGMAKHITSSSLVLSFKGSPYWMAPEVVMNTSGYGLPVDIWSLGCAILEMASSKPPWSQYEGVAAIFKIGNSKDFPEIPDHLSNDAKNFIKLCLQREPSARPTASQLLEHPFVKNQSTTKVTHVGVTKEAYPRSFDGNRTPPVLDSGGRNISPTKGNYASHPVITISRPLSCPREIVKTITSLPVSPTSSPLRQYEPARRSCYLSPPHPAYGIGGHSGYDENDYLMFQARPTTRNTLEPWLEIPQFKVQTPSRSPKLRPIL

SEQ ID NO: 2020 - protein, 378 aa, Methylococcus capsulatus str. Bath
MFSPSKSRKILRDHVSVVLGWLIWIILLLSGHKFGRGDSLAVLAAGSALTFCTMLGCVFSVVRQADELAELLEEPYGTLVLTLSATAIEVSLMLMVMAGGGQNPSMLRDTIFATLMVVLNGMVGVSLVSGGWINVEQSFNLRGALSFLHLIAPLSLLLLVLPNYTSSTGGPTLAPVQEAFLGILCLLVYGVFLIIQTGRHRSYFANMSAVLDEEPENDGTAPTLRSRRGAILRTSSGLLAALLPVVLLAEHLGSVIDFAIEESHTPAALGGLVVAALVLLPEGVGAQRAAALNLMQRAVNICLGSALATIGLTVPTILLAASLQRHSLTLGLNGAEETLLYATLLVSVMTFISGFANVLQGMVHLMLFVAYLFFVFVP

SEQ ID NO: 2021 - protein, 257 aa, Oryza sativa
MAGGGDDLKMLGVYVSPFPLRVKLALSFKGLSFEYVEEDLHNKSDLLVSSNPVHKRTPVVIHNGKPISESMVIVQYLDEASPGAGAALLPSDPLDRAVARFWASYVDDKVIRMITVHQFSHASFSDDFGADRMMQLFSAWKMVFKGKTEEEKVEGRKQTFAVAETLEGALRECSKGKPFFGGDAVGYVDVALGGFVPWVHAMEELFGLKQFDAAKTPLLAAWLERVGELEAYKAVMPDAGMMIEFKKKQAQEAAAEA

SEQ ID NO: 2022 - protein, 614 aa, Solanum lycopersicum
MPAWWGKKSTKNKDLQAKEKEREKYVKPRSFDELLSRNSPRTSKDFSGSGSGFSGFDSGSSLEKAHPLPMPSVSSLGNDHGVVLGCGSVSVSSTSSSGSSDGGGPVNTDQAQLDTFRGLGDNRLSPLSRSPVRSRGTTTTSSPLHPRFSSLNLDSSTGKLDDVRSECHQLPLPPGSPPSPSALPNPRPCVVAEGANVNMSKWKKGRLLGRGTFGHVYLGFNRENGQMCAIKEVKVVSDDQTSKECLKQLNQEIILLSNLTHPNIVRYHGSELDEETLSVYLEYVSGGSIHKLLQEYGPFREPVIQNYTRQILSGLSFLHARNTVHRDIKGANILVDPNGEIKLADFGMAKHITSCASVLSFKGSPYWMAPEVVMNTSGYGLAVDIWSLGCTILEMATSKPPWSQYEGVAAIFKIGNSKDFPEIPEHLSNDAKSFIRSCLQREPSLRPTASKLLEHPFVKNQSTAKVAHVGVTKESYLRSFDGSRTPPVLELHPGGRTISPGRNISPAEGNYASHPVITVSRPLICARENVKAITSLPVSPTSSPLRQYEPARKSCYLSPPHSSYGIGGQSGYEANDYSMFQTRPSTRITLEPWLEIPHFRTQTPSRSPKTRPIL

SEQ ID NO: 2023 - protein, 513 aa, Zea mays
MANIDMAKILADLDRGAGDARLPKTKLVCTLGPASRSVPMLEKLLRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 2024 - protein, 998 aa, Cryptococcus neoformans var. neoformans B-3501A
MDRLQRTRSQHFVSSPRKTASPLIARHTLYPRHPPKKRRLGVTTFVASHNEAGQNYSNELEDDLEKAIMKTGESSSAPARRTSRSRSQSRPVRRKSNDKVWADSLPNGQDGEDAASPKKRKRSRAGSLSTEDSWVETSGDEWEPDFIAESDRNMIHYAPSTALHRLRKAELVRLWRVAGMWDSEDIPDDMNEDETIGDMGKKELVDGLISARKHQTGRLISPLPSSPNRLIRRQSTLSPIPATPPPSSPLAESSSPDVTPKPRPRTRSRVRLETPVVRRQPRPSRPTRTLTKRHTKSEARSRRVRAQLTKKVNGKSENGDEIELTESSDSDDDVNGIESTPIVKRLRPRGVGERKSFMKEPSTDITDFEDDAEEADAEATEVEEEPQPKERKLRRKSISQASLSKYGGDIDMAPTSEQRSSKNLPTRGAKKKAIQRMQGGESGTEDEDMEVDEERDIGMKEGTPTPQPAIPPRRGRASRSSTPKLDEDSAMVGSPTPSVATETETSTPRPVHTTRSGKTFGAIQNRRRQLLQEARNDPDMDEEDESDEEDGEPELDIDLSEATVASLIRLLRDELVQMCETRGIEVGGTKPQLAKALLEWRDEQKGSYPSSASTARPSPPRTAMPRRKSKSKSKTKSKFKSNKHVPAIGTAAHAPGKPTPVLLRSHIHANDPETPPLSKGEEGDVEEEKKGTEAELNLDLQELGLEDSVIKPSQLIKLEKIGSGGFKDVYVGKFRGRKVAISEFRSHLSEMDIRELKLLAEFSHPNIVRFVSPFLSSERIIAYIEQRGICIPEDSTHVPCMLVSELCENGDLFDYIRNVPCPTLKRLLSLMLDIARGLEYLHTRKPSIIHRDCKSSNILINRSGVAKVGDFGLARVKNSTRSMIRSLVGTVNWQAPELWHPTPRYDYKVDVFSAGMVYWEMMSGWIGEKKYPWEGHNEHYIYDAVGTKHRRPPVTGMRKHWGSEPVNLMERMWHQDPAERPTMTDVVHDLESILAELK

SEQ ID NO: 2025 - protein, 354 aa, Triticum aestivum
METRTLRALLPPSLEVEEVLAAGAMRYTRHELEALSGAPSREAQALRWAEVYAALAAAGFSGDYDGLLASDEPLTRRGKKVSGGGKKRPEAAAHQLSEMGAWRNGDSGVHQATGEPFDQGGDVEYEDDSDDEYDGILKPAFAVDGEPDFESGEPLDGFEYLRRVRWEANQIPKVKVAKIDLSAARKEQTPYMPEIPDIPKCSPDLCASKEWEDSFITYFSETRLAFLELDSSDGPSVSGAVKNSCKPGISFEPQIDPTLTMIRKMDAVSRAATLRNYIDMIQSFDTLSRNDCLWLFALCVAVEPPLDAETCASLRSMLRKCSTILATKSEMDDEVVMLNILVAISGVYFGQYEK

SEQ ID NO: 2026 - protein, 234 aa, Zea mays
MVVNKFGAGPTLSIQQARNLAPPRKNQISSERRRLRRVRGNDEGVGASGERKSMLKFLSKVVVEYCPLDPRKAAAVELLAQCNGRKAKDSNPACSVELRRLPSPAPSTDLKSQPTLPPPRVLVTYFTGAEEAIVFAEGATAQGIRDQIVARGRLIDTEKMFRDGGEKWPVVIPEEELGMSFPGIKDSRALEGGLWWRHGVEAGATHWRVEARVEASAAATRWSRGPPEQRAAME

SEQ ID NO: 2027 - protein, 214 aa, Escherichia coli
SGGEEGALKGPSIMPGGQKEAYELVAPILTKIAAAAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLR

SEQ ID NO: 2028 - protein, 522 aa, Lotus japonicus
MLVELALALLAIALFLHLRPTPTAKSKALRHLPNPPSPKPRLPFVGHLHLLDQPLLHHSLIKLGERYGPLYSLYFGSMPTVVASTPELFKLFLQTHEASSFNTRFQTSAIRRLTYDNSVAMVPFAPYWKFIRKIIMNDLLNATTVNKLRPLRSQEIRKVLKAMAHSAESQQPLNVTEELLKWTNNTISRMMLGEAEEVRDIAREVLKIFGEYSLTDFIWPLKKLKVGQYEKRIDEIFNKFDPVIEKVIKKRQEIIKRRKERDGELEEGEQSVVFLDTLLEFAEDETMEIKITKEQIKGLVVDFFSAGTDSTAVATDWALSELINNPRVLKKAREEVESVVGKDRLVDEADIQNLPYIRAIVKETFRMHPPLPVVKRKCVQECELNGYVIPEGALILFNVWAVQRDPKYWEGPSEFRPERFLTAEGGATSIDLRGQNFELLPFGSGRRMCPGVNLATAGMATLLASVIQCFDLQVVGQKGKLLKGSDAKVSMEESPGLTVPRAHNLMCVPLARTNVTSELLSS

SEQ ID NO: 2029 - protein, 313 aa, Methylococcus capsulatus str. Bath
MARTVLIVGCGDIGRRVARLESAEGRGVYGLARSPETAARLVRQGITAVHGDLDKPDSLAGLNGGWTTLYYFAPPPAAGDGDPRLAVFFEALPVRCLPGKVVYVSTSGVYGDCGGDWVDEERPPRPQTARSRRRLAAEEALMAWSRRYGVTVVILRVPGIYGPGRLPLERLCAGVPVVRQEESPYSNRIHADDLAEVCVAAGTRAAAEGVYNVSDGHPTTLTDYFHAVADHFGLPRPPAISLAEARRVLSPEMLSFVEESKRLDNGRMLRELRPRLHYPDLERGLPACSGGHPQGFQVAPCADGLRVFGHRPT

SEQ ID NO: 2030 - protein, 352 aa, Streptomyces tendae
MNDDASPQTGVLSWFPVGLPPRQRVIGLFVAKWTIGALRPLVQLKVPDLLAGGPRTAAELAAATGTDADGLYRLLRAVAGAGILREDAEGRFALTPAAEGLRSDAEDGVREMFLFACDPMMWRPYEDLLHTVRTGQPSFDRAFGMSFFDYLRADPDSARLFDQAMVQNHYPGTDRIFEEFDFSRFPRIADVGGGRGQFLAEVLSRHPDCSGAVCDQAQVIADAKAEFERRGVADRASVVETDFFTRVPAGFDAYFIKHTLHNWDDRDAVRILTRVREAIGDRGAARLLIVDMLLAGPGEWDLGKLTDVEMMAALGGRERDRQEWDRVAAAAGFAPANDPPPNGLALLEYRPV

SEQ ID NO: 2031 - protein, 214 aa, Escherichia coli
LRGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLR

SEQ ID NO: 2032 - protein, 1507 aa, Candida glabrata CBS 138
MSSSSEISVAGSDVSFEGRLTQHGRHEETPADQLTKILSGRSHEDADGDDAHSDNRSILSRSRRSSTAELSPEMVGRVQSLADVLSRHTSRSGGNIDLSQLSESDRFDAERIIGSFVRDADEQGIHLRKAGVTLEHVSARGADSTAMEGATFGNVLCLPYTIYKAIRDKSGSKMRTILNDVSGLARAGEMVLVLGRPGAGCSSMLKVTAGEIDQFAGGVEGEIMYDGIPQKEMMKRYKPDVIYNGEQDVHFPHLTVQQTLDFAIACKTPSKRVNDVSREEYIASTRDLHATIFGLRHTYHTKVGNDFVRGVSGGERKRVSIAEALVTKGSIYCWDNATRGLDASTALEYAKAIRITTNLLGSTAFVTIYQASENIYETFDKVTVLYTGRQIYFGPIDEAKDYFYRMGYECPPRQVTAEFLTALTDVNGYHKIRPGYENKVPRTAEEFERYWQESPEYRQLLIDIDQYKKEIDTEKTKEIYDQSMQQEKSKHARKKSYYTVSFWEQIRLCTKRGFQRIYGDKAYTVITICSAIIQSLVSGSLYYNTPSSTSGAFSRGGVLYFCLLYYSLMGLANLSFEHRPILQKHKIYSLYHPAAEALGSTIANFPFRMIGMTCFLIIIYFLSGLNRTASSFFRVYLFLTMCSESINALFELIAAGCDNISQANSISGIVMMSISLYSTYMIQLPSMRPWFKWISYILPIRYAFESMLLAEFHGRHMGCGGTLVPSGPGYENIASENQVCAFVGSKPGQSWVLGDDYLRLQFEYEYKHEWRNFGIMWCFLLGYIALKALITEIKRPVKGGGDALIFKKGTRKYHMKLDEEDGELHEIDTKEKFSSRSGSSTTSEDEIFEELESKGIFIWRNVCYTIPYDGGMRQLLDNVSGFCKPGTLTALMGESGAGKTTLLNTLAQRNVGIITGDMLVNGKPIDISFERRTGYVQQQDIHISELTVRESLQFSARMRRAQNVPEEEKMEHVERIIKVLDMEEYADALVGDVGRGLNVEQRKKLSIGVELVAKPDLLLFLDEPTSGLDSQSSWAIVQLLKKLAKAGQSILCTIHQPSATLFEEFDRLLLLKKGGQTVYFGDIGDNSKTLLSYFERNGARKCSPSENPAEYILEAIGAGATASVTEDWHQIWKNSDEFISTEKEVDHLIDQLSNQKTESEFGDAPTKYATSYAYQFKWVLIRTSMSLWRNLDYIMSKMMLMTVGGLYIGFTFYDPGDSYTGLQNTLFAAFISIILSAPAMNQIQARAIAARELFEVRESKSNMFHWSLLLITQYLSEIPYHFLFSAIFFVSSYFPLRTHFQASASAVYYLNYSIMFQLYYIGFGLCVLYMAPNLQSANVILGLCLSFLIAFCGVVQPVSLMPGFWTFMWKTSPYTYFVQNMVGILLHNKPVICRKKELSIFDPPAGQTCQEFTQAFLDKRGGYIANPNATTACEYCIYEVGDDYLKHISASYSYLWRNFGLYWAYIGFNICAMVAIYYIFHVRGVSFKFDRVFKLFSRITRRGKKSN

SEQ ID NO: 2033 - protein, 451 aa, Pseudomonas viridiflava
MDAALARLESWRQAQSERLSHCAPVQIRGRIAGVNGILLNSYMPRARIGDLCEISRADGSEVMAEIVGFDRQHTLLAALGPLDGIAIGAPVRPLFQPHSLVVGEFLLGAVLDGFGRSLSGDGPSAFALSGAVGAQPVIRDAPPATERPRIDTPLSTGLRSIDGLLTLGEGQRVGIFAGAGCGKTTLLAEMARNTPCEAIVFGLIGERGRELREFLDHELDEELRQRTVLVCSTSDRSSMERARAAFTATAIAEGFRQQGKSTLLIIDSLTRFARAQREIGLASGEPAGRGGLPPSVYSLLPRLVERAGRTHDAAITALYSVLIEQDSMNDPIADEVRSLLDGHIVLSRKLAERGHYPAVDILTSLSRTMSNVVGTEQVHGATQVRRLMAAYQQVEMLIKLGEYQPGNDPLTDFAVQSRDRIMGFLQQSLRDPVSLDETLDHLIQVTADVPR

SEQ ID NO: 2034 - protein, 329 aa, Aspergillus nidulans FGSC A4
MILLQWSWQILINCDTECEMAHHELQECLVSDTIGTETVHIPAEDNAGVPSDDTMPTAMYGWLDTNVPADLMAFTHTPLPEENSPISVERYGDGNATRPWYTVAQYLLELVEWLQGSISFETTVVSVEKTWSGKWRLTLRRPEAVEGGKRDLWWQEEFDAVIVATGQYSEPFLPKIPGLDRVVNTHPETLEHVNAVRSREQYASKRVVIVGGSFSASDAVGDIYMLVRGPLYVSRSSHSPYITEIWNLSNVEVRPTIGQIEGQDRTKLKLTFSDGSKLDDVDKLIFATGYRFSVPFLSHQPVIKADRVPGTYQHVFRIGDPSLAFSRAC

SEQ ID NO: 2035 - protein, 282 aa, Oryza sativa Japonica Group
MAGGGQAAASLLTKLAQAAAGLGIAASAASTALYTVDGGQRAVIFDRFRGVLPETSSEGTHFIVPWLQKPFIFDIRTRPHSFSSTSGTKDLQMVSLTLRVLARPDIDRLPDIFTSLGLEYDEKVLPSIGNEVLKAVVAQFNADQLLTERPHVSALVRDSLIRRAAEFNIVLDDVAITHLAYGPEFSQAVEKKQVAQQEAERSRFLVARAEQERRAAIVRAEGESEAARLISEATAAAGTGLIELRRIEAAKEIAGELARSPNVSYIPAGDSSQMLLGLSGAR

SEQ ID NO: 2036 - protein, 214 aa, Escherichia coli
SGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLR

SEQ ID NO: 2037 - protein, 253 aa, Roseovarius nubinhibens ISM
MHPSQLFDLTGRIACVTGASSGLGQHAASLLARAGARVVGVARRAEALGAWRDDLGPDRAAAIAADLSDHDALGDVARAIAAPFGAPDIVVHAAGLNTRQPADEVTQEGWDATLAINLTAPFFLSQALVPAMRDRGWGRIVNFASLQSSRAFPGGIAYGTTKGGVTQLTRAMAEAWSPHGITANAIGPGFFPTELTQAVFSDPDRAARNAAQTCLGRNGTLADLDGPLLFLCSEASSYVTGQLLMVDGGFTAK

SEQ ID NO: 2038 - protein, 469 aa, Oryza sativa Japonica Group
MDMAACVDDVGKPRASRKVCVIAAAAAAKPVRVHSSMYASLRLLGPREVMGFSDFQFVPARKSRCGGGDNPGGRDPRRFPGHREVYLYLRDFYRAAGLTDSVRFNTRVVRVAVAPPPCRGGPGDALRWVVRSMDAGLWKRCTDDQMAEAHCVEEVFDAVVVATGHYSQPKLPSIQGMGDWKRRQMHSHWYRVPDSFRDEVVVLVGCGDSGMDIALDLLAVAREVHLSAKSVEAAATPAMSKMLARHANLHLHPQIERLCDDGRVVFADGGGGVVAADTVMYCTGYRYSFPFLDTEGKVAVDDDDNRIGPLFEHTFPPSLAPSLSFVGIPRKVMVPWFFEAQGRWIAGVLSGRRALPSEEEMTRSVEEFYRARELAGVPKAHTHDVEPHKMYELGEKYCDFPRTEEWKRELMAIISRNTSDDMETFRDRDDDSDNVRRCLQEWYALAEHQAQDEEDPAAAAAQAPVHSSL

SEQ ID NO: 2039 - protein, 130 aa, Oryza sativa Indica Group
MYQAIPYNANRAWPAASRPATAAPPPPPPRGEEEEVRRAVAECPVVVVGRSGCCLSHVVKRLLQGLGVNPAVHEVAGEAELAGVVAGGGGVALPAVFVGGRLLGGLDRLMAVHISGELVPILKEAGALWL

SEQ ID NO: 2040 - protein, 318 aa, Oryza sativa Japonica Group
SRASSTCGGSSGFRRDGKEVKAVVSPGAAAGANSGSPILASPHPPLPRRRAEIRTREGDPEDFKEDSVGASQDVGSSDHESPLHSPVSYNPPIGCLQQKHCSGNGGGRSFSSGSSAWSSSRSVTDSDDDTGGSPENDDDGVLDDWEAVADALSVDDNHNHQDPVPADPPVVPASCPVPANAATRQEPIKSSTRAWSPDDAFRPQSLPSLSKQVSFPASMGNCWVAMGIGSAQKGVPSKPTSCPICYEDLDPTDSSFLPCPCGFHLCLFCHKRILEADGRCPACRKQYISASSGGETVGSEREMGNLRLSRSCSMGPRY

SEQ ID NO: 2041 - protein, 131 aa, Arabidopsis thaliana
  misc_feature (47)..(47): Xaa can be any naturally occurring amino acid
GILSSGPDQRVRKKQEEVWVSFLSSSTVGVTSRVKATMVVPLTGWKXSVFFRATRRANNDITSITGNGGGVSCMKGGPPIGKKKLGTLFYLPDLRDVEWAKEVDYLFRTRGIPGVEFKWKHGFVYRKHGNT

SEQ ID NO: 2042 - protein, 679 aa, Vitis vinifera
  misc_feature (307)..(307): Xaa can be any naturally occurring amino acid
  misc_feature (368)..(368): Xaa can be any naturally occurring amino acid
  misc_feature (372)..(372): Xaa can be any naturally occurring amino acid
  misc_feature (465)..(465): Xaa can be any naturally occurring amino acid
  misc_feature (474)..(474): Xaa can be any naturally occurring amino acid
MMRTVQWLLQISLLLWLSKGLAATQAKPGCQEWCGDVDIPYPFGIGSSGCYFDEWFEVTCNNSTDPPKPFLKGVNLEVLNVSLHGTVRVNNPVLLSQNCSGKPSNDTQWWEGGPFSFSNTYTRFTAVGCSAMAYFMQDDTVIGGCMTLCKKDVATAAKNASCYGLECCQTQVPPGLLSFTANLDTFPEGSADEQEPCKYAFMVDQEWFISNVPDPHTVKDMEYVPAVLDWRIYNATCDASTSNLNTSTSFCGENTFCSTDTQTSSLTCSCPLLYEGNPYLPQGCQVITIGSLGTLLLVLCAWWLYIXLKRRKKIKYKEKCFNRNGGLLLEQQLSSSEGNIDKTKLFTSKELEKATDRYNENRVIGQGXQGTXYKGMLMDGRIVAVKKLKIMSDSKLEQFINEVVILCQINHRNVVKLLGCCLETEVPLLVYEFIPNGTLSEHIHGQNEEFPITWEMRLRIATEVXGALSYLHSXASIPIYHRDIKSTNILLBDKYRAKVADFGISKFVAIDQTHLTTQVQGTFGYLDPEYFQSSQFTEKSDVYSFGIVLIELLTGKKPILSIASEEGKSLASYFILSMNEDRLSDLLDAQVVKESRKEEINAIAFLARRCINLNGKKRPTMMEVAMELERIRKCQGDFRAQENFEEIEYNTTELIGPWDVTSISTDSCLNTNASSSSDV

SEQ ID NO: 2043 - protein, 193 aa, Triticum aestivum
KQARVLPPSSLYPYIVQPWPPPVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 2044 - protein, 688 aa, Oryza sativa Japonica Group
MANTTLSSLLFLSMASALFLLTLLRILRSKKQQRRLRLPPSPPSLPPLHRALSGLAATHGPVLLLHFGSRAVLHVTDPAVAEECLTDHDVTFANRPRLPSSCHLSNGYTTLGSSSYGPNWRNLRRIATVEVFSAHRLLRSADVRGGEVPHMARWLYLAAPAAGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMETVEEQAREVQRLKDQLARNTKNQEELKASLKDELMKEIQTMMLEQSKKPLTPGVIHSYCVHKANLDSNTSNEEADRSNVNNSDATALHTQERPVHTPETTNEIDPKSVITSEKENRPPTKQNIPTSNVTANKENMDPTTCKYRVSKVTKSSFTENAGKGTAAKYISSKQLLSGALTRASKRKQLV

SEQ ID NO: 2045 - protein, 462 aa, Streptococcus agalactiae 2603V/R
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNALTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 2046 - protein, 192 aa, Brassica napus
AGLLAWAADVVGKNGKDGGGDEEEDQIPLVLTEEQQRYVDELGRKATTLSRSIQDLRLRLPPPDISQRLPHLLAHSLASNAALALQLDSHSATREQAQVREQTLLEDAQASLDERYYKSSSESRVPPADDTEAVKSVMLEKLESKKNDLSSMEEKVQELERSWAAIQERALNHPSPARREKTLDKQLHTLIE

SEQ ID NO: 2047 - protein, 1688 aa, Arabidopsis thaliana
  misc_feature (1231)..(1231): Xaa can be any naturally occurring amino acid
  misc_feature (1239)..(1239): Xaa can be any naturally occurring amino acid
MGQKRLLFLLAVFTFLVSSSYGRGVLKLKSDDDRPVYNHTLAVTLVEYASAVYESDLTKLFTWTCERCNGLTKDFEVIEVIFDVEHCLQAYVGVAKDLNAIIIAFRGTQEHSIQNWVSDLFWKQLDLNYPDMPDAMVHHGFYSAYHNTTLRPAVLDAITRVKKVYGANINIIVTGHSMGGAMASFCGLDLVVNEGEENVQVMTFGQPRVGNAAFASYYSLLVPNTFRITHDRDMVPHLPPYYYHFPQKTYHHFPTEVWVKDFSFSNFVLFGLEKVCDNTGEDPTCSRSVRGNSISDHLRYMLISSLEQEKARWKRRFGGFNVWRKNKGSLILCDGKRRLCWESDDCGTRKNLKHKTILGFRIRKRCFLCQRLTHEKSVCPFATVGNTRDSEEDHRSVDSGFLFGKKCLLKPGEMIVPTKLSSISTHQEYSILPEVNDIPNHETGDSKRSSHPSGNLDYPTSKGFLFGFNESGSSGLSIKQKNPRKRKALLVHKRQDSFAGIKEKEVSLNIEFASAIKRNKKITDSERSDSTVKSLITVVPQEPPQWLGYGYFHTIEPEGKSGGLAIFWNQHLHIEFLYEDKNLLDLEISQGCKRWFISCVYGNPRQNLRHLLLDKISNIGVNRMAAWSLIGDFNDILSNKEKIGGPSRVESSFQDFKNMLSTCDMHELSSTGNSFTWGGKRNEENGFNWFSLFPNSHQWFLEKLGSDHRPVLVKFVNDQELFRGTFRFDKRFAEDPQYQDVIHKAWIGNISSHNSSSMHRLVDCRKSISHWKKGKDYNAENRIKRLRFELDEEKSYQFPCWNKISVIQNQLGIAFREEESFWRLKSRDKWMAGGDKNSKFFQASVKANRIKNCLSFLVDENGIEHTLNKEKGKIAEQLWICSPLLILQIWIQSWKKITEQEIYNAVFSINAESSPGPDGFTATFFQTHWNLVKNQIIADIMGFFETGILPEDWNHTHLCLIPKISNPERMSDIRPISLCSVLYKIVSKILSARLKKHLPAIVSPTQSAFVAERLASDNILLAHEIIHNLRTNDKISRDFMVFKTDMSKAYDRVEWPFLKGILRALGFCNQWIGWIMGCVSSVSYSVLINGQPYSHFLPQRGIRQGDPLSPFLFVICTEALTHILNQAERCGKITGIRFNDAGPSVNHLLFADDTLIICKASQEECSQIMHCLSQYGHISGQMINVEKSSVTFGNKIEAETKDWIMHRSGIHVEGGTGKYLGLPECFSGSKXDFWWNMLXEKKKIHWIGAETLMLPKVLGGFGFKDLQCFNQALLAKQAWRLLSDKDSLLSQILKSRYYLNSEFLSATKGTRPSYAWQSILYGRELLRKVKSRYDLSSSQNHKEMFHKAHEQPSVNPIFQGIWSLYIAPKIKIFLWKAVKGAVAVEERLRTRGILINDGCSICPEENETINHVLFQCSLARQVWALSLMQSPPSGFGNSIFTNMNHVLHNCKNQSILRLMRYASPWIIWTLWKNRNKSLFESDVSISNSIVQKAFEDWNHWLSAQDPKTQSEDTKKEMKWIPPPWNELKCNIGVAWSSKTQLAGVSWVVRNDTGEVLIHSRRSYSQVHSNFEAKLKSWEWALESMDKLHVDRVTFGASSHDIIKAMNKPGEWPALRGHLDALLDLTLDKPHWYMAMELRQCNTGANEIAKSVITGLRWQSYVAKGPPQWLHYLFDSELIHQRSRCLSPL

SEQ ID NO: 2048 - protein, 363 aa, Prochlorococcus marinus subsp. pastoris str. CCMP1986
MLKAGIIGLPNVGKSTLFNALVENAKAQAANFPFCTIEPNKGIVSVPDQRLQELGSLSSSQNIIPTKIEFVDIAGLVKGASKGEGLGNKFLSNIREVDAIVHVVRCFEDTEVIHVSGKIDPLDDIEIINLELNLADLSQLQKRRERIKKQVKTSKEAAQEDSLLEKIEDELQKGLSIRSISLTDEENLMIKQLGFLTAKPIVYATNLNENDLAEGNDFSSKVQSFANSENTECIKISAQVESELIELEPEDKKDYLMGLGVEEGGLKSLIKSTYKLLGLKTYFTTGEKETKAWTIKDGMTAPQAAGVIHTDFEKGFIRAQTISYQNLIDSGSIVNAKNKGLLRSEGKEYVVNEGDVMEFLFNV

SEQ ID NO: 2049 - protein, 466 aa, Bacillus anthracis
MKVLKNGGSAVDAAIVVSYVLGVVELHASGIGGGGGMLIISKDKETFIDYRETTPYFTGNQKPHIGVPGFVAGMEYIHDNYGSLPMGELLQPAINYAEKGFKVDDSLTMRLDLAKPRIYSDKLSIFYPNGEPIETGETLIQTDLARTLKKIQKEGAKGFYEGGVARAISKTAKISLEDIKGYKVEVRKPVKGNYMGYDVYTAPPPFSGVTLLQMLKLAEKKEVYKDVDHTATYMSKMEEISRIAYQDRKKNLGDPNYVNMDPNKMVSDKYISTMKNENGDALSEAEHESTTHFVIIDRDGTVVSSTNTLSNFFGTGKYTAGFFLNNQLQNFGSEGFNNYEPGKRSRTFMAPTVLKKDGETIGIGSPGGNRIPQILTPILDKYTHGKGSLQDIINEYRFTFEKNTAYTEIQLSSEVKNELSRKGLNVKKKVSPAFFGGVQALIKDERDNVITGAGDGRRNGTWKSNK

SEQ ID NO: 2050 - protein, 633 aa, Oryza sativa Indica Group
MDDHNLDYKGSGALEELEMLTVNAKEAQELILTKILERNQATEYLSKFMNGSTNISAFKRHVPVVTYDKVHPYILRIATGEESSILCGEYILELLRRLLLMTVINPEAQTELRLGKIVYIYFLECARLEMTGHTKLLAFSGTSRGEPRLMPSILKDLDRRTYLYSLIMPIMNKYISGLGEGKAMYLLFVKAETLTDSGIPVRSVLTSYYKSPHFLHRKHDLYNNYTSPDEVILCPDSQQSMYCQLLCGLVERQHVLRIGAVFASAFLRSISFLEQHWRDLVNDIRIGQLNSSITSPACRLAMLNFLALPNPELADQVEAICSCGSWKGILGRLWPNVKYIEAVLTGTMAQYIPMLEFYGGGAIPFVCTMYASSESYFGVNLSPLCSPADVSYTILPNMAYSEFIPLEDGLRLTDHEEVIENDKLVSLVDVKVGCYYELVVTTFSGLYRYRVGDVLQVTGFYNRAPQFKFICRRNVILSIDSDKTNEEDLHNSVTTAKKILENQNYLLLEYTSYTDISTVPGHYVLFWEIKSTHDERPAPLDAQLLESCCAAVEESLDYVYRRCRAHDRSIGPLEIRLVEAGAFDALMDLLVSHGSSINQYKTPRCIESSLALKLLNSKVIACFFSPQDPECGM

SEQ ID NO: 2051 - protein, 1217 aa, Arabidopsis thaliana
MFLSTENPPNDPLSSSSSPFLQHLTSSSHELGQSHLSNFSIRDYAYSNRKNNIKNNWPFSSKSLQLFSTHGVTNPLPPFQKFSTVSSKFETTASPSSGKQIVSSYVHQGRDLDLAKLGLNQTVAETSSKGVCSQSRIIENGLFPSTSVSKSEVEILVATTSNKKDNHSRKCGRGMVKSKEDSCAGLVTTSESIMASKTCPICKTFSSASNTTLNAHIDQCLSVDSALLPPVVFSKPNKPRSKPPRVKVKTMVDIYASAKQGTLEDLDRRNGTKWVSILSYSNRVVADKSEVSKKRKVSPVGVGPVYIDAKGQKLRILSGFSEKKSSTTPLREQHEDGSSDKKCLGQGSKGTNKSLRKIRRGKKPHKFVKLTNHKADGPEQIRGVQRGFSGEGSHMGHHRRIYNQRMLAKRGLVSKKLNEKGHELSEDDEDTWSGGDPTVLRGTDLSATDSYPLKKQKLGSEVAGRKKTLFRSQSAQSRSFRVPQSEKEDESLEGVNINRLKKSVASFQEDKYPPGKKFCSDASPRGTSMRKFSPPFVPNAWRRLSMPVELKKARLDFSEEKDDEETGKWESEMTHERELRDDDYVSGDDGENNEVLLRSNPSSSGYDDYNDDDEESSEEEGDNNKRAHVLDQTDYTGAEFYQSESDSPTSIEILPSERAMYYSEAGNMIYGQTSCKEDERFDSEVGQGSLFVEVDTIPIPGPPGSFLPSPRDMGFDENLGNSSVITSQVQSSMDQLDRNSSESPVSAVSNFAAGRLNFPAELSSFRENFSPDIAMSYSTTPMSFCVPSHHGTITEAEPITIDKTISPSRFRNNDQESCCCQRKERISEGITLNHQGSHLLQRRAASSSNTMNLTNSPTRLDPNHPFEQSPYKTQQALDLQMSKFSSRKSLNAVVPPSPSNPVLRLMGKDLMVMNQGEADEEASRSSLTPNPQFVDPPCGGTGLYFNTGLYLRNSFDSTHQPQVQAQQQSQAAAFRNNFDHKTQSYKAREMSNFRLLSPPKGQKLGQPQLYARGCISGRVKPVNKIGKLAGRMTPSPPPITYISIPLPTNDVVSRSIHNLTTAISSHRPWSELIFSGDFSLPESFSSLLLRSKTNFNYFFVNYTIIVSTCAAFALITASPVALIVVGAIIALWLIFHFFREDPLILWSFQVGDRTVLLFLVLASVWAIWFTNSAVNLAVGVSVGLLLCIIHAVFRNSDELFLEEDDAINGGLIGSNLR

SEQ ID NO: 2052 - protein, 239 aa, Cryptococcus neoformans var. neoformans B-3501A
MSTISFASEDQFEAASSWLISTPAAAGLPNEIKLELYGLFKFITTGAGPTSSRPSLFYPTNRAKHDAWDSVSRKYLHLNSVPNQTKAMAQGRYVEIAKQVGWDGVIQEENEIDLERLSDSGSEDGKDGNEGAKDGWRKVSVMQGEDGLDNDPIHDAVVADSLQAAKELAEGDSSLINSRDEFGYTPLHLAADRGYPEMTKLLLELGADKSLKDQDDQTPSMLAQISGRDDIIAILDSTP

SEQ ID NO: 2053 - protein, 211 aa, Zea mays
MSQTRRTEAPTDSNAADVMEVEPKRRAPRLTSASCRRCRGGPEAPAVFNVVVEITKGSKVKYELDKKTGLIKVDRILYSSVVYPHNYGFVPRTLCEDNDPMDVLVLMQEPVLPGAFLRARAIGLMPMIDQGEKDDKIIAVCADDPEYRHYNDISELSPHRLQEIRRFFEDYKKNENKEVAVNDFLPAAAAREAIQYSMDLYGQYIMQTLRR

SEQ ID NO: 2054 - protein, 472 aa, Pseudomonas putida KT2440
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPEATVANLWTHGGFFPNGVSGLVMALAFIMFSFGGLEMLGFTAAEADKPKTVIPKAINQVIYRILIFYVGALVVLLSLTPWDNLVASIDASGGSYGSSPFVQVFSLLGSDVAANLLNFVVLTAALSVYNSGTYCNARMLLGMAEQGDAPASLAKVDKRGVPVRSILVSAAVTFVAVLLNYLMPQNALELLMSLVVATLVINWAMISYSHLKFRQHLDRTGQKPLFKALWYPYGNYVVLAFVVLILGIMLMIPGIQVSVYAIPVWLLAMLVVYMVKSRRQVNAGGAVETVAK

SEQ ID NO: 2055 - protein, 252 aa, Comamonas testosteroni
MNLNKQVAIVTGGASGFGAAIARRLSQAGAAVLVADLNAEGAQRMATELNAAGGRALGMACDVSKEADYRAVVDAAIAQLGGLHIVVNNAGTTHRNKPALAVTEDEFDRVYRVNLKSVYWSAQCALPHFAQQGHGVMVNVASTTGVRPGPGLTWYSGSKAAMINLTKGLALEFARSGVRINAVNPMIGETPMMADFMGMEDTPANRERFLSRIPLGRFTRPDDVASAVAFLASDDASFLTGVCLDVDGGRNI

SEQ ID NO: 2056 - protein, 476 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 2057 - protein, 397 aa, Roseovarius nubinhibens ISM
MNIHEYQAKALLRSYGAPVSDGRVVLRAEEAKTAAGEMDGPLWVVKAQIHAGGRGKGSFKEAGAGEAGGVRLAKSVEEAAEEAKRMLGRTLVTKQTGPAGKQVNRIYIEDGSGIEKEFYLALLVDRQTSRVSFVASTEGGMDIEEVAESTPEKILSFSVDPATGYQPFHGRRIAFNLGLEGKQVKQCVSLMGTLYKMFLEKDMEMLEINPLIITDAGDLKCLDAKMGFDGNAIYRHADIAELRDTTEEDPKELEASKYDLNYIALDGEIGCMVNGAGLAMATMDIIKLYGAEPANFLDVGGGATKEKVTEAFKIITSDPNVKGILVNIFGGIMRCDVIAEGVVAAVKEVGLKVPLVVRLEGTNVEEGKAIINNSDVDVIAADDLKDGAEKIVKAVKG

SEQ ID NO: 2058 - protein, 337 aa, Glycine max
  misc_feature (150)..(150): Xaa can be any naturally occurring amino acid
FGSRLKEVKLRDGYYVMDPEKAVEMVDENTICVAAILGSTLNGEFEDVKLLNDLLVEKNKETGWDTPIHVDAASGGFIAPFLYPELEWDFRLPLVKSINVSGHKYGLVYAGIGWVIWRSKEDLPEELIFHINYLGADQPTFTLNFSKDNXTHSIGSSQVIAQYYQLIRLGYEGYKMVMENCNDNMAVLKEGLEKTGRFEIISKDIGVPLVAFTLKDHTHFNEFQISDMLRRYGWIVPAYTMPPDAQHVTVLRVVIREDFSRTLAERLVIDVTKVVHELDLLPARVISTNTIMVTGEAGEENDEKVLFAKKSEIETQREITKAWKKFVMDRKKMNGVC

SEQ ID NO: 2059 - protein, 332 aa, Cryptococcus neoformans var. neoformans B-3501A
MSGPSSSPHVMQSGATSGVNIKLHPLAILNISDVYTRAQCTSTGSEVPKLIGALLGTESNREIAIVNSFELIYHPSVMSGEDVDMSDSGSSGGKYVLNTDFLETRKDQFKQVFPTLDVIGWYSVGKEPSSDDISLHAQFASSVETPIFLLFDPDPASGTQALPLKIYESATVTDTTGEISGEGKFVELEYGIETGEAERIAVDGVAKGGAGEEDTAVAHLTTQRNAIKMLYDRIEILLKYVTGVVNKSAKPDYSILRRISSLVATLPTMDAGEFREELITEYSDVQISSYLTTLTKQLNALSEVCYALQHLILATKKNKKQKTKKLIPVTVR

SEQ ID NO: 2060 - protein, 376 aa, Vitis vinifera
MRLATKLFRPDQILGEGGFGIVYKGVIDENVKPGYKTTQVAIKELNPEGFQGDREWLAEVNYLGQLSHPNLVKLIGFCCEDDHRLLVYEYMACGSLEKHLFRRVCATLTWSTRMKIALDAAKGLAFLHGAERSIIYRDFKTSNILLDANFRAKLSDFGLAKDGPMGDQTHVSTRVMGTYGYAAPEYVMTGHLTARSDVYGFGVVLLELLIGRRAMDKSRPSREHNLVEWARPLLNHNKKLLRILDPRMEGQYSTKMALKVANLAYQCLSQNPKGRPVMSQVVEILETIATQSENQEEAMLQSGGSSCVTLYEVPKDTHSNPDKKQKPTNMDGEKGETHQKRKPSNGRSKSEPPNEGGLCSPFVDSESDEKPVSPRS

SEQ ID NO: 2061 - protein, 469 aa, Oryza sativa Japonica Group
MEGRMQGKAPLSDSNRRIMDADAPPRRVYQGWKGSNIFFLGGRLIFGPDVRSLILTVCLIVIPVILFAAVISGQLDHEYHNQIGGWVASVAIIFTAYIIVLLLLTSGRDPGIIPRNAHPPEPEDVGESSNLSEWPGGQHGSTGLPLTKDVLVNGVLVKVKYCHTCMLYRPPRCSHCSICNNCVERFDHHCPWVGQCIGKRNYRFFFMFVSSTTLLCVYVFAFCWVDLRIIMDTHRCKLGRAIMKSPVSGILILYTFIAVWFVGGLTSFHLYLISTNQTTYENFRYRYDRKTNPHNRGLVQNFIEILCSRIPSSRNNFRAKVKEDSATFPSSLGMGRALSPPKMSVDLEMGMKRQTVAMEELEDLHSQIGSAMGLERCGTEPPHIVGRKGCSEIATDIEAFAEEFGLEQRHGEALKPKVLLYFWNAGSMYYKNHQVIFKDFIFFSLKGLQEEDFEAEEEDAPLHKDFLSN

SEQ ID NO: 2062 - protein, 517 aa, Roseovarius nubinhibens ISM
MSTEVRVPTLGESVTEATVATWFKKPGDAVAQDEMLCELETDKVTVEVPAPAAGTMGEIVAAEGDTVGVDALLATIVAGDAKPAGNTGSPKDDAPAAKPASGGDAAKGNTDVMVPTLGESVTEATVSTWFKKVGDSVSQDEMLCELETDKVSVEVPAPAAGTIVEILAQEGDTVQANGRLAVLSGSADGTITPDTRPEASAADAAPAPAASGSGRSDVEDAPSAKKAMAEAGLNRDQVTGTGRDGRVMKDDVARAAAAGAATGASASAPAPAAPAAPRAVSADDAAREERVKMTRLRQTIARRLKDSQNTAAMLTTYNEVDMTEVMALRNEYKDLFLKKHGVKLGFMSFFTKACCHALKEVPEVNAEIDGTDIVYKNFVHMGIAAGTPTGLVVPVIRDADSMSFAAIEKAIAEKGARARDGKLSMAEMQGGTFTISNGGVYGSLMSSPILNPPQSGILGMHKIQDRPMAINGKVEIRPMMYLALSYDHRIVDGKGAVTFLVRVKEALEDPRRLLMDL

SEQ ID NO: 2063 - protein, 292 aa, Coprinopsis cinerea okayama7#130
MRGAPFQLARFDKEWHDTSNRVTLPSVNFLVSRRQFLDLHLINLADMGQFRESRPPSEQIVGATKWCVFKQIIPTRQAVWAAVQERMVRMRSQQVDLLQFHWQDYTDKGYLTALSILNDLRMEGHIRAIGLCNFDAIRTDEICTELGPGVIVSNQVQFSVIDTRPLHGMSDVCDRHGLKLLTYGTLYLDMIVKAWGTWDLFQTLLSVLRKVGDRHGGRSIANVATRWVLDHHFVGAVIIGARLGLSEHRDDNLHVSSFRLTDTDRAEIEAVLERSNGRRIISTIGDCGAEYR

SEQ ID NO: 2064 - protein, 158 aa, Zea mays
  misc_feature (10)..(10): Xaa can be any naturally occurring amino acid
MYSEDKSTYXAEPPSRFEAGTPAIGEAIGLGAAIDYLSCIGMEQIHEYEKELGTYLYESLLSVPNVQIYGPAPSQTVHRAPLCSFNIENVHPTDIAEILDLQHSVAIRSGHHCAQILHRTLGINASARASLHFYNTKDEVDTFVDALKATVDFLTDRY

SEQ ID NO: 2065 - protein, 462 aa, Roseovarius nubinhibens ISM
MASYDVIVIGAGPGGYVAAIRCAQLGLKTACVEGRDTLGGTCLNVGCIPSKALLHASHMLHEAEHNFAKMGLKGKSPSVDWPGMLAYKDDVIGQNTKGVEFLFKKNKIDWLKGWGSIPEAGKVKVGDEVHEAKNIIIASGSEAASLPGVEVDEKIVVTSTGALELPKVPKKLVVIGAGVIGLELGSVYARLGSEVTVIEYLDAVTPGMDAEVQKTVQRMLKKQGMSFIMGAAVQKTEATKTKAKVHYKLRKDDSEHVLDADVVLVATGRKPYTDGLGLEALGVEMSQRGQIKTDDHWQTNVKGIYAIGDAIDGPMLAHKAEDEGMAAAEVIAGKAGHVNYGVIPGVIYTHPEVATVGKTEDQLKEEGRAYKVGKFSFMGNGRAKAVFAGDGFVKLLADKDTDRILGCHIIGPGAGDLIHEVCVAMEFGASAEDLAMTCHAHPTYSEAVREAALACGDGAIHS

SEQ ID NO: 2066 - protein, 531 aa, Arabidopsis thaliana
MDKFSYNSYPDSAESSPRSRDVEFENPSPWEDQQQQNYKVKLMCSYGGKIQPRPHDNQLTYVNGDTKIMSVDRGIRFPALVSKLSAVCSGGGDGGEISFKYQLPGEDLDALISVTNDEDLEHMMHEYDRLLRLSTKPARMRLFLFPSSPISGGFGSEGSTKSDRDTLNPIPSRPESEKSVTAPPNNADFLFGSEKVAPIPPSPVKVPQPVPEPVVLEPPQMFVDQRMLQPEHGVNPAEIQRQIQEFQMIQIRDQEQQMLHQNQLHQQQQQQEAIHQNQLHHQQEVIHQNQLLQQEAIHQNQMLQQQQQQEAMYRRKTEDEAGRYFPPTYTQNPAPVTNQQPPVGYWQGNTNNSNIQGNIYTTTSQNLPEQQQQQQQVYMIPAQSQAPGTLYQSVMRPTVQGNQGYYPSPVQRLHHPDAYMEQQNQPGYNVVQPQPTFSGGPQVMTSVGPQVMTSVGPPMGLQEPYSQMGKPVYYTVAGEGMMVQPPPAQPQQQQQQYQGMGQPVSGMTDLRTGPDGKVAVNMAAPQVSDSV

SEQ ID NO: 2067 - protein, 266 aa, Xylella fastidiosa 9a5c
MITIPSDLRESVIAIATDSGRAIMEIYQDHFQVQIKADMSPLTQADLTSHQIIVHGLKQLTPSLPVLSEESTGITWEERRHWTSYWLVDPLDGTREFVKRNGEFCINIALIHEGIPVYGMILAPVEGTIWHAMHGGQAFRRDGHRDTTLHVRAPAGTALQVAASRSHIDVHTSALLAQMKEITLVSQGSALKFCRLAEGTLDVYPRLGATYEWDTAAGQCLLLAAGGTLLNIETGKPFRYNKRETLLNNGFIALGDATLPWRDWLA

SEQ ID NO: 2068 - protein, 282 aa, Zea mays
MACSHLAAAGGSSPAAAAVVRSPTHSPAAAFARLRSTPRFSSAGLSVKGSRAAFPWVAAAGPAAAAPVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEKETFPHDALEATAWTEDGLIMAARHKKYKHIQGVQFHPESIITPDGKKIILNFVRFIEELEKQRS

SEQ ID NO: 2069 - protein, 223 aa, Xylella fastidiosa 9a5c
MSNCLIAPSILSADFARLGAEVDAVLAAGADWIHFDVMDNHYVPNLTFGPMVCKALRSYGITAPIDVHLMVEPVDRIVPDFTQAGASMISFHMEASRHVHRTIQLIKSHGCMAGLVFNPATPVDMLDWVLPELDLVLLMSVNPGFGGQRFIPGTLDKLRLVRKKIDLLGRPVRLEVDGGVGIDNIGAIAEAGADTFVAGSAIFHAPDYGDVIAHMRAAVAAVR

SEQ ID NO: 2070 - protein, 427 aa, Mycobacterium sp. JLS
MNSPSSGALARRLGTRDAVLIGLGSMIGAGVFAAFGPAAQAAGTGLLVGLAIAAVIAYCNAVASAQLAAQYPTSGGTYIYGRERLGPWWGFIAGWGFVVGKTASCAAMAMTVAAYAVPGPWWAQRLVGVAAVVGLAALNYRGVTKTAGLTRILVGCSLIALTVVVVGIAVGGQASLDHLGGWPALGAGGVYGVLQSAGLLFFAFAGYARIATMGEEVRDPTRTIPRAILIALFITVGVYLIVGVAALLAVGPDGLAHATAPLTAAVDGAGAGELAPVVRIGAVLAALGALLALIAGVGRTSLAMARHRDLPVWLSAVHPRYQVPHHAELALAVVVSVLVLTADLRDVIGFSSFGVLIYYAITNASAFTQPAAQRRWPRWLNVAGLAGCLILTATLPWPSVLAGAAMFAIGLAGRWLIVGRRTHTTHA

SEQ ID NO: 2071 - protein, 445 aa, Phalaenopsis hybrid cultivar
MARGIGLGAPLSKIAVSKAHGEDSPYFAGWKAYDEDPYDPVANPTGVIQMGLAENQVSFDLLEDYLEQHPETASWSSGISGFKENALFQDYHGLQSFRKAMASLMEQIRGKRVKFNPDRMVLTAGATAANELLTFILADPGDAVLVPTPYYPGFDRDLQWRTGVKIFPVHCHSSNGFQLTLPSLQSAYSIAEASNLRVKALLITNPSNPLGTTMPRSLLEDILNFISQKNIHLISDEIYSGSVFSSPEFISVAEVVEASQHKNCDGVHIVYSLSKDLGLPGFRVGTIYSYNDRVVTTARRMSSFSLVSSQTQKMLASMLSDEEFTVKYIKTNRERLRRRHGYIVEGLKDAGIECLEGNAGLFCWMNLTQMLEEKSMEGELRLWKMILSEVKLNVSPGSSCYCAEPGWFRVCFANMTKETLEVALRRTKDFVEKIKGRKSNVIFRS

SEQ ID NO: 2072 - protein, 358 aa, Pseudomonas putida KT2440
MSQFHSLTIKQVRNETRDAVSIAFDVPEHLQGQFRFTQGQYLVMRTQLDNEEVRRSYSICSAVQDGELRVAVKRVPGGRFSAFANEVLKAGQQLEVMPPSGSFFVPLDPARQGNYLGVAAGSGITPILSIIATTLASEPHSRFTLLYGNRSSSGALFRDKLEDLKNRYLDRLNLIFVFSREQQDVDLYNGRIDADKCGQLFSRWLDVAGLDAAFICGPQAMTETVRDSLQANGMAKERIHFELFAAAGSEARREAREAARQVDSALSHITVISDGRALSFDLPRNTQNVLDAGNAIGAELPYSCKAGVCSTCKCRVIEGEVEMDSNHALEDYEVAAGYVLSCQTYPVSDKVVLDFDQL

SEQ ID NO: 2073 - protein, 619 aa, Sorghum bicolor
MMRHSEIMKLLAFVLLMLGCQQSSLCLAVDSQVEALVEMKMQLVDNRGVLSDWKDNQMSPCYWEYVNCQDNKVSTITLSSSGLTGTLSPSIAKLTTLQQLKLDNNNITGGIPPEFGNLSSLTILNLGRNNLNGSIPDSLGQLSKLQILDLSHNHLSGNIPSSFSNPPSLNDINLAYNNISGEIPQHLLQAAHYNFTGNHLNCGQNLFPCEGGSTMTGGSKNSKLKVVIGSIAGAVTLCVTVALVLLWWQRMRYRPEIFIDVSGQNDHMLEFGQIKRFSWRELQIATNYFSEQNVLGKGGFGKVYKGVLPGPDSIKIAVKRLFNVERHEGELAFLREVELISIAVHKNILRLIGFCTTPTERLLVYPFMENLSVASRLRDIKLNEPVLDWSTRMRIALGAARGLEYLHEHCNPKIIHRDVKAANVLLDGNFEAVVGDFGLAKMMDIGRNTVTTGVRGTMGHIAPEYIKTGRPSVKTDIYGYGVMLLEIVTGERAIAFHPDRMEEAGEIMLIDQVKLWMEEGRLLDLVDRNLGGVYNLEELEKVTQIALLCTHMEPSQRPTMSEVVQMLEGEIVPAERWEEWQLAELQRRQQHEMRQQGKLFNFSEESLNIQEAIELSTGR

SEQ ID NO: 2074 - protein, 475 aa, Rhodospirillum rubrum ATCC 11170
MSAIFSNLLNDLAKLPERRIFGRVVGVQGMLVEIGGAQTNLSVGDRCAVIARDGRPITCEVIGFRAARALLMPFSVLDGVGLGCRAEVIEGVPAIYPTRDWLGRVINAMGEAVDGKGALPAGERAVAIRGRPPSAHSRQRVGGKLDLGVRAINTFLTCCRGQRMGIFAGSGVGKSSVMSMFIRNTNADVIVMGLVGERGREAREFIEDDLGEEGLKRAVTVVATSDESPLMRRQAAYMTLAVAEYFRDQGLDVLCLMDSVTRFAMAQREISLSAGEPPASKGYTPTVFAELPKLLERAGPGVEGSGSITGLFTVLVEGDDHNEPISDAVRGILDGHIVLDRAIAERGRYPAINILRSVSRTMPGCNSPAENALVAKGRRLMAAYENMAELIRLGAYRKGSDPETDTAIHYHPALDAFLTQAKTEGTDLATGYAMLEAALAPQIEMSPPPMAAKGFPAPSRSFQPSRSPAPPRKRD

SEQ ID NO: 2075 - protein, 555 aa, Triticum aestivum
  misc_feature (485)..(485): Xaa can be any naturally occurring amino acid
  misc_feature (514)..(514): Xaa can be any naturally occurring amino acid
REQKLELHRGGGRSRTSGSPGLQEFGTSGGGIYTKAADVGADLVGKVERNIPEDDPRNPAVIADNVGDNVGDIAGMGSDLFGSYAESSCAALFVASISSFGTEHNFAAMMYPLLISAMGIVVCLATTVVATDVAEVKTVEEIGPALKRQILISTVLMTVGIAIVSFLVLPHSFTLFDFGRRKLVKNWYLFICVSAGLWAGLVIGYVTEYFTSNAYRPVQAVANSCRTGAATNVIFGLAVGYKSVIVPIFAIATAIYASFRLAAMYGIALAALGMLSTIATGLSIDAYGPISDNAGGIAEMSGMPHVVRERTDALDAAGNTTAAIGKGFAIGSAALVSLALFGAYVSRAGVAAVDVLSPRVFAGLLVGAMLPYWFSAMTMRSVGSAALAMVEEVRRQFDSIPGLMEGTAKPDYATCVKISTDASLKKMLAPGALVMLSPLVAGTLFGTETLAGLLAGALVSGVQVAISASNSGGAWDNAKKYNRGXAPRAEAPALGAPGGRDAHKSRRSSGDTIXGDPLKDTSGPSLNILIKLMAVEALVFAPFFAAHGGLIFKHL

SEQ ID NO: 2076 - protein, 379 aa, Oryza sativa Indica Group
MSTSAPISSPEPPEFIRGSLIPALPDDLAIHCVALLPRAAHPSLALVSRAFHTLLCRDPGPLLAARRRLRLSDPHVILSLRPPASASPLFFLLLPHPGWPPLPLPSPPVPVSSSSSVAVDGNRVFLFGGSVSGVPSPSVQILDPRTRFWSVGPRLSSPREFAAAVAHSGVLFVAGGCVPSSPFWAESLNLSSPDAKWSPVPSPPHFREKWMHGSASLAGKVLAVADRGGLAYDPAAPPTEAWAPVSPILDMGWKGRAAVVGGILYSYDYLGQVKGYDPDTDCWSKVEGLEQELPKFLCGATLANVGELLYLVWEGKWKGKGKAKGKGEARSMVVIDWAAIVVTKAEEGRLTGKVLSRDTIVFKDMPKGSAITHCIALEL

SEQ ID NO: 2077 - protein, 459 aa, Candida glabrata CBS 138
MGQILSNPVIDKEHHSGADLLTAFGLCAMQGWRMSMEDAHIVEPNVLPETDDEHIAFYSIFDGHGGSAVAQFCGSKMVSILTSQESFKEKKLKQALIDTYLKTDEELLKDPEMRNDHSGCTATSILVSKLQQTLVCGNSGDSRTVLSINGVAKALSFDHKPTLTSERSRIVAADGFVEMDRVNGNLALSRAIGDFEFKSNDKLGPHEQIVTCVPDIVEHRLNYDNDEFVILACDGIWDCLSSQECVDLVHHGIMKGDMSLNDISSRIIDVCCSPTTEGTGIGCDNVSIVVVALLKENETINAWFERMRNKGYKPPHSFEEQRRSIFSYYQFPEDDEKVFDVTTKKPQDRFNQDSEISTGDEDERNKMEIDEDDNDRSGAQKKTGASIPVDLLSLEALLNGAGNIQLNQGPDNVSYISGSSLTDMINSLSRAAAMANNTRDSDSEEEDTKIIEDVSDKQE

SEQ ID NO: 2078 - protein, 243 aa, Ralstonia eutropha JMP134
MLQSREGQRIPNVAFRIRQDNEWKTVTSGDLFNGKTVVVFSLPGAFTPTCSSTHLPRYNELAPAFAKHGVDEILCVSVNDTFVMNEWAKDQESQNITMIPDGNGEFTEGMGMLVDKADLGFGKRSWRYSMLVRDGVVEKMFIEPNEPGDPFKVSDADTMLNHIAPDAKRPDQVVVFSKAGCSFCAKAKQQLSDAGYEYIEVPLDNKVRGKVLGAVSGEMTAPQVFINGKLIGGAAALEQYLGQ

SEQ ID NO: 2079 - protein, 252 aa, Idiomarina loihiensis L2TR
MPNASLVIANWKMNGNRELTKTMSAALREKLNQLQQVKLVICPPFTLIGELANQCYYDDIAIGAQNVSEHTGGAFTGEISTAQLQEFGVSYVLVGHSERRQLFAETDKMVNEKALATVNAGMTAVICVGENKAQRDEGNTWEVVAQQAQAALADLPKEQAGKIVLAYEPVWAIGTGETASPEQAQDVHAKLRALLVEQFGAIGEKMPLLYGGSVKADNAAELFAQKDIDGGLIGGASLKESDFVAICQAAQG

SEQ ID NO: 2080 - protein, 234 aa, Arabidopsis thaliana
MATSLSVSRFMSSSATVISVAKPLLSPTVSFTAPLSFTRSLAPNLSLKFRNRRTNSASATTRSFATTPVTASISVGDKLPDSTLSYLDPSTGDVKTVTVSSLTAGKKTILFAVPGAFTPTCSQKHVPGFVSKVGELRSKGIDVIACISVNDAFVMEAWRKDLGINDEVMLLSDGNGEFTGKLGVELDLRDKPVGLGVRSRRYAILADDGVVKVLNLEEGGAFTNSSAEDMLKAL

SEQ ID NO: 2081 - protein, 360 aa, Glycine max
  misc_feature (162)..(162): Xaa can be any naturally occurring amino acid
  misc_feature (183)..(183): Xaa can be any naturally occurring amino acid
MKKAGSISSGLKLTVPAASDRDSFTKFRSEPESGTFKAGDLLVNNEGVRIVSENEVEAPPPIRPQDNQLSLADIDTIKVIGKGNGGVVQLVQHKWTNQFFALKEIQMPIEEPIRRQIAQELKINQSAQCPYVVVCYNSFYHNGVISIILEYMDGGSLEDLLXQVKTIPESYLSAICKQVLKGXLMYLHYAKHIIHRDLKPSNLLINHRGEVKITDFGVSVIMENTSGQANTFIGTYSYMSPERIIGNQHGYNYKSDIWSLGLILLKCATGQFPYTPPDREGWENIFQLIEVIVEKPSPSAPSDDFSPEFCSFISACLQKNPGDRPSARDLINHPFINMHEDLNVDLSAYFFNSGCTLATI

SEQ ID NO: 2082 - protein, 331 aa, Synechococcus sp. RS9917
MTSFLTAARAEQEKIQQDTRRLRLFSGTSNPSLAREIAAYLGVPDGPRVCKRFADGELYVQIQESIRGCDVFLIQPTCAPVNDHLMELLIMVDACRRASARQITAVVPYYGYARADRKTAGRESITAKLTANLLVTSGVDRVLAMDLHSAQIQGYFDIPCDHIYGSPVLVDYLSAQDLGDVVVVSPDVGGVARARAFAKQMQDAPLAIIDKRRTGHNMAESLTVIGDVADRTAILIDDMIDTGGTICAGARLLRQQGAKRVIACATHAVFSPPACERLSADGLFEQVVVTNSIPIPADRTFPQLQVLSVANMLGEAIWRIHEESSVSSMFR

SEQ ID NO: 2083 - protein, 286 aa, Lactuca sativa
LELYSNNISGPIPNDVGNLTNLVGLDLYLNSFSGPIPVTLGKLSKLRFLRLNNNSLTGPIPLQLTNITSLQVLDLSNNRLSGSVPDNGSFSLFTPISFANNLDLCGRSRAPCPGSPPFSPTPPFVEPPPIFLPGGNSATGAIAGGLAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSV

SEQ ID NO: 2084 - protein, 381 aa, Idiomarina loihiensis L2TR
MSILASQSAKRAILVLADGTVFRGTAIGAEGSAVGEVVFNTAMTGYQEILTDPSYTEQIVTLTYPHIGNTGINSEDAESDQVWAKGLIIRDLAMKASNFRSEETLSAYLQRHNVVGIADIDTRRLTRILREKGAQNGCIMVGELDENKAQELAQKFPGLKGMDLAKEVCCDKPYDWQGGSWQLGEGHTKPEQNKYHVVAYDYGCKHNILRLLADRNCKITVVPAQTSAEDVLALKPDGVFLSNGPGDPEPCDYAITAIKALLDKEIPIFGICLGHQLLAIASGAHSMKMKFGHHGANHPVQDLKTKRVMITSQNHGFAVDEKQLPDNLEVTHVSLFDGTLQGIRRKDKPAFSFQGHPEASPGPHDASELFDQFIELMQAKA

SEQ ID NO: 2085 - protein, 120 aa, Glycine max
LTSFGSRATKLSSTATKMSTVTGAHLDQRLVAAKRCSREAAMAGAKAAAVATVAAAVPTLASVRMLPWAKAHLNPAGQALIISTVAGMAYFIVADKTILSMARKHSFEDAPDHLKNTSFH

SEQ ID NO: 2086 - protein, 342 aa, Zea mays
  misc_feature (106)..(106): Xaa can be any naturally occurring amino acid
MAAAGDPPPPIYAEGAARTRGEISPHFQTYARDDDAKLETTRARLSNILKRHEDLKERLSRDSDKLIFERLQKEFEAARAAQTEEISINDDEWNDGLLATIREKTXVHMEADRKAMSNQVNVPADLSFQSRTTYRIRNKVIYCLDGARIGIQYETFFAGEPCEIFHCVLESKSFLEKMIMIEHTLPFFLPVRELESDLLSSNSIKFIDHLEEILQAYIDRREQVRLIKELYGNQIGELFHSLPYNMIEFVLEDFECKVTISIRYSDLLQTLPSQARVLAWPLRSAKKISTRSSSASAAQPVPFHLSYAEEALKTLCLPEAYADIVLELPHALKRILSSRDSD

SEQ ID NO: 2087 - protein, 447 aa, Staphylococcus aureus subsp. aureus MRSA252
MYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEIAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALENICRENGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKNLKTRDASAALKICNYCFEHGVVIIAVAGNVLRFQPPLVITYEQLDTALNTIEDALTALEAGNLDQYDISGQGW

SEQ ID NO: 2088 - protein, 294 aa, Glycine max
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANGVPNLEAGGLNFLLSMLCLDPSKKIPPRSAVEHEFFKDIKFVP

SEQ ID NO: 2089 - protein, 119 aa, Zea mays
  misc_feature (55)..(55): Xaa can be any naturally occurring amino acid
RGGRNTFFFLLNNGGSPIGGGVPGGPFNVFKNGNSPGLGEGFPNGGGGCSPPKVXPGGGVAGARGAPFGLKKGCFFFFGVFGLKGAPPKALFGGGFGVFGGNTPPPNPPGIPPVSRIAL

SEQ ID NO: 2090 - protein, 110 aa, Glycine max
  misc_feature (37)..(37): Xaa can be any naturally occurring amino acid
  misc_feature (50)..(50): Xaa can be any naturally occurring amino acid
  misc_feature (75)..(75): Xaa can be any naturally occurring amino acid
PVAFARTPVTSSGVSSCGGTAQARIEARGFIFGSPIXGAKFVPLRKPKKXPGKVISQEHILEYGRDCLEMHVGLXAVEPAEHALVVDDLIATGGTLCAAMDLLGFDAWCS

SEQ ID NO: 2091 - protein, 425 aa, Physcomitrella patens subsp. patens
MGNLKDVDDEAEFSNGIADLHIDGSRGHTEAEAGDDDEEAENLLVGLGFVQPVEDSEKWKVERQHFPSKVGGCPAWLDPINIPTGEQSTCGICDSPLEFLLQVYAPIDDIDDAFHRSLFVFVCPNASCLEQDRHHQSKKPEENPRRCVKVFRSQLLRKNSYYSYTPPSGEDDLPISEGAALCTWCGIWKGHKACAACKQTKYCSRSHQVEHWRGSHAVYCRQVQAARKEGKMDVNIPVCSPGPVSDKLWPEMELVVDEEDNYEVDELSDPNANVPASDKTKSKAQLLLEDYERRREAGEEFTAADLEDVHEASQDMQLWAAFLAKIGKAPDQVLRYCRSPAAKPLWLSLNGQPENSGIPSCSHCGSRRIFEFQVLPQLLNFLDFKDEANSLDWGTIAVYTCERSCGEGVGKGYAEEFAWVQPPPE

SEQ ID NO: 2092 - protein, 560 aa, Physcomitrella patens subsp. patens
MVAPNAAAEYQLTPHPTIPKGKPFLLVVLDGWGENREDEFNAIYNAQCPTIKSLKEGAPRRWRTIKAHGTAVGLPSDADMGNSEVGHNAMGAGKIIQQGASLVDNAIESGSMFTGEGWNYAKDAWVNGGTLHFIGLLSDGGVHSRTDQLYALMYGANDHGCKRIRVHVLTDGRDVPDGSSIKYVGQLEKECENLRNQGCDARIASGGGRMYVTMDRYEADWNIVERGWRAHVLGDAPHKFESALDALTKLKEADPKLNDQFYPPFVVVDKDGAPVGTIGDGDAVVNINFRADRVIQISKAFEYEDFTAFDRVRFPKVKYLGMMQYDGDLKLPSNYLISPPLIENTSGQYLCANGVRTFACSETQKFGHVTFFWNGNRSGKIDETLETYHEIPSDNIQFNQAPHMKAAEIAKAAREALLSGEFDYVRVNFANGDMVGHTGDLEATKMACEAVDQGVKVLIDAVEQMGGIYLITADHGNCDDMAQRKKTGEPLRDETGKVQPLTSHTLAPVPVAIGGPALPENIKFRDDLPKAGLANITATFMNLMGFEAPEEYVPSLLTFD

SEQ ID NO: 2093 - protein, 496 aa, Staphylococcus aureus subsp. aureus MRSA252
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEIDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 2094 - protein, 228 aa, Physcomitrella patens subsp. patens
AVVERDGARAKIANEEAREFVQQAHVAALKRVLREDARDTISYQEFLQLCRTVGMAPSDEDAAVMAHVFNQSGVVFTFRDRVHLHPEKIAELVAKVLPLSVLGEDDQRRIELTELARKKEEIDRKAHKQMRLVLWSGLFGLTMQVLLFFRLTFWDLSWDVMEPVAFFTTATGLICGYAYFMFTSRDPSYRDFMQKIYQSRQRKLFKKQNFDINRFKELQMQCQAPVPR

SEQ ID NO: 2095 - protein, 447 aa, Herminiimonas arsenicoxydans
MKHQSLEDFLTHVAERNPGQPEFLQAVTEVMESLWPFIEQNPHYAEHGLLDRLIEPERIIMFRVSWVNDHGDVQVNRGYRIQQNSAIGPYKGGIRFHPSVNLSILKFLAFEQTFKNALTTLPMGGGKGGSDFDPKGKSPGEVMRFCQAFVSELFRHIGSDTDVPAGDIGVGGREVGFMAGMMKKLSNRADCVFTGKGLSFGGSLIRPEATGYGTVYFAEQMLKQKGLSFDGMRVSVSGSGNVAQFAVEKAMSLGAKVITVSDSSGTIVDNDGFTPDKLAILMEVKNHLYGRVSDYAQRTGVEFHAGMSPWHVPVDVALPCATQNELDIEAANILVKNGVICVAEGANMPTTIEAVRVFESSGVLYAPGKASNAGGVATSGLEMGQNAMRISWPREEVDARLHSIMCNIHDACLRHGRRADGTISYVDGANIAGFVKVADAMLAQGVI

SEQ ID NO: 2096 - protein, 418 aa, Fusarium proliferatum
MSDLQGRKVFKVFNQDFIVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKTIDVWSVGCILAELLGGRPFFKGRDYVDQLNQILHILGTPNEETLSRIGSPRAQEYVRNLPFMPKKPFPSLFPQANPDALDLLDKMLAFDPSSRISVEQALEHPYLHIWHDASDEPDCPTTFNFDFEVVEDVGQMRGMILDEVMRFRQTVRTVPGQGGPAGLQNQQGVPVPLPQGNGQWTAEDPRPQEYQGHGNTGLEQDLQGGLDASRR

SEQ ID NO: 2097 - protein, 571 aa, Candida glabrata CBS 138
MIPKLLCGNTLLSASVTTSRSVYGLSTRYFTQDLAPSLVKLHSELKPDELLTDNTPDYVRLVLRSSVYDVIKESPISHGVGLSSRLNTNVQLKREDLLPVFSFKLRGAYNMIAKLDDTQRNQGVIACSAGNHAQGVAYAARHLDIPATIVMPVSTPSIKYQNVSRLGSQVVLYGNDFDEAKAECTKLAEERGLTNIPPFDHPYVIAGQGTVAMEILRQVYNSNKIGAVFVPVGGGGLIAGVGAYLKRVTPHIKIIGVETHDAATLHTSLQRNKRTNLASVGTFADGTSVRIIGEETFRVAREVVDEIVLVNTDEICAAVKDVFEDTRSIVEPSGALAVAGMKKYITQLHPEIDHSKQTYVPILSGANMNFDRLRFVSERAVLGEGKEVFMLVTIPDVPGSFKKMQKVIHPRAVTEFCYRYNEHRHESSSEVPKAYIYTSFSVVDREKEIKQVMQQLNTLGFEAVDISDNELAKSHGRYLVGGASKVPNERIISFEFPERPGALTRFLAGLSESWNLTLFHYRNHGADIGKVLAGISVPPRENLTFQKFLEDLGYKYQDETENMVYQRLLKY

SEQ ID NO: 2098 - protein, 237 aa, Haemophilus influenzae R2846
MNIQHNLNLIQQKIETACKEKNRNQNTVKLLAVSKTKPISAILSAYQAGQTAFGENYVQEGVEKIQYFESQNINLEWHFIGPLQSNKTRLVAEHFDWMQTLDRAKIADRLNEQRPTNKAPLNVLIQINISDEESKSGIQPEEMLILAKHIENLPHLCLRGLMAIPAPTDKIAEQEAVFRKMSDLFEQLKQALPNQQIDTLSMGMTDDMPSAIKCGSTMVRIGTAIFGARNYSTSQNK

SEQ ID NO: 2099 - protein, 543 aa, Lilium davidii
TREIRRRMLSGLSIRVRQLRHRLPKLSRPGLSIEDFQFFLFSDELNPPIGTQVHQDMTAPLSHYYIYSGHNSYLTGNQLSSDCSDVPIINSLQSGVRVIELDLWPNSTKDNIDILHGRTLTTPVDLIKCLKSIKEYAFVASPYPVIITLEDHLTPDLQAKVAKMVTETFGDMLYFPDSDYLKEFPSPEALEKRIIISTRPPKEYLEAKSFKKKDDDSPKEKNSDDEEWGSEAVDKTEADFDDGQSEHPHNEDEANDDDHKIKHDLAPEYRRLITITAGKPKGSVRDALKVDPDRVKRVSLSEQELEKVAVSHGADVIRFTQKNLLRIYQRGTRFNSSNSILVGWMHGAQMVAFNMQGFGRSLWRMQGFYRANGGCGYVKKPHFLLNNGPHGEVFNPKAKLPAKKILKVKVYMGDGWRMDFKSTHFDTYSPPDFYTRVGIAGVPADCTMKKTRTIEDDWTPVWDEELVFPLTVPELALLRIEVHEYDMSDKDDFGGQTCLPVSELKPGIRAVPLFTRKGVKYRSVRLLVRFEFLTDCFSSVEIE

SEQ ID NO: 2100 - protein, 81 aa, Glycine max
KAGNKVSKAPKIQRLVTPLTLQRKRARIADKKKRIAKAKSEAAEYQKLLASRLKEQRDRRSESLAKRRSKLSSAAKPTVTA

SEQ ID NO: 2101 - protein, 547 aa, Lilium davidii
  misc_feature (253)..(253): Xaa can be any naturally occurring amino acid
  misc_feature (460)..(460): Xaa can be any naturally occurring amino acid
TRGPDQLLRFLADSQGEVGATVADAEKVIDQLRQLRHRIAKLTRPLLTLDDFHHYLFSEELNPPIRSQIHQDMNAPLSHYYIYTGHNSYLTGNQLSSDCSDVPIIKALERGVRVIELDMWPNATKDNIDILHGRTLTTPVELIKCLKSIKEHAFVASPYPVVITLEDHLTPDLQAKVAEMVTETFGDMLYYPESDSLNEFPSPEFLKKRVILFTKPSKESLKLRARRMIFLMKMFLKRKKHGERKSRSQNRNXAGDKRENDESEDEEVDDDYVIPQNLAPEYKRLILLRAGKPKGELVDALQVDPDTVRRLSLSEQELAKAAISHGSDLVRFTQKNLLRIYPKGTRFTSSNYNPFVGWLHGAQMVAFNMQGYGRALWLMHGFYQANGGCGYVKKPDFLLNTGSHGETFHPKVPLPVKKTLKVKVYMGDGWRMDFKQTYFDAYSPPDFYTRIGIAGVPADXVMKRTKAIEDDWTPVWNEEFVFPLTVPEIALLRIEVHEYDMSEKDDFGGQTCLPISELRPGFRSVPLFDRKGMKFKSVKLLMRFEFI

SEQ ID NO: 2102 - protein, 313 aa, Medicago sativa
MATAIKFFQLNTGAKIPSVGLGTWQAEPGVVAKAVTTAVQVGYRHIDCAEAYKNQSEIGSALKKLCEDGVVKREELWITSKLWCSDHHPEDVPKALDKTLNDLQLDYLDLYLIHWPVSMKRGTGEFMGENLDHADIPSTWKALGALYDSGKAKAIGVSNFSTKKLQDLLDVARVPPAVNQVELHPGWQQAKLHAFCESKGIHLSGYSPLGSPGVLKSDILKNPVVKEIAEKLGKTPGQVALRWGLQAGHSVLPKSTNEARIKKNLDVYDWSIPEDLFPKFSEIKQDKLIKGTFFVNDTYGAFRTIEELWDGEV

SEQ ID NO: 2103 - protein, 244 aa, Zea mays
  misc_feature (212)..(212): Xaa can be any naturally occurring amino acid
MDRYQRVEKPRNETPIRENEIRITALGRMRNYIGYGMSLLEENGHDEITIKAMGRAINKTVMVAELIKRRVAGLHQNTSIESVGITDTWEPLEEGLVPLETTRHVSMITLTLSKEPLDTSSPGYQPPIPAEEVKPAFDYEHEGSFPSARGRGRGGPGGGRRGRGRAISNGPPPYDWGEEWEEDGDYYYNGRGRGRGRLRGRGRARGYYGGGXRRGGYGYDYGYGGRGGYYEEQGGYFDGEQMSI

SEQ ID NO: 2104 - protein, 121 aa, Zea mays
FGRWQDVMPQLGSYDGIFFDTYGEYYEDMREFHQHLPKLLKPGGIYSYFNGLCGDNAFFHAVYCQLVALELANLGYSTQFIPLPVKDCLAEEVWKGVKRKYWQLDTYYLPACQSESESTIK

SEQ ID NO: 2105 - protein, 501 aa, Candida albicans SC5314
MTIPLSVDVTLPDGKKFTQPTGLFINNEFIKSKSGKTLESINPGTSEINGEVYAAESEDIDYAVECASKAFKSWKKITGVERGKYLYKLADLVEQQRDLLGAMEAWDSGKTKSTNAVFDVDECIAVIRYAASWADKITGKVIQNDPKKFAYTIHEPWGVCAQIVPWNYPLLMSMWKIPIAVAAGNTVVLKTSEITPLSMLYFASLVKQVGFPPGVINIVSGFGATAGAALASHKKVAKIAFTGSTATGKIIQKLAAENLKAVTLECGGKSPLIIRSDADIDQAVKWGAIGIMSNQGQICTSTSRIYVHESIYDKFIEEFAAHVKSDYKQGDVFDDEAVVGPQVSKMQHDKILNYIDIGKKEGARCVLGGEKNIEGELSKGYFVKPTIFADVKPEMRIVNEEIFGPVVVVGKFSTDEEAITYANQTDYGLGAAIFTKDITAAHNMASDIEAGMVWINSSNDSDYHVPFGGVKMSGVGRELGEYGLNMYTQAKAVHVNLGTRL

SEQ ID NO: 2106 - protein, 507 aa, Synechococcus sp. RS9917
MSATITNPLRVGLRQERVIAPQCLIIFGASGDLTHRKLVPALFELFQQRRLPSEFALLGCARRPWSDEEFRQKMAEAMGAKVSDNRMAWDQFSAGMFYEPVDLQQPEDLVKLGHRLQEIDRLRATRSNRTFYLSVSPKFYGSGCRALADAGLLKDPDRSRVVIEKPFGRDYSSAQALNKVVQACGQEKQIFRIDHYLGKETVQNIMVLRFANTIFEPIWNRNYISSVQITAAETVGVEERAGYYETSGALRDMVQNHLTQMLAITAMETPGRFDPEAIRSEKAKVLQAARLADEQEPWNCCIRGQYGPGGSQVAPLAGYRQEPGVDPNSTTETYVAMKLFIDNWRWQGVPFYVRTGKRLPKRLSEVVLTFREAPVHLFDAAGGSPTANQLILRIQPDEGAEFRFDVKSPGSGMRSRPVEMEFSYDESFGEPSDEGYVRLLADAMLGDPTLFTRSDEVEAAWRLYTPLLELIEDSPWQLPIHPYESRTWGPAASDALLARDGLLWRRP

SEQ ID NO: 2107 - protein, 153 aa, Streptococcus mitis
EYFIRGQYRSGKIDGMKYISYRSEPNVNPESTTETFASGAFFVNSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 2108 - protein, 384 aa, Idiomarina loihiensis L2TR
MATQDFYQVLGVSKDANERDIKKAYKRMAMKYHPDRTEGDKDMEIKFKEIKQAYEVLSDPQKRQMYDQYGHEAFEQARQGGAGHGAGGFGGGGADFADIFGDVFGDIFGGGRRQQARAQRGADLRYNLDMSLEEAVRGKTVELEIPTLVECRDCNGSGAKKGSKPQTCGHCHGSGQIQMRQGFFAVQQTCPQCRGTGTIIKDPCRTCHGHGRKEETKTLSVKIPAGVDTGDRIRLANEGEAGEHGAPAGDLYVQVHVREHPIFARDGNNLFCEVPVSFTKAALGGDIEVPTLEGKVKLKVPKETQTGKHFRLRGKGVKSVRTGEVGDLICKVMIETPVNLSSKQRDMLEELEDSMGTGDEAAKFRPKEKGFFDGVKQFFDDLRS

SEQ ID NO: 2109 - protein, 562 aa, Vitis vinifera
MQVFPPVIYNDNPSLVFSSGYGFNPQMAYGQYTNVATPLPSLMVDRQLYSPHQNPFSQPYYPQSIPSVPNISSAVSVPQTELMAPESSVQEADVSLSSVTSQAAHPQPVGILGSYELNVRQRAAHGLGLVPSSSNIFYPDGGLYESTNFGGASVSPLGANDRNRLILDKGKIRERDRSSGGQSTSGQGVSSSSRKSDASNSVVHFDSYNQPDFVTDYENAKFFIIKSYSEDNVHRSIKYSVWASTALGNRKLDAAYQKAKEIETNCPIFLCFSVNASSQFCGVAEMVGPVNFEKDAEYWQQDRWSGLFPVKWHIIKDVPNSLFRHILLENNENKPVTHSRDTQEVNLEQGIEMLKIFKSYDAHTSILEDFDFYEQRERASKERKARQQACSTTKSPGSEESVNHVSNSFSQSLQLEESDREVIATEWGDNSRTESGAHCLEESGEAVEPERGCSTTTGALVSLADDSMNQMSDSFAQTLRLEGSIKELRAASSSGTDAEVSLDDAITLMTLESKKNNKELPRAGRINSPRPDAFVLLVDYPKGQISDSSVQSPQLEESSKEV

SEQ ID NO: 2110 - protein, 85 aa, Zea mays
  misc_feature (22)..(22): Xaa can be any naturally occurring amino acid
FSWKPVGPRLSELLRAELVMAXDCIGEEAEKLSASLTKGGTLLLENVRFYREEEQNEPEFAKKLASAADLYVNDAFGTAHRAHAS

SEQ ID NO: 2111 - protein, 755 aa, Aspergillus nidulans FGSC A4
MTESDHTRSLRDRIIELFRPPASVTFLPRMTVHNNTMGDFDESAGSNSSQVDSRTPLLGSYDRREPPCGMGNSCNHGTFTPRVESDDWRTNAMPEYGGERYPIGSTSRRSTSAAPSAQGLENFPAGASTPLTIKYSKSQYISYYIPFFTWISQYRLSYLRGDICAALTVASIYIPMGLSLSNIAHAPPINGLYSFVLQPFIYAILGSSPLLVVGPEAAGSLLTGAIVKESVNQGSSGEDDEAANAIVVGVATALAGLMILVAGIFRLGFLDNVLSRPFLRGFITAIGFVIFVDQFIPELGLAAEAKAAGVTHGSTVDKLLFIIRNITHSHSLTAAVAFTSFAIIMVFRTLKKLLQPRYPQVIYFPDRILVVVISAVLTQQLRWHEQGLEVLGPTKNSGNGVFNFEWPFQPKYAEYLRTALSTSFIIAILGFFESSVAAKGLTGVASVGVQGMQVSPNREMVALGFANVVGGCFMSLPAFGGYARSKVNASTGARSPMSNICLSVVAIICIMVLLPYLYYLPKAVLSSMISVVAYSLIEECPHDLAFFIRLRGWSELALMLLIFLSTIFYSLELGIALGMGLSVLILIRHSTKPRIQILGKVAGSDRFDNAELHPENVESVEGALVVKIPEPLTFANTGDLKNRLRRLEMYGTNRAHPSMPRIRPPEHNRNVIFDVHGVTSIDGSGAQVLYEIVDGYAQAGTRVFFCRVPNRSVYRMFQRSGIVERCGGMSHFVGHVDEALKLTDSETRPLSASSA

SEQ ID NO: 2112 - protein, 209 aa, Brassica napus
  misc_feature (181)..(181): Xaa can be any naturally occurring amino acid
MQNGAHGVAKEQPRLTLYIILTTAFLSLCFLLSLSSSFHSSPPYSGSNGIRPDPRLFPSSSKIAADTSPPSVAYLISGSSGDSRRILRLLFAAYHPRNRYLLHLDSLATQSERDRLASTVGDVPIFRAARNVDVVGKRDFAYRRGSSPMASTLHGASILLRLSGAWDWVLLISVVGTRYPXTQDELFHILSYLPKDLNFVNHTSYIGWK

SEQ ID NO: 2113 - protein, 279 aa, Zea mays
MVSSARALIGLLVAAASLAVALSDGGGMAAPVYGYAAGSPNGPENWGKLSPAYKLCGEGKQQSPIDIVTKQAVPAATLDTLNRTYGATNATLINDGHDITLALEGKVGTVTVNGKAYSFEKLHWHSPSDHTINGQRFPLELHLVHRSADGALAVIGILYQLGAPDSFYYQLKRQLGEMAQDRCDFAEEEESRVEAGLIHLRSLQKRTGSYFRYTGSLTVPPCTENVVWSVLGKVRQISQDQLQLLKAPLPGSDARPTQPLNGRTVQFYNPPNSTISFQI

SEQ ID NO: 2114 - protein, 463 aa, Bacillus anthracis str. Ames
MANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 2115 - protein, 427 aa, Glycine max
MAIRNSLTGQFLRRSSVAGARLMSSSSSWFRSIEPAPKDPILGVTEAFLADQSPNKVNVGVGAYRDDQRKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLVLTAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVLDAIHEVTKSF

SEQ ID NO: 2116 - protein, 228 aa, Bradyrhizobium sp. BTAi1
MPDAPTSFTSSSPSALTAVEQEILRACRDAKRERASVTLIAVSKTFAADAIEPVIAAGQRVFGENRVQEAKGKWPALMAAHPGLSLHLIGPLQSNKAKEAVALFDAIHSVDRPSLCAALAKEIAAQNRHPQLFVQINTGEEPQKAGIAPGEADAFVAACRKDYGLEISGLMCIPPVDEAPGPHFALTAKIAARNGLANLSMGMSADFATAIQFGATHVRVGSAIFGHR

SEQ ID NO: 2117 - protein, 551 aa, Ralstonia eutropha JMP134
MQSSHHANQASAMIPIETRIDPSSDSFASQRAGMQALIDRLHSLEQRAVAASERARPAFAKRGALLPRERIGRLLDAGAPFLPIATLAGFGMDDPNHETSIPGGSLVAGIGIVCGVRCMVLATDSGIDAGAMTEAGNMKLMRCQEIALENRLPFIHLVESAGANLRKYRVDKFIRGGSIFYNLARLSAAGLPVITVVHGSSTAGGAYMPGLSDYVVMVRNRARAFLAGPPLLKAATGEIATDEELGGADLHATVSGLAEYLAEDDEHAIATARDIVASLDWPDVAPAPGQPARAPRLDPAELDGVMTLDMKRPVDMREVIARIVDDSAWLPFKPDYGPGTVCGHARIEGHAVGFITNNGPIDPAGATKAAQFIQLCNQSGTPIVFLQNTTGFIVGRASEEAGMIKHGSKMIQALSNSTVPQITIYCGSSFGAGNFGMCGRGFHPRFCFSWPNARTAVMGGEQAAMTLEIVARQQAERKGKAVDEAQLAAQTAEIVANFERQASAFVTSGLLLDDGVIDPRDTRAVLAFVLATAREANRREPRAVQFGVARL

SEQ ID NO: 2118 - protein, 68 aa, Zea mays
  misc_feature (38)..(38): Xaa can be any naturally occurring amino acid
  misc_feature (46)..(46): Xaa can be any naturally occurring amino acid
MTTPRRQADTKRAKPQNNLTKRGAGPETTAKKSNDHPXGPTDRGAXKAEAIGSSLFQIIMTATRGGLT

SEQ ID NO: 2119 - protein, 304 aa, Physcomitrella patens subsp. patens
MAEHLASIFGTEKDRVNCPFYFKIGVCRHGDRCSRLHNRPTASQTLLLANMYQSPDAGFHGGVDQHGNIQQSDPRKLQEHFEDFYEDIFEELSKYGEIENLNVCDNLADHMIGNVYVKFREEEHAAAALNALSGRFYAGRPIILDFSPVTDFREATCRQYEENTCNRGGYCNFMHLKKISRELRRKLFGNYRRRSRSRSHSPYGRGEARGPPSPRRYGDRDFYDSRRGGGRGGGGRGRSYGRRRDRSRSRTPPRRGRSPGAREGSAERRAKIEQWNREREVRQAAETAPAGSPHRRDSAAYDNE

SEQ ID NO: 2120 - protein, 364 aa, Glycine max
MARRSLPLLKHLLLSRRIPARSVTYMHRPGDGSPRPVTLIPGDGIGPMVTGAVEQVMEAMHAPVYFEKFEVHGHMKAVPPEVLDSIRKNKVCLKGGLVTPMGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATRYPGIKYNEIIVDNCCMQLVSKPEQFDVMVTPNLYGNLVANTAAGIAGGTGVMPGGNVGAEHAVFEQGASAGNVGSDKIREQKKANPVALLLSSAMMLRHLQFPAFADRLETAVEKVILEGKCRTKDLGGTSTTQEVVDAVIDALD

SEQ ID NO: 2121 - protein, 298 aa, Secale cereale
MAARRPSPPPASPPPPRPRSTTTTRTTSSASAAPAAAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 2122 - protein, 156 aa, Oryza sativa Indica Group
MSRERKKAAALHEKLQILRSITHSHALSNTSIITDASEYIKELKQKVVRLNKEIACAEAAALRQNSIPTVTVETLGHGFLINVFSDKSCPGLLVSILEAFDELGLNVLEATASCDDTFRLEAVGGENQVDEHVIKQTVLQAISNSNCSESSGDQEG

SEQ ID NO: 2123 - protein, 371 aa, Mannheimia succiniciproducens MBEL55E
MRYDKMSPFIVMDIVREAAKYPNAIHFEIGQPDLAPSEKVKKALQSAVENNKFSYTESLGLLALREKICQYYDRTYHVKITPNRVLLTPGTSGAFLIAYALTLAQDDKLGLTDPSYPCYKNFAYMMDIQPEFMPVDKHNCYQLEVGQLKGRNIKALQISSPANPTGNIYTAESLKSLNDYCMENHIDFISDELYHGLVYDQNAATALQFNPRAYVINGFSKYYCMPGMRLGWIIVPEDKVREAEIIAQNIFISAPTLSQYAALEAFEEEFLTATKQVFQQRRDFLYDALKDLFTIEFKPQGAFYLWADVSKYTDDSYQFAKKMLHEIQVAATPGIDFGENGTKHYLRFAYTRDIEHLREGVERMKQWLKNK

SEQ ID NO: 2124 - protein, 253 aa, Secale cereale
MGRKFFVGGNWKCNGTVSQVETIVNTLNAGQIASPDVVEVVVSPPYVFLPTVKDKLRPEIQVAAQNCWVKKGGAFTGEVSAEMLVNLGIPWVILGHSERRSLLAESSEFVGEKVAYALAQGLKVIACVGETLEQREAGSTMEVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 2125 - protein, 588 aa, Mannheimia succiniciproducens MBEL55E
MSDKKQKGLEWQDNPLSDNERLKEESNHLRGTILDDLEDGLTGGFKGDNFQLIRFHGMYEQDDRDIRAERQEEKLEPRKFMLLRCRLPGGIIKPEQWIEIDKFARDNNYYQSIRLTNRQTFQYHGVPKTKLQDMHRLLHKLGLDSIATASDMNRNVLCSSNPVESELHQEAYEWAKKISEHLLPRTNGYLDVWISGKKVQSSDSFLGQEDEPILGNRYLPRKYKTAVVLPPLNDVDLYSNDMNFVGIKDEKTGKLAGFNVLVGGGLSFEHGNTKTYPNIALELGYVPVEDTLKAAESIVTTQRDFGNRADRKNARLRYTIQNMTLEGFREEVERRMGRRFEAIRPFEFTERGDRIGWVKGIDKKWHLTCFIESGRLVDKPDLPLMTGMLELAKVHKGDFRITANQNIIIANVAEEDKRQIEDIARQYGLIRKITKLRENAMSCVSFPTCPLAMAESERVLPEFIDELDKIMAKHHVEQDYIVTRITGCPNGCGRAMLAEIGLVGKAVGRYNLHLGGNIAGTRIPRLYKENITLDEILSELDGLIARWATERDQGEGFGDFVLRVGIIKPVVNPVVDFWDENLIPTVAV

SEQ ID NO: 2126 - protein, 594 aa, Physcomitrella patens subsp. patens
MRGSWLPEESFQSWGNYRRALAATPSRLKDRVFARTEVNEEVISMKARSNVDMKKNLNWWDLMWFGIGAVVGAGIFVITGVEAKNYAGPAIVISYAIAGFSAMLSVFCYTEFAVEIPVAGGSFAYLRVELGDFVAFIGAGNIVLEYVIGGAAVARGWTSYFASLIFSGIDVGDRLRIHTDLAEGYNKLDPIAVGVLILVGLLATWSTKGTSFVNWIASILNMFIIAFVIVAGLAHSHSHNLTDDFFHYGARGIFSAASVLFFAYLGFDAVSTMAEEVKNPGRDIPIGLLGSMVICTFIYIMMALTLSLMVPFTDIDEGAPFSVAFSSVGWNWAKYVVALGALKGITTVLLVSAVGQARYLTHIARSHMIPPWFARVNKRTQTPINATVTMILASSIVGFFTDLPILGNLLSMSSLFIFFLVAVALLVRRYYVPGETSPKHGGLFITYMLIIIAASIVIAAFWGMNKSGYIVYAVCGPIWFLATLALHTTLKPLRQPKTWGVPLVPWIPSLSIAFNVFLLGSLDRASFVRFGYWTGLMLVYYFFFGLHASYDTAMYHSPDLDPKTLRDEEALSSKSNEPVTGPTAAAAPTKTSIT

SEQ ID NO: 2127 - protein, 355 aa, Brassica napus
  misc_feature (153)..(153): Xaa can be any naturally occurring amino acid
MAARYWCHMCSLMVNPPVIEAEIKCPFCQSGFVEEMSGELNDGSSIREVQDSEIDFGTDRALSQWGPILLGMMSNPRRRRRFRRTELGLDNDAVNITAADVDGNDSIVDSHHHHHHNRRRHRHMQHDGEVDLDREFDSIIRRRRRSSAAILQXLQGIREGINTEDESSERNQFNTAFNFIRNNTSPSGSGDNFVGTGLAHLLEHLADNDPTRHGSLPARKEAVESLPTVKICEPLQCSVCLDEFEKGSEAKEMPCKHKFHVGCIVPWLELHSSCPVCRYELPPDDEVKPDLLRPRTRSVETNRSDVEEDARNTSGNERRFSFGWRFSGLFSSSASSSSGSAASGSSQLNENSNSG

SEQ ID NO: 2128 - protein, 132 aa, Physcomitrella patens subsp. patens
MAEQRVKLRSSDDEMFEVDEAVAFESQAVKNMIEDTGKDAVIPLPNVSSKILAKVIEYCKYHVDNQKQGEDKPPASEDEIKAWDADFVKVDQATLFDLILVRNWASVWFNIKNDFTPEEEEEVRRENQWAFE

SEQ ID NO: 2129 - protein, 349 aa, Solanum tuberosum
MTTRGTTQPLLDQLHQTQHTVGLGRKRFRRSKSTPVGEIAPVEINEIKNDQSLLRSKLILDKLHPSIRKVIVYLIIYLGIGTICFYFVRSKIKGKKIDGVLDSLYFCVVTMTTVGYGDLVPNSATTKLLACVFVFSGMALVGLVLSKAADYLVEKQETLLIKALHMGCRVGPSEILEEIETNKVRYKCFMVAAFLIMLIIIGTVVLTRVEKFDTVDAFYCVCATITTLGYGDKSFSTKAGRIFSIFWILTSTLCLGRFFLYVAEWNTEKRQREIVKWVLSRRTTNVDLEEADLDDDGVVGAAEFVIYKLKEMGKINQHDVAAVLKEFESLDVDQSGTLSTADLTLAQSS

SEQ ID NO: 2130 - protein, 315 aa, Synechococcus sp. RS9917
MTAAATSPDSAPPAGAAQGFDFNAYLAARKAEVESALDASLPPERPESLREAMRYSLLAGGKRLRPILCLAACELAGGDPALAMPTAVALEMIHTMSLIHDDLPAMDDDDLRRGRPTNHKVYGEAVAILAGDALLTRAFEMVALRSPGVPAERLLQVVAELSLVAGAPGLVGGQVVDLESEGKQVDLETLEYIHLHKTGALLRACVITGALIAGADASRIDSLRTYARGIGLAFQIVDDILDVTASSDVLGKTAGKDLIADKTTYPKLLGLEESRQRAKALVEEAKASLAAFKPTEPAKASPLLALADYVIGRDR

SEQ ID NO: 2131 - protein, 195 aa, Oryza sativa Japonica Group
MVTAVSTRLHRSTRTHDEYVVRVGGRQVVATVTAHAGGAPWTPPFRRATIRPGTLQLCAGHRCLVFQLAHADAAVPAALRRFLADERVVFVGYGVRSDCRKLEEQHGLEVARTVELRSLAGMGNTSMQRMAEEHLGWDGVTTKPRKVGTSRWDARRLSKEQVQYACVDAYLSFRLAVHVVAAPEPDATSSTSSSE

SEQ ID NO: 2132 - protein, 451 aa, Pseudomonas viridiflava
MDAALARLESWRQAQSERLSHCAPVQIRGRIAGVNGILLNSYMPRARIGDLCEISRADGSEVMAEIVGFDRQHTLLAALGPLDGIAIGASVRPLFQPHSLVVGEFLLGAVLDGFGRSLSGDGPSAFALSGAVGAQPVIRDAPPATERPRIDAPLSTGLRSIDGLLTLGEGQRVGIFAGAGCGKTTLLAEMARNTPCEAIVFGLIGERGRELREFLDHELDEELRQRTVLVCSTSDRSSMERARAAFTATAIAEGFRQQGKSTLLIIDSLTRFARAQREIGLASGEPAGRGGLPPSVYSLLPRLVERAGRTHDAAITALYSVLIEQDSMNDPIADEVRSLLDGHIVLSRKLAERGHYPAVDILTSLSRTMSNVVGTEQVHGATQVRRLMAAYQQVEMLIKLGEYQPGNDPLTDFAVQSRDQIMGFLQQSLRDPVSLDETLDHLIQVTADVPR

SEQ ID NO: 2133 - protein, 268 aa, Roseovarius nubinhibens ISM
MAKAHAKLSELDPVWKQITEEAKDTIAQEPLMGGLVHSSILHHKTIESALAYRISLKLASSEMPEQILREICDWALAADPNISLASRADIVAVNDRDPACDRFILPMLFFKGFQAVQAHRVAHWLWHNERKDMARFFQMRCSEVFGIDIHPAARMGKGIMIDHAHSIVIGETAVVGDNVSMLHSVTLGGTGKEEEDRHPKIGDGVLIGAGAKVLGNIKVGHCSRIAAGSVVLSEVPPCKTVAGVPAKIVGEAGCDQPSVAMDQLLGVR

SEQ ID NO: 2134 - protein, 153 aa, Streptococcus mitis
EHFIRGQYRSGKIDGMKYISYRSEPNVNPESTTETFASGTFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 2135 - protein, 429 aa, Roseovarius nubinhibens ISM
MPALSPTMEEGTLAKWLVKEGDTVSSGDLLAEIETDKATMEFEAVDEGVIGKILVAEGSEGVKVNTPIAVLLEEGESADDIGEASAPAAEPKAEAPKSDAAPKPEAAPAASAAPAAPKADGERIFASPLARRIAADKGLDLSQISGSGPRGRIVKADVENAQPSAAKPAAKDQPAAAPAAAAPAATGPSSSQVIAMYEGREYEEIPLNGMRKTIAARLTEAKQSIPHFYLRRDIRLDALLKFRGQLNKQLEARSVKLSVNDFIIKACALALQTVPAANAVWAGDRVLQLKPSDVAVAVAIEGGLFTPVLKDAEMKSLSALSSEMKDLASRARDRKLAPHEYQGGSFAISNLGMFGIDNFDAVINPPHGAILAVGAGVKKPVVGADGELSVATVMSVTLSVDHRVIDGALGAQLLDAIVQNLENPMVMLA

SEQ ID NO: 2136 - protein, 333 aa, Roseovarius nubinhibens ISM
MAQPPIRIALNGFGRIGRAILRILLREGQDFELVLINEIEPLETCAYLFEYDSVFGPWSGTVETGPETLIVDGRSIPFLAAPDLSALDLSGVDLVLECTGMAGARPVAERGLAAGAGAVLVSGPSAEADITLVLGANDAALGAERIISNASCTTNALAPLARLLDDAFGIISGQMTTVHCYTGSQPTVDKPRGAPERSRAAALSMVPTTTSAQHQTGLVLPKLKGRIEARAIRVPTASVSAIDLTLHTEAPVTVSEVNAVLEAAAKSGPVFGYTRKPLVSSDLRGRSESVILCGHETSVSTGGLLRVFGWYDNEWGFSCRMLDMARLIARRRA

SEQ ID NO: 2137 - protein, 526 aa, Burkholderia sp. 383
MTNVELFHYLLLLICGAGALTWLAERISIPPAVVLLLGGCVVAVAGKRVPDMDPALLLAAVLPPLLMSSGFYTAWKEFRQELASIASLALGAVVFTTVAVALVVHAVNPTLPWAACFTLGAIVSPPDAVAAKAILQRHPLPSRLVAVLEGESLVNDASGLLLYQMAVSAALAVSITAASATGLFFSLTLIGIAVGLACGHAMSWVLPRLRDPMLGIVVTFAMAWGSYGIAEAVDGSGVLSVVTCGLVLGVRQHRVFDADMRIKAKATWEAIVFVLDALVFILIGLALHAILARVNHEGAVLMAGLRVALPATAAAIAARIVWVFVAMWLPGRLRAPRAGHAPWSWREAVVLGWSGMRGVVSLAAAIALPANFPGRDLILFSTFLLIIATLVVQGGTLAPLIRVLKLHPAARHTMSEHAVRAHAFGAALAELDALEQRGSTLERPSLDRLLAEYRNRVTFNDRAHRQGAEPAKVRSRMLRVELELVGVSRRALLDLHRDGKVDDAVLHRIESELDFEELRLQRLLEP

SEQ ID NO: 2138 - protein, 364 aa, Ficus carica
MAFSHHLLVTLFFSAFVVGGYAQLTPTFYDDTCPNVTSIVRGVIEGALQTDPRIAASLIRLHFHDCFVIGCDGSLLLDNSDTIVSEKEALGNNNSVRGFNVVDDIKTALENACPGVVSCADILAIAAEESVWLSGGTSWPVPSGRRDSLIANRTLANEVLPSPFLTLDQLKANFLDNQGLNSTDLVALSGAHTFGRAQCQFFSRRLYNFNDTGSPDPTLNTTLLETLRKICPEGGNGSVITDLDQTTPDAFDNKYFSNLEVEYGILQTDQVLFSTSGADTTAIVNRFSADQNAFFDSFVASMIKMGNIRVLTGNERKIRSNCRRGIGDISGVSSGRFGCEVFRGLFYNKITWEKVRPDQGHEYK

SEQ ID NO: 2139 - protein, 297 aa, Bacillus anthracis str. A2012
MVESCSNKVVAYKKCNDERETTVHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 2140 - protein, 51 aa, Brassica juncea
LADRKIEKFDKNITKRGFVPETTTKKGKDYPVGPILLGFFVFVVIGSCEYS

SEQ ID NO: 2141 - protein, 149 aa, Geobacillus stearothermophilus
MAERTFLMVKPDGVQRNLIGEIVSRFEKKGFQLVGAKLMQVSRELAEQHYAEHKERPFFGELVDFITSGPVFAMVWEGENVIAAARQMMGKTNPQEAAPGTIRGDFGLTVGKNVIHGSDSPQSAEREINLFFKEEELLNYTKLLNEWLY

SEQ ID NO: 2142 - protein, 62 aa, Brassica juncea
LADRKIEKFDKNITKRGFVPETTTKKGKDYPVGPILLGFFVFVVIGSSLFQIIRTATSGGMA

SEQ ID NO: 2143 - protein, 250 aa, Zea mays
TLQDPFPFPSPPAPPPRPLRQPPAPPLRRAPPLHRGGREAGGLTKSVGCGGGDPGAGAESRERGQQSLIYAFGARGTGVVAEYTEFTGNFTTIAAQCLQKLPASNNKFTYKCEGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAPARRRRLHVEFFLLL

SEQ ID NO: 2144 - protein, 160 aa, Glycine max
MVKICCIGAGYVGGPTMAVIALKCPEIEVVVVDIAAPRINAWNSDHLPIYEPGLDDVVKQCRGKNLFFSTDVEKHVAEADIVFVSVNTPTKTQGLGAGKAADLTYWESAARMIADVSKSDKIVVEKSTVPVKTAEAIERILTHNRKGINFTILSNPEFLA

SEQ ID NO: 2145 - protein, 491 aa, Physcomitrella patens subsp. patens
MRRGVNLVPGQSFTHSVLQRNTENLKDLYTLGRKLGQGQFGTTYLCVEKTTGKEYACKSIAKRKLISQEDVDDVRRELHIMHHLSGHPNIVTIKGAYEDQVSVHLVMELCAGGELFDRIIQRGHYSEAQAAELCRVIVGVVETCHSLGVMHRDLKPENFLLSDPSENAALKTTDFGLSVFFKPGEVFTDVVGSPYYVAPEVLRKHYGPEADVWSAGVILYILLSGVPPFWAETEQGIFEQVLAGELDFVSEPWPSISESAKDLIRRMLDPVAKRRLKAHQVLSHPWIREAGVAPDRPMDPAVQSRLKQFSAMNKLKKVAIRVIAEFLSEEEIAGLREMFKMIDTDHSGSITFEELKSGLERVGSNLVESEIRQLMDAADVDQNGTIDYGEFLAATLHLNKIEREENLFAAFSWLDKDHSGYLTVDELQHACSEYNIGDTSIEELIREVDQDNDGRIDYNEFVTMMRKGNGTVGRATLRNSLSLSDALMHTN

SEQ ID NO: 2146 - protein, 93 aa, Synechococcus sp. RS9917
MASFTISIDGGSSFSCADDQYILDAAEEQGIDLPYSCRAGACSTCAGKILSGSVDQSDQSFLDDDQIAKGYALLCVSYPLSDCSVKTDVEDEL

SEQ ID NO: 2147 - protein, 285 aa, Vitis vinifera
  misc_feature (14)..(14): Xaa can be any naturally occurring amino acid
MGLGRALARRAGPXVGRGPRAFWRPLLPMFILNITKTTIINDVALQCIARVPRSRHPHLLLVCKSWRSILNSPDFFSTRSLLNCMQHSLYLIVRVNCTLKWFVLNQNPRILASLPPNPSPAIGSAFAAIGSKIFVLGGSVNDVASPTVQVFDCRFGTWELGPRMRVGREFAAAGVVGRKIYVMGGCLVDTWAKSANWAEVFDPAAGRWAGVESPVEVREKWMHASAVVEEKIYAMADRGGVVFEPGTAEWGGVSTELDLGWRGRACVVDGVLYCYDLFWAKSGGF

SEQ ID NO: 2148 - protein, 468 aa, Clostridium perfringens SM101
MSNLKKKRVKSREQDPIERGKNFKEVSLGYKEEEAIEEANRCLGCKNPKCVEGCPVSVNIPSFISFIKKGDFSASFEELSKYNALPAVCGRVCPQESQCEGKCVLGIKGEPLAIGQLERFIADFARNNKLSPLKKSDKTLEKVAVIGSGPAGLTCAGELAKLGYRVTIFEALHESGGVLVYGIPEFRLPKKDVVKYEIEEIKKLGVKIENNVVVGKTVDIDELIENEGFKAVFIGSGAGLPKFMGIKGENANGVFSANEVLTRVNLMKAFKNESHTPLNLGKKVAVVGGGNVAMDAARTSLRLGAETHIIYRRSEKELPARLEEIHHAKEEGVILDVLTNPTEILTDENGWVKGIKCIRMKLGEEDSSGRRRPIEIENSEFIMEVDSVIMSLGTSPNPLISNATKGLKTNKRGCLLVDEESLKTSLKGIYAGGDAVTGAATVILAMGAGKKAAKSIDSYLRKEEQNNI

SEQ ID NO: 2149 - protein, 958 aa, Zea mays
VCKDRDQAECWYLGLTAVISAPCTPLLLIDSTNSRRINSCTNSPPSYIQQRSRLFAVHDGRNFPKVNSLYGSPRLIQNKYLRNNLDCSEPFFSPRQRAWSELDFYLEKISPELVDRVKNNLRDIKSAEIINDQRIMQIPKLKQSEGSNAAADSLKDIFVWGDALGRMSDHGHVSASNISLPRLLKSSEILDVQSIACGEKHAAIVTKQGQVFSWGEENGGRLGHKTSDSVSDPKIIDSLSSTPVKTIAFGAKFTCAVSVSGELYEWGEGIDSLGFGTNQCQRSPWFPHKLIRTSDGISVAKIACGQWHTAIVSSTGKLFTYGHGAFGVLGHGDTRSFVQPKEVESLRGLRVKSVACGPWHTAAIVETSGTLKSNAPGGKLFTWGDAGGEKMGHTDKKSKLVPTRVESLVDCDFTQVSCGISLTAVLTITGVVFTIGSKDHGQLGNPRSDTDSACICMVEGPLKTEFVKDISCGSSHVAVLAMNGKVFTWGKGTEGQLGLGDYVDRSSPTLVEALEDKQVDSIVCSSNSTAAICVHGEISSKDQSVCSSCRLAFRFTRKKHNCYNCGSMVCNSCSSNKVHRAALAPDKSKRCRVCDACFNELNKTAEHGKMSCGSKIQKEPSYLAETRTYTPKLSRMLKEANFIMEKMGSSAQSPGQRNQEPATPNQMQKERWGQVECPDRFKCARDNIPHRLTPKKQTIDDYPMRRMADPVSQKTAAPLTQTTSDRRKEQDLIEKILLEEVKQLQAQVTTLAEECRHRSLKVRLYKRKLEETWLIVRDEATKCEAAEEIIKVLTNQRNALSNKLLDGLELDGSSIVPNPPDKALATCKTPPLNSIRDQHNAEAEEVLDTRSTASSNTVAVDDSAAHQNGRSRASSSSRGYYDDGGTDSTAAPTDSNGVIEQIERGVYITVVTSPSGKKGIKRIRFSRKHFGEAEAQKWWERNESRVFAKYDSVEYLAA

SEQ ID NO: 2150 - protein, 588 aa, Petunia x hybrida
MAGVANGGTKCIQDSSSASAIANAEATLGRHLARRLVEIGIEDVFSVPGDFNLTLLDHLIAEPKLKNIGCCNELNAGYAADGYARERGIGACVVTFTVGGLSVLNAIAGAYSENLPVICIVGGPNTNDYGTNRILHHTIGLPDFSQELRCFQTVTCYQAVVNHLDDAHEQIDKAISTALKESKPVYISISCNLPAIPHPTFSRDPIPFSISPRLSNKRGLEAAVDATVAFLRQAVKPVMIGGPKLRVAKALNAFVEFADSSGYAMAVMPSAKGLVPEQHPHFIGTYWGAVGTSYCGEIVESADAYLFAGPIFNDYSSVGYSLLIKKEKSIIVQPDRVVIGNGPAFGCVLMKDFLTELAKRIQKNTTAYENYRRIFVPEGTPPKSEPNEPLRVNVMFQHIQKMLSDETAVIAETGDSWFNCQKLKLPKGCGYEFQMQYGSIGWSVGATLGYAQSVPKKRVISCIGDGSFQVTAQDVSTMIRCDQKNIIFLINNGGYTIEVEIHDGPYNVIKNWNYTGLVEAIHNGEGNCWTQKVRTEEELTDAIATATGEKKDCLCFIEVIVHKDDTSKELLEWGSRVCSANGRPPNPQ

SEQ ID NO: 2151 - protein, 448 aa, Brassica napus
  misc_feature (133)..(133): Xaa can be any naturally occurring amino acid
  misc_feature (161)..(161): Xaa can be any naturally occurring amino acid
RGSFTRWTEHVPLSPLEGCPSVFQVICNLTPGYHQYKFYVDGEWRHDEHQPFVNGNGGVMNTILITLPDMVPTGFSPSNMDVDDFSQQMADPSQDSIPRMSAVDLEMSRHRISVLLSTCTAYELLPESGKVIXALDVNLPVKQAFHILYEQGIPLAPLWDXFGKGQFGGVLGPLDFILILKELGTHGSNLTEEELETHTIAAWKEGKAHISRQYDGTGRPYPRPLVQVGPYDNLKDVAMKILQNKVAAVPVIYSSLQDESYPQLLHLASLSGILKCICRYFRHSSSSLPILQQPICSIPLGTWVPRIGESSSKPLATLKPHASLGSALTLLVQAQVSSIPVVDDNDSLIDIYSRSDITALAKDKAYAQIHLDDMTVHQALQLGQDSSPPYGSLNGPRCQMCLRSDSLGKVMERLANPGVRRLVIVEAGSKRVEGIISLSDVFRFLLGL

SEQ ID NO: 2152 - protein, 507 aa, Petunia x hybrida
MDAKIGSIDTCKPTTNNVATLPTNNTVTISTHTPSTTIIPCNSTTDSTLGRHLARRLVQVGITDVFGVPGDFNLTLLDHLISEPNLEFIGCCNELNAGYAADGYARPRGVGACVVTFTVGGLSVLNAIAGAYSENLPLICIVGGPNSNDYGTSGVLHHTIGLPDFSQELRCFQTVTCYQAVVNNLEDAHEMIDTAISTALKESKPVYISISCNLPAIPHPTFSREPVPFSLSPRLSNQMGLEAAVEAAAEFLNKAVKPVVVGGPKLRVAKASDAFVELMDASGYAVAVMPSAKGMVPEHHPHFIGTYWGAVSTAFCAEIVESADAYLFAGPIFNDYSSVGYSLLLKKDKAIIVQPDRVTIGNGPAFGCVLMKDFLAALAKRLKHNPTAHENYRRIYVPEGHPLKCEPNEALRVNVLFEHIQRMVSADTAVIAETGDSWFNCQKLKLPEGCGYEFQMQYGSIGWSVGATLGYAQAARDKRVLAFIGDGSFQVTAQDISTMLRCGQRTI

SEQ ID NO: 2153 - protein, 383 aa, Glycine max
  misc_feature (170)..(170): Xaa can be any naturally occurring amino acid
  misc_feature (202)..(202): Xaa can be any naturally occurring amino acid
  misc_feature (228)..(228): Xaa can be any naturally occurring amino acid
MATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPVAPLXEKVCLLGCGVSPGLGAVWNTAKVESGSIVAIXFGLGNCWALLLQKGAKTVGASRVIGXIDIGSNRKERAKNLGVTEFINPNEHEKPVQQVIVELTDGGVDYSFECIGNVLVMRSALECCHKGWGTSVIVGVAASGQEICTRPFQLVTGRVWKGTAFGGFKSRSQVPWLVDKYLKKEIKVDEYITPSLSLAEINKAFDLMHEGGCLRCVLAMNV

SEQ ID NO: 2154 - protein, 282 aa, Roseovarius nubinhibens ISM
MNRDWIATARTLSEALPYLQRYDDAIVVIKLGGHAMGSDEAMETFARDVVLMRQVGVNPVVVHGGGPMINEMLGRLDIQSEFVNGKRVTDEATMEVVEMVLSGRVNKRIVAAINAQGGRAVGLSGKDANLVTCTPANPELGLVGDPTKVDPSILHTLFRDDMIPVIAPLGAGENGETYNINGDTAAGAIAAALRADRLLLLTDIDGVRDAEGRVITELTAQDIHDLVADGTIAGGMIPKTETALAAIEGGVRAVVILDGRAPNAPLLELFTDHGAGSIIRAK

SEQ ID NO: 2155 - protein, 285 aa, Bacillus anthracis str. Ames
MKLSVYVASAFSKDHKGGNKAGVVFIENSLTTTQKMAIAKQLGYAETAFISESEIADYKFEYFTPKEEVDLCGHATIGSFAILMHLNKLFRNRYTIETNSGVLTITIKDDSIFMEQNNPIFYDVVSPNEFIDCFDMKAIDNKYPIQIVSTGLKDILIPIKSETRLHALQPSFEKIKEISKYYNVVGMHLYTFNDDRIICRNFAPLYDINEEAATGTSNGALACYLHEQHNLQKEVYVFEQGYSLQSPSEILVTLATNSKNEIEKVYVGGKGYYCETKCLNVENME

SEQ ID NO: 2156 - protein, 290 aa, Oryza sativa
MGKDEVMESGGAAGEFAAKDYTDPPPAPLIDAAELGSWSLYRAVIAEFIATLLFLYITVATVIGYKHQTDASASGADAACGGVGVLGISWAFGGMIFILVYCTAGISGGHINPAVTFGLFLARKVSLVRAILYIVAQCLGAICGVGLVNAFPNAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 2157 - protein, 331 aa, Saccharum hybrid cultivar H65-7052
MTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 2158 - protein, 187 aa, Geobacillus stearothermophilus
MSLVGKKVQPFRAQAYHNGEFIEVTEQDFMGKWSIVCFYPADFTFVCPTELEDLQDHYATFKELGVEVYSVSTDTHFTHKAWHDTSPAISKIEYVMIGDPSHQLSRMFDVLDEEQGLAQRGTFIIDPDGVIQAVEINADGIGRNASTLIDKIKAAQYVRNHPGEVCPAKWKEGAETLKPNLDLVGKI

SEQ ID NO: 2159 - protein, 478 aa, Staphylococcus aureus subsp. aureus MRSA252
MNMNESGDNKLSKSSLIGLVIGSMIGGGAFNIMSDMGGKAGGLAIIIGWIITAIGMISLAFVFQNLTNERPELDGGIYSYAQAGFGDFVGFISAWGYWFSAFLGNVAYATLLMSAVGNFFPIFKGGNTLPSIIVASLLLWGVHFLILKGVETAAFINSIVTVAKLIPILLVIICMIIAFNFDTFKTGFFGMTSEGVLPFSWASTMSQVKSTMLVTVWVFIGIEGAVIFSSRAKNKKDVGSATVIGLISVLIIYFLLTVLAQGVILQNHISQLDSPSMAQVLASIVGGWGSTLVNIGLIISVLGAWLGWTLLAGELPFIVAKDGLFPKWFAKENKNGAPVNALLITNILVQLFLISMLFTQSAYQFAFSLASSAILYPYMFSAFYQVKYTLEHRQQATTKQWTIGIIASIYAIWLIYAAGINYLLLTMLLYIPALLVYSIVQKNNQTRLIKSDYILFMIIIVLAVIGLIKLLMGTINVF

SEQ ID NO: 2160 - protein, 336 aa, Staphylococcus aureus subsp. aureus MRSA252
MTEIQKPYDLKGRSLLKESDFTKAEFEGLIDFAITLKEYKKNGIKHHYLSGKNIALLFEKNSTRTRAAFTVASIDLGAHPEFLGKNDIQLGKKESVEDTAKVLGRMFDGIEFRGFSQQAVEDLAKFSGVPVWNGLTDDWHPTQMLADFMTIKENFGYLEGINLTYVGDGRNNIAHSLMVAGAMLGVNVRICTPKSLNPKDAYVDIAKEKASQYGGSVMITDNIAEAVENTDAIYTDVWVSMGEESEFEQRINLLKDYQVNQQLFDLTGKDSTIFLHCLPAFHDTNTLYGQEIYEKYGLAEMEVTDQIFRSEHSKVFDQAENRMHTIKAVMAATLGS

SEQ ID NO: 2161 - protein, 70 aa, Brassica juncea
NEDELRDAVLLVFANKQDLPNAMNAAEITDKLGLHSLRQRHWYIQSTCATSGEGLYEGLDWLSNNIANKA

SEQ ID NO: 2162 - protein, 524 aa, Vitis pseudoreticulata
MAARRISSLLSRSLSVSSAFSLSLGKNFNRGKSIHRFSTAAAAVEELITPTVQINYTQLLINGQFVDAASVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGVLNIVSGYGPTAGAALASHMDVDKIAFTGSTDTGKIVQELAAKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIKSGVESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYNLNNYLQVKAVITPLRNPAWL

SEQ ID NO: 2163 - protein, 354 aa, Triticum aestivum
  misc_feature (222)..(222): Xaa can be any naturally occurring amino acid
  misc_feature (246)..(246): Xaa can be any naturally occurring amino acid
VTSRTSLYKKAGWYRSGIPGISSTHASVGRPNKKKFIARSKAYHGSTLISASLTGLPALHQKFDLPAPFVLHTDCPHYWRFHLPGETEQEFATRLAKNLEDLILKEGPETIAAFIAEPVMGAGGVIPPPKTYFDKVQAVVKKYGILFIVDEVITAFGRLGTMFGSDMYNIKPDLVTLAKALSSAYVPIGATLVSPEIAAVVDSQSNKLGSFAHGFTYSGHPXACAVAIEALKIYREKDIPDHVKQXAPPFRKERRASAGSPMVGEIRGVGLILETEFANNKSRDDPFPAEWGVGAIFGQECQKRGMLVRVAGDSIMMSPPLTMTPGEVDELVSIYGEAMKSTEERVAELKSKKN

SEQ ID NO: 2164 - protein, 303 aa, Physcomitrella patens subsp. patens
MDKYEKLEKVGEGTYGKVYKARDKLTGQLVALKKTRLEMEEEGVPSTALREVSLLQMLSHSIYIVRLLCVEHVEKGGKPMLYLVFEYMDTDLKKYIDLHGRGPSGKPLPPKVVQSFMYQLCTGLAHCHGHGVMHRDLKPQNLLVDKQTRRLKIADLGLGRAFTVPMKSYTHEIVTLWYRAPEVLLGATHYSLPVDIWSVGCIFAELVRKMPLFTGDSELQQLLHIFRLLGTPNETIWPGVSQHRDWHEFPQWRPQELSLAVPGLCAVGLDLLAKMLVFEPSKRISAKAALSHPYFADFDKTSA

SEQ ID NO: 2165 - protein, 144 aa, Brassica napus
MAATRASPVLLLLLTVQLSLLFRLPDSPSTLALALAAEPEQQNAKQHRQPALLVQSTCNSTSFYDLCIAALAADPASSTADVPGLGAIAVSAAANNASGTAAFLGNASDAAATPQADRALLRACAGKYAAARDALVQARASLAE

SEQ ID NO: 2166 - protein, 638 aa, Gloeobacter violaceus PCC 7421
MNLSDLSHPNQLRDLSVSQLGRLAQQIRDKHLQTVAATGGHLGPGLGVVELTLALYKTLDLDRDRVVWDVGHQAYPHKMLTGRYANFHTLRQKDGLAGYLKRAESPFDCWGAGHASTSISAALGMALARDFQGLNRKVVAIIGDGALTGGMALEALNHAGHLSKTNLMVILNDNEMSISENVGGLSLYLNRLRTDPALRQIRSNLETQLRNIPLVGPTFSPEFERFKDTVKYMTMTRSKAGVIFEELGFTYLGPIDGHNLGDLIETFEFAHSLPGPVFLHAITVKGKGYEVAEQNQIKYHAQSAFDLATGKAKPASKPTPPAYTSVFAQTLVKLAEQNEKIVGITAAMPTGTGLDKFKERFADRYFDVGIAEQHAVTMAAGLAADGMRPVAAIYSTFLQRAFDQIIHDVAIQDLPVFFCLDRAGVVGEDGPTHHGVFDLAYLRQIPGLVVMAPKDEAELQRMMVTGIQYTKGPIAVRYPRGSGSGAPLMAEGWDPVPIGKAEVLRSGDDLLIVAIGTMVHPSLQAAALLSEHGIDATVVNARFAKPLDTELLLPLARRIGRVVTVEEGCRMGGFGSAVLEALMDGGIAVPTLRIGIDDKFVTHAGRSQLLDLLGLTPSGIAKTIRESLSTEPVSAPRA

SEQ ID NO: 2167 - protein, 240 aa, Brassica napus
  misc_feature (228)..(228): Xaa can be any naturally occurring amino acid
MARAACSSVVTALSLLPSKSHHLLRNQFSFSGKSNKFVGVLTLERRCFSSTVSMSLKAGIVGLPNVGKSTLFNAVVENGKAQAANFPFCTIEPNVGIVAVPDSRLQVLSKLTNSQKVVPASIEFVDIAGLVKGASQGEGLGNKFLSHIREVDSILQVVRCFEDNDIVHVNGKVDPTSDIDVINLELIFCDLDQIGKRLDRLNKGKPKDSQSKVKEEAEKSALQRIQEXALLDGKPARSVA

SEQ ID NO: 2168 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 2169 - protein, 284 aa, Physcomitrella patens subsp. patens
RQSTHYRKIKDDYESVEEVQQALRDAGLESSNLVVGIDFTKSNEWTGKNSFGGRSLHAIGGDLNPYERALSIVGRTLSSFDEDNLIPCFGFGDATTHDTEAFSFYADHRPCDGFEEALARYRSIAPHIRLAGPTSFAPVINAAVDIVEKTGGQYHVLVIIADGQVTRSVNTQEGQLSPQEQATVDAIVNASKYALSIVLVGVGDGPWDTMQRFDDDLPQRNFDNFQFVNYTEIMLHNLPPMVADAKFALQALMEIPQQYNATKEIEILGTQRGHSPGIELLPPP

SEQ ID NO: 2170 - protein, 369 aa, Triticum aestivum
MAIGGVGAGGGAGGGEGLGRSVLVTGGAGFIGTHTVLQLLEKGYAVTAVDNFHNSVPEALDRVRHIVGPALSARLQFIFGDLTIKDDLEKVFAAKKYDAVIHFAGLKAVAESVAHPEMYNRNNIVGTVNLYDVMKKHGCNKLVFSSSATVYGQPEKVPCFEDSPLKALNPYGRTKLYLEEMLRDYQHANPEWRTILLRYFNPIGAHESGDIGEDPKGVPNNLLPYIQQVAVARRPELNVYGHDYRTRDGTAVRDYIHVVDLADGHIAALEKLFATPDIGCVAYNLGTGRGTTVLEMVSAFEKAYGKKIPVKMCPRRPGDSEQVYASTAKAEEELGWRAKYGIEEMCRDQWNWAKKNPYGYCGNAAENKD

SEQ ID NO: 2171 - protein, 399 aa, Mannheimia succiniciproducens MBEL55E
MFDTTGFRSHFPYFQHPDRVIYLDNAATTLKPQSLIDATVKFYQSAGSVHRSQYDEEQTALYEQARSQVRQLINAESDKAIIWTSGTTQAINTVANGLIPYIQSDDEIIISEADHHANFVTWSMIAQKCGAKLRILPIQDNWLIDENALLEALNKRTKVVVLNFVSNVTGTEQPVEHLIRLIRKHSSALVSVDAAQAISHVKIDLRKLDADFLSFSAHKIYGPNGLGVLSGKLTALELLQPLIYGGKMVDRVSKQQISFAELPYRLEAGTPNIAGVIGFNAVLSWLNQWDFEQAEHHAVQLAEQTKVRLKNYEFCQLFNSPKPSSVISFVFKNIAGSDLATLLAEQNIALRTGVHCAQPYLSRLGQHSTLRLSFAPYNTQQEVDAFFTALDKSLALLEE

SEQ ID NO: 2172 - protein, 185 aa, Vitis vinifera
MRPPTSLKKEFLKKWIMGLQLCSSSKKEMSFLERKKAIKLSADVAMASARNATTRWSRALISNASKDDSNKGLVECILGPESESLKRASMSLVLCNKRNRSKKILRKSCSIRRARKSSSQMVMASSIAKRLVKKRTQVLKSLVPGGGSMSEFSLIEETLDYILSLRAQVDVMRHLANATELLNRK

SEQ ID NO: 2173 - protein, 328 aa, Clostridium perfringens SM101
MAILVCGGAGYIGSHMVAELIENNKEVVILDNFEKGHEDAILGGKLYKGDLRDRKILDKIFTENNIEAVIDFAAYSLVGESMTEPLKYFNNNVSGTISLLEAMRDHNVKYIVFSSTAATYGEPENIPILETDKNLPTNAYGESKLLVEKILKWCDTAYGIKYTALRYFNAAGAHVNGKIGEDHAPETHLIPLILQVALGKRDKIMMFGDDYDTKDGTCVRDYIHVSDLASAHSLALERLMNGGESRIYNLGNGTGFTVKEVVEVARKVTGHQIPAEVAPRRAGDPAILIASSDKAIEELNWKPKFNSLETIIETAWNWHKNHPNGYEK

SEQ ID NO: 2174 - protein, 295 aa, Nitrosomonas europaea ATCC 19718
MPSPSAINEKVNILAEALPYIRRFHDKTIVIKYGGNAMIEEALKQGFARDVVLLKLVGMNPVIIHGGGPQIDHMLKRVGKEGVFIQGMRVTDAETMDIVEMVLGGLINKEIVNLINRHGGQAVGLTGKDGMFIRAKRMLIQDKEKAGEWINIGQVGEIEYIDPSLIALLDTRDFIPVIAPIGVGEDGESYNINADLVAGRLAETLKAEKLILMTNTPGVLDKNGNLLTGLTAGRVDELFADGTISGGMLPKIKSALDAVKNGVKSCHIIDGRVQHALLLEILTDEGVGTLIKGNG

SEQ ID NO: 2175 - protein, 321 aa, Bacillus anthracis str. Ames
MKALCFETFGNADVLQYKEIPDPIINPNEILVRTKAIGLNFADIYRRRGDYHLAGNPPYILGYEGAGIVEEIGTNVTTIKPGDRIAFADVPFANAELVAVPSKKTIQLPNSISFETAASVLLQGLTAHYLTKDSYQIKQGDIALVHAAAGGVGQLLIQIIKLLGGTAIGLTSSNEKAKVATLAGADHVFLYSEKWHSKVLEITNGTGVNVVYESVGSTLEESFNATKIGGTVVFYGMAGGNPAPVDPRMLMDTSKTLTGGDLWNVLTTFEERKQRSTQLFDWIASGKLNIASPTTFSLQDGAHAHKLLESRKSTGKILLIP

SEQ ID NO: 2176 - protein, 239 aa, Brassica napus
DTLKFVVNQSDYTVGILRNVTQYLSLAKTINVTSISVSSNVLGEIEKLNVNLKAAAETIEEKTRDNAAKIKRVFYAVRSALITVATVMLILSFLGLLLSVLRHQHAIHIFVVSGWILVAVTFVLCGVFLILNNAISDTCVAMKEWVDHPHAETALSSILPCVDEQTTNKTLTQSKLVINSIVTVVNTFVYAYANTNPSPGQNFYYNQSGPPMPPLCSPFDANMEDRECGSWELSIGNAS

SEQ ID NO: 2177 - protein, 105 aa, Oryza sativa Japonica Group
MADDDDDQDEVQESMEDQTAAAAGLDSRVKASLVLGTESFAISSESGILSEQLAAMKEKSMEILKGYITKHNAPADVPDEPIEGLSDDEGDAPAKNPPKKPKKQK

SEQ ID NO: 2178 - protein, 442 aa, Oryza sativa
  misc_feature (91)..(91): Xaa can be any naturally occurring amino acid
MMKPQHGGMAGHGGGRTRSPFLTSYALTLAFITFVSVLYFKDFSSTLHQPFLTRPPPHRRQIARPRAPSHHHGGGSSSGGGDVVPPFAVGXAAAAAGCDVGVGEWVYDEAARPWYEEEECPYIQPQLTCQAHGRPDTAYQHWRWQPRGCSLPSFNATLMLEMLRGKRMMFVGDSLNRGQYVSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVRWVENNMNPRNSRVFFVTMSPTHTRSKDWGDDSDGNCYNQTTPIRDLSYWGPGTSKGLMRVIGEVFSTSKVPVGIVNITQLSEYRKDAHTQIYKKQWNPLTPEQIANPKSYADCTHWCLPGLQDTWNELLYSKLFFP

SEQ ID NO: 2179 - protein, 204 aa, Cryptococcus neoformans var. grubii
MGGCMSTPEAPRKAAETKQVPSTSTTSRPPQASTSATATAAGASTSPPNGTANGIKGDTTAANRTGASAGQGIVAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDADLNAVIPSEIL

SEQ ID NO: 2180 - protein, 348 aa, Guillardia theta
ADTLVELARQDPTVCGITAAMPGGTGLDKFGKIFPKRTFDVGIAEQHAVTFAAGMAVDGLKPFCAIYSTFLQRGYDQVIHDCIIQSLPVRFMVDRAGLVGNDGPTHHGCFDLAYLGTLPNIVIMAPADEIELMRMVKTAHAIDDKPSVVRYPRGNGFGAEGLNKLFGYNLKSTPLPSEVSALPVGEGRMIRRADPEAKTKVAILSLGTRLCEAVRALRMIQQEGNGIGVTIADARYMKPLDKELIRSLVEEHDVLITVEEGAVGGFGDHVNHFLTNEGLLDSGKCRLRVMVLPDQFVEAGGQKQQYDFAGLQAKHIAATAFRALDRQGEALEVLAAAPAVGMGKPSVA

SEQ ID NO: 2181 - protein, 1869 aa, Arabidopsis thaliana
MEPTDVSTGTCKVLLLDTKRYGYWKVRMTQIIRGQGEDAWTAVEEGWEPPFDLTEDGFKITKPKANWTAEEKLQSKFNARAMNAIVNGIDEDEFKLIQGCKSAKQAWDTLQKSHEGTSSVKRTRLDHIATQFEYLKMEPYETIVKFSSKISALANEAEVLGKTYKDQKLVKKLLRCLPPKFPAHKAVMRVAGNTDKISFVDLVGMLKSEEMEPDQDKVKPSKNIAFNADQGSEQFQQIKDGMALLARNFGKALKRVERGQNRDSTSWSNKDGETSRGRFSRSENDDLGKKKEIQCYECGGVGHTKFECPNKSKLKEKSLITFSDPESDDEGEELLNFVAFMASSDSSKVMSDTDSDCDQEVNPKDEYRVLYDSWMQLKDKQKLSGITVDENSQDYYQKKFDWLQEECHMERDRAKLLERELNDKHKQIRMLNKGSESLDKILAMGRTDSQPRGLGYQGYTGKINKEEGRVINFVSGGSTSETVVRQSYTEPKKQVKSHVETKGECFVRTRMIKKKDLYGDMEAERYNYKLERMYEEEEMHYASVYNQVNKEMQDEANLVCNWNLSELDDCTPQAKVAYTSVVSQNNRAWYFDSGCSRHMTGVQSILKDFSVINNGKVTFGDGGKGSIKGKGKIEIDDQPHLSNVYFVEGLTANLISISQLCDDDLTVTFTKTGCVALDIAGNNVLSGVCSGNNCYMWKDSEVCLSAITSKLDLWHQRLRHMNTQSLVKIVNADVVRGIPKLEGSTSVVCKTCSQGKQVKVQQKRATHIGTTSVLELVHMDLMGPVQTESLSGKKYILVLVDDYSRFTWVRFLREKFEAAESFKILALQLQTEKGNLVQIRSDHGGEFQNEEFEKFCRIQGIRHQFSAPRTPQQSGVAEAVNTACYIVNRVYVRPGTSTTPYEIWKGRIILESLMQESDEGIFLGYATNSMAYRVYNKRLKRVEESVNVFFYDKHPTRLFTVEQDDDEQVEEIRHSTSLVESGTSKDVEQTTEPRTSSSRLTVPKSHSETDVIGELDGDRVTRGIKMNYRDMILFTCFVSSIEPKNIEIALEDEFWYQACHEELNHFSRHEVWDLVPRQVHVNVVGTKWIFKNKTDEEGNVTRNRARLVAQGYSQVEGIDFDETFAPVARLESIRLLLGISCLLKIKLFQMDVKSAFLNGVIQEEVFVSQLKGFEDSNLPDHVYKLKKALYGLKQAPMACTKQKLVSDFVESMTKEFEMSMVGEMNHFLGLQIKQTDEGVHISQSMYAQGLIQRFGMQTAKTSKTPMSATAKLSADEAGLSVDEKMYRGMIGSLLYLTASRPDLCFSVGVCARYQANPKQSHLNAMKWILKYVKGTTDVGLFYSKQTNQNLVGFCDADWAGNLDDRRSTTGGCFFLRNNLVSWHSKKQSCVSLSTAEAEYIALGSCCTQLLWMKQMLLDYGSTNPPRRVTHTHHEVASLESMTSVDYPVLITCLGFRAVLGFPLMRSCLLNLAALTEGSFSFSATQTSKFKGFLSLKTQVTINQEATSLTGVSGAGQPSAATPSDPPPPPVAPMFIPKTEPGICMSKKTKSKVSTLTQRKRQYLQDGDVTEIAPPLFLSCYRENRRLLAVRDRKYPELKFPSETPYSSCFLTEEGLGRYKVIGNRCFNDMRFLPLDGNNTASTQQLLFNGGLLPTVTEIDSYVHEVVMEFYANLPDGEEGDNLAYSVFVRRNMYEFSLAIINQMFQLPNPSYPLDGMSEIQVPESMDEVAIALSNGKANSWKMLTSRLLSPELALLNKICFANPSSTLCLVLPNLIDQMLRFQRIVRSDEGDTTSSAPLKFTMEVKPVPLLQSDSPTLDAALETLIASLTTMHVRLAGGEYSDVSYSVPDDVGDEDVEEEDDDDELDDNT

SEQ ID NO: 2182 - protein, 434 aa, Cryptococcus neoformans var. neoformans JEC21
MAAPFVQYGITPGQSAEAPKRPHLYVGNLSPRVTDYILTEIFAVAGPVVSAKIIQDRNFQHGGFNYGFVEYADMRSADQALTTLNGRKIFDAEIRVNWAYQGNQNKEDTQHHYHVFVGDLSPEVNDDVLSKAFGAFGSLSEARVMWDMNSGKSRGYGFLSFRDKADAEQAIASMNGEWLGSRAIRVNWANQKTQTGGTRTGGGTPSYPAPPMGAPPAPAGVPSAYGAPAPGVVPGVGVGGAVGSYETVASQTPEFNTTVYVGNLIPYTTQADLIPLFQGYGYIVEIRMQADRGFAFVKLDTHQNAALAITHLQNQLVHGRPIKCSWGKDKGSMEGGAPAAGYPSMQPQIGYPNYNYYGGYNYNQAGVPGQPGQPGVAVASHPAPAVGAVGAVGAESQAQQGAWDPAAAAAYYQAGGWGGYYAQQQDTQQPSAHQ

SEQ ID NO: 2183 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQDLFKEFGCESKLRVDGDGKPYVTDNSNYIIDLYFKTPLKDGFAAAKEIGKFQGVVEHGLFLGMATSVIIAGKNGVEVMTK

SEQ ID NO: 2184 - protein, 589 aa, Shewanella sp. MR-4
MEESSLLTSVLLFLLAAVIFVPLGKRFGAGPILSYLAAGGILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTCVALVGFVLVGKYLLPRLLKLVASSGVREVLTAFALLLVMGSAELMEWLGLSAGMGAFLAGIMLANSSYRHQLETDIEPFKGLLLGLFFMAVGMSMDLKLFLTDPLLILAILLGMLLIKTTVLMLLGRLRHHTWRPSIALGLILAEGGEFAFVLLSQAQLSSIVDDKIAQILVLAIGLSMAVTPMIFTLFRATKPKVVDTRSPDTINVTESEVVIAGFGRVGQITGRILASSGIPFVALDKDASHVDVIRKYGGEVYFGDARRLDMLMSAGIARSRLLLLAVDNVEDSIEIAQQVKTHFPHINIVARARDRNHAYRLMSLGVTDVFRETFGSALSASEKILQGLGLSQVQANERVKIFAEHDKKLVIASAAHQHDLAKLIDLSTKGKAELESLMRGDRENVS

SEQ ID NO: 2185 - protein, 254 aa, Chlamydomonas reinhardtii
MNIKPVTGMWSTGFCDCCAEPGGCGTCFYTCCCPCCQYGQNVARMPADMVCCGGSCYGACCCYFMMHLIGCPCLLHMNTRSWVRVKYGIPGDCCQDCMATWCCALCAICQEHRELTCRLVQQGGAELKDNKVSPAPQQQQPQVVMMAAPPASYPAASPYPPPYGQQPPPGYGAPQPQYAPPPPQYAPPPAQAYPPPGYGAPPPAYAAPPPAYGAPAYGAPAYAAAPQPVQYVAVPAQGHHHRRRSGSSSSSDEE

SEQ ID NO: 2186 - protein, 327 aa, Staphylococcus haemolyticus
MKKSGKARAHTNIALIKYWGKADEALIIPMNNSLSVTLDRFYTETRVTFDETLTEDQLILNGEAVNAKESAKIQRYMEMIRKEAGISEHALIESENFVPTAAGLASSASAYAALAGACNEALQLGLSDKDLSRLARRGSGSASRSIYGGFAEWEKGNDDETSFAHRVEADGWENELAMVFVVINNKSKKVSSRSGMSLTRDTSRFYQYWLDNVEPDLKETKEAIAQKDFKRMGEVIEANGLRMHATNLGAQPPFTYLVPESYDAMRIVHECREAGLPCYFTMDAGPNVKVLIEKKNQQAIVDKFLQEFDQSQIITSDITQSGVEIIK

SEQ ID NO: 2187 - protein, 376 aa, Robiginitalea biformata HTCC2501
MGKKIQLDSIESAIEDIRQGKVIIVVDDENRENEGDFIAAAEKVTPEMINFMATHGRGLICAPLTEERCDALDLKMMVENNTVLHHTQFTVSVDLIGYGCTTGISVHDRAKTIQALVNPDIRPEELGRPGHIFPLRAKNGGVLRRVGHTEAAVDFARLAGFQPAGILVEVLNEDGTMARLPELARVARKFNLKLVSIEDLVAYRMKHDSLIRKEASFDVKTRFGEYRLHAYRQTTNDQIHLALTKGAWKDGDPVLTRINSTLVNNDILGTLTNDADKKLDDMFRALNDEGTGAIVFINQPSESLNLLSRIRGLEENQAKGILKAPGIEMDTKDFGIGAQILHDLRIQKIRLMTNSSQAKRVGIVGYGLEIVDYVPY

SEQ ID NO: 2188 - protein, 485 aa, Saccharophagus degradans 2-40
MSLTLTNSKLQRQGSVIDGAWLQSSDEFVVENPATGQVVATVANAGAAEAEAAVLAAERAGVQWREFSAKKRSTLLKAWYELVVSNANDLAVLLTTEQGKPLAEAKAEILYGASYIEWFAEQAKRIEGAVIPAPASNQRIVTVKQPVGVVAAITPWNFPMAMLARKIAPALAAGCTVVAKPAKETPLSALAMAYLAQEAGIPPGVINLVTGQDSSAIGGVFTQHPSVKKLTFTGSTAVGKTLLEQSAATIKKCSMELGGNAPFIVFDDADIDAAVAGCIAAKFRNAGQTCVCVNRIFVHDKVKAAFTKKLVEAVAKLKVGDGIEEGVAIGPLINAAAFKKVSELVIDACNKGAKAIVAEGHTHLNGALFYPPTVVTEATTQMDVFNEEIFGPVAVVYSFSSEEEAIALANNTPFGLAGYFYSRDIGRVWRVASALEVGMVGVNDTAISNEMAPFGGVKESGFGREGSQMGLDDYLETKYMLMGGL

SEQ ID NO: 2189 - protein, 182 aa, Magnetospirillum magnetotacticum MS-1
MARRGWTVADIPSQAGRRAVVTGASAGLGYETALALAGAGAAVVLAVRDAAKGARAAEAIARAHPGADLAVRLIDTASLASVRAFAADWPARQPIDRLILNAGIAAVPSREESVDGFERQLATNTLGHVALTGLLLPVLSPTAGSSRWRASPIAAAGSASTTSTGARVTGRRPPTVRASSRS

SEQ ID NO: 2190 - protein, 206 aa, Candida albicans SC5314
MSDPFSINGGAAVAMIGKDCIAIASDLRLGQQSLGVSNNFEKIFSVGDKTFLGLTGLATDVISLKELFRFKTNLYKLREERNIEPSTLANLVSSSLYERRFGPWFVSPIVAGLSSKDNKPFICGFDSIGCIDFSHDFIVSGTASDQLYGMCESLYEPNLEPEDLFETISQALLNAVDRDALSGWGAVVYIVTKDKVIKRVLKTRQD

SEQ ID NO: 2191 - protein, 472 aa, Neisseria meningitidis FAM18
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 2192 - protein, 691 aa, Saccharomyces cerevisiae
MNRFWNTKKFSLTNADGLCATLNEISQNDEVLVVQPSVLPVLNSLLTFQDLTQSTPVRKITLLDDQLSDDLPSALGSVPQMDLIFLIDVRTSLRLPPQLLDAAQKHNLSSLHIIYCRWKPSFQNTLEDTEQWQKDGFDLNSKKTHFPNVIESQLKELSNEYTLYPWDLLPFPQIDENVLLTHSLYNMENVNMYYPNLRSLQSATESILVDDMVNSLQSLIFETNSIITNVVSIGNLSKRCSHLLKKRIDEHQTENDLFIKGTLYGERTNCGLEMDLIILERNTDPITPLLTQLTYAGILDDLYEFNSGIKIKEKDMNFNYKEDKIWNDLKFLNFGSIGPQLNKLAKELQTQYDTRHKAESVHEIKEFVDSLGSLQQRQAFLKNHTTLSSDVLKVVETEEYGSFNKILELELEILMGNTLNNDIEDIILELQYQYEVDQKKILRLICLLSLCKNSLREKDYEYLRTFMIDSWGIEKCFQLESLAELGFFTSKTGKTDLHITTSKSTRLQKEYRYISQWFNTVPIEDEHAADKITNENDDFSEATFAYSGVVPLTMRLVQMLYDRSILFHNYSSQQPFILSREPRVSQTEDLIEQLYGDSHAIEESIWVPGTITKKINASIKSNNRRSIDGSNGTFHAAEDIALVVFLGGVTMGEIAIMKHLQKILGKKGINKRFIIIADGLINGTRIMNSIS

SEQ ID NO: 2193 - protein, 73 aa, Magnetospirillum magnetotacticum MS-1
MTASAPYDLLVIGGGINGAGIARDAAGRGLRVLLCEKGDLAEHTSSASTKLIHGGLRYLERYEFRLCARPWPK

SEQ ID NO: 2194 - protein, 780 aa, Saccharomyces cerevisiae
MAPKSSSSGSKKKSSASSNSADAKASKFKLPAEFITRPHPSKDHGKETCTAYIHPNVLSSLEINPGSFCTVGKIGENGILVIARAGDEEVHPVNVITLSTTIRSVGNLILGDRLELKKAQVQPPYATKVTVGSLQGYNILECMEEKVIQKLLDDSGVIMPGMIFQNLKTKAGDESIDVVITDASDDSLPDVSQLDLNMDDMYGGLDNLFYLSPPFIFRKGSTHITFSKETQANRKYNLPEPLSYAAVGGLDKEIESLKSAIEIPLHQPTLFSSFGVSPPRGILLHGPPGTGKTMLLRVVANTSNAHVLTINGPSIVSKYLGETEAALRDIFNEARKYQPSIIFIDEIDSIAPNRANDDSGEVESRVVATLLTLMDGMGAAGKVVVIAATNRPNSVDPALRRPGRFDQEVEIGIPDVDARFDILTKQFSRMSSDRHVLDSEAIKYIASKTHGYVGADLTALCRESVMKTIQRGLGTDANIDKFSLKVTLKDVESAMVDIRPSAMREIFLEMPKVYWSDIGGQEELKTKMKEMIQLPLEASETFARLGISAPKGVLLYGPPGCSKTLTAKALATESGINFLAVKGPEIFNKYVGESERAIREIFRKARSAAPSIIFFDEIDALSPDRDGSSTSAANHVLTSLLNEIDGVEELKGVVIVAATNRPDEIDAALLRPGRLDRHIYVGPPDVNARLEILKKCTKKFNTEESGVDLHELADRTEGYSGAEVVLLCQEAGLAAIMEDLDVAKVELRHFEKAFKGIARGITPEMLSYYEEFALRSGSSS

SEQ ID NO: 2195 - protein, 349 aa, Triticum aestivum
  misc_feature (175)..(175): Xaa can be any naturally occurring amino acid
  misc_feature (183)..(183): Xaa can be any naturally occurring amino acid
MGLRRRGPPLLMLLGLAATALAASASASEGDADPLYRACFEECQRTGTLKEDSIKHCVVPTDDQPADKAWYAHEPLYLQWKEWNCNSECRYHCMMEREQEREELGLGPVKYHGKWPLKRASVFQEPLSAALSALTLLVQFNGWLSFFLLLSYKLPLRPETHATYYEYTGLWHINXLLAMNSWXFWCAIYHSCDTAWTEKLYLSSAAAFLGYSLILAILRTSNLRDEASRVMVAAPILAFVTTHILYLNFYELDKGLNMKVCTVISVAQLLLWTVWAAITRHPSRLKVAFVAIGGVLSLYLEAHDVPPRWGYVDGHAICLAMAIPLSYLWWSFAKEDAEMRTAAIMKKKR

SEQ ID NO: 2196 - protein, 459 aa, Oceanobacillus iheyensis HTE831
MELLERYQSIVENQRAYFNHGNTVDYSFRKQQLEKMKVMLKEYESHIFQALKHDLNKSKHEVITSELAILYSEIDSMLKNLRQWMQPDKVTNPITHKGSKSYIMKEPLGVILVIAPWNYPLQLSLAPVIGAIAAGNTVIIKPSEHAPHTSELVAEMIQNTFDSSFVTVVQGAKVETEALLKQRFDHIFFTGGAAIGKIVMRAASEFLTPVTLELGGKSPAIVDEDANIQVAAKRIVWGKYTNAGQTCVAPDYILVHEKAKFKLLKAMKKYIKSMYGKDPLQNDAYTRIIHEGHFDRLTNFLSNGTIVHGGEYNRDTLSIEPTILDKITWDEAIMQEEIFGPILPVLTYTNIEDALYQIKLREKPLALYYFGENEKMQQQVMEYVSFGGGAINDTIYHLANPHLPFGGVGTSGMGNYHGKASFDTFSHQKSIMKQTTKFDIPFRYPGGKITSNIVKKFLT

SEQ ID NO: 2197 - protein, 473 aa, Cryptococcus neoformans var. neoformans JEC21
MSSQNVSGLMAGLSLYAPQSPKGSKAQQAGKTQESSHSSQSQNRLPPVLKKYMNPGLVRPPNSGLANNSHPSSSYSDPSSRGPLLTLAGVNVSYPKSGTVSPMNKSKGAVGHHSAHGIHGPAHSTSSRAMASSINPGASKHAVTTSSSHITNLVSENCKSLELGRYDGGLEEDEANHGDASGPTAKMLELSSVSEGAIPLSLPSFTIGRPLGKGKFGRVYLARSKAPPHFIVALKCLHKAEIIQGKVESQVRREIEIQQNLRHPNILRLYGYFHDSKRIFLVLEFAAKGELYKQLSRLGRFDEKKSSRYIAQMADALSYLHRKHVIHRDIKPENLLIGLNGELKIGDFGWSVHAPSNRRSTLCGTLDYLPPEMVEGKEHTAAVDLWALGVLTYEFVVGGPPFEDLSGNAATYRRIRNVDLHVPSWVSPEATDLIKRLLRYKPEDRLPLSQVMIHPWIKMYEKKRSASNGIRRS

SEQ ID NO: 2198 - protein, 425 aa, Oceanobacillus iheyensis HTE831
MVGYATISKKPIYVFAHDFTVRGGSLGELQGKKIASMMDLAAKTKVPIVGLNESAGARIQEGVTALDGYGQIFYRNVKYSGVIPQISIILGPNAGGAVYSPALTDFIIMVKDISQMYITGPKVIEAITKETVSAEDLGGTYMHAVVNGNCHFLATNEQEAFQITAKLLTFINTTTMSNELTARDYCNSLHELVPSESGKTYDVIPIIETIVDDGSFLEVHKYFAKNIVVGFASLLGKTIGIVSNQPKHMAGGIDSNASDKAARFIRFCDCFNIPIITLEDVTGFYPGIRYEKEGIIRHGAKLVYAFAEATVPKITVILRKAYGGAFVAMNSKALGADLLYAWPSAEIAVMGPEGASSVFKTDKKDNETRTNLPNNSTSPYYAAAKGMVDDIIDPRETRIKLIQSFIMLEQKNETAPIRKHGNIPL

SEQ ID NO: 2199 - protein, 114 aa, Brassica napus
IKQLLQERINNISLMSAEDLGVVREERQLVDSLWSTCFNEPSSLREKGLLVLPGEDVPPPDVASKYFEPPLRSSTANPSSKKDPEKNEIPLLLGSGPSPTYTNNQGSNKGDASS

SEQ ID NO: 2200 - protein, 488 aa, Bacillus anthracis str. Ames
MTKNNEAGWNLDHSYTTLPQSFYTEIPPTPVSSPELVKLNHSLAISLGFNPEELKKEAEIAIFAGNALPEGAHPLAQAYAGHQFGHFNMLGDGRALLIGEQMTPSGKRFDIQLKGSGPTPYSRRGDGRAALGPMLREYIISEAMYALDIPTTRSLAVVTTGEPTYRETKLPGAILTRVASSHIRVGTFQYAAARGSIEDLQSLADYTIKRHYPEIEAHENRYTALLQEVIKKQASLIAKWQLVGFIHGVMNTDNITISGETIDYGPCAFMDNYDQGTVFSSIDTQGRYAYGNQPYMAAWDLARLAESLIPILHEDEEEVLKIAQDEISKFSVQYEKQWFLGMKKKLGLFSNEEQDQSLIEQLLKMMEKFKADYTNTFRSLTLNTIENTALFESPEFKEWYKLWQSRLERQEESKENAYEMMKNNNPSIIPRNHRVEEALEAAVTNGDYSVMEKLLEALSNPYAYATEQEEYCVPPVPTNRPYRTFCGT

SEQ ID NO: 2201 - protein, 196 aa, Clostridium perfringens SM101
MNLANKLTLIRIILVPIFLVFIAYQDLPYGSVIATLIFIIASVTDQLDGYIARSRNQVTNFGKFMDPLADKLLVTAALISLVELQLVPAWAAIVIIAREFAVSGLRTIAASEGLVIAASWWGKIKTVIQIIAIVLLLLQVNIINSPGIKELVSGSSFLRNFFIYVPDIFLYLAVAITIISGVDYFRKNKNVINTYK

SEQ ID NO: 2202 - protein, 427 aa, Oceanobacillus iheyensis HTE831
MSVEKINMPQLGESVTEGTINTWLVAVGDKVNKYDPIAEVMTDKVNAEVPSSFSGVIKELIAEEGETVEVGQLMCYIDTEESSSASKPKSSEDSTKTNDNIENDTNSKEDVNKSMKKRYSPAVLRLAQENDIDLTMIDGSGRAGRITRKDVEKFMKEGTKNDPKEEQKEPSHQTIPKVNQSGTPSVRSNSIASEKGDKEIPVKGVRKAIADNMVRSKQEIPHAWMQVEVDVTNMMKYRNSIKDKFKSDEGYSLTPFAFFIKAVSQALREYPELNSAWAGDKIIQKKDIHLSIAVAKENELFVPVIRHADEKTIKAVARDIYELANKARNGKLSSEDMQGGTFTVNNTGTFGSVSSMGVINHPQAAILQVESIVRKPVIIDDMFAARDMANLSLSLDHRILDGLVCGRFLARVKEILEGMNVDTVSLY

SEQ ID NO: 2203 - protein, 322 aa, Bacillus anthracis str. Ames
MKVLEAISNIAGKYFAFWVICIATIAYFIPAPFLGLNSYITILLGVVMFGMGLTLKAVDFKIIATKPLPVIIGVCAQFIIMPLVAYVLAYVMNLPAELAAGLVLLGSVPGGTASNVMVYLAKGNLALSIAMTSLSTLLAPIATPLILLLLAGQWMPVNPMSMFLSIVQVIIIPIILGLVVKKFFPKTVTKGMTVIPFISVLAIIIIVSAVVSANVSSITSSGLLILIAVMLHNAFGFLLGYITAFILKLDEGTRRAISIEVGMQNSGLGVALATAHFGPAAALPSVLAAVWHNIAGPILATIWSKNAKNTFSDENVSVNIEK

SEQ ID NO: 2204 - protein, 147 aa, Salmonella enterica subsp. enterica serovar Typhi str. CT18
MSTFKVRCEQMANQPSAEELKKKLSEMQFYVTQDRGTEPPFTGRLLHNKRDGVYHCLVCDTPLFHSHTKYDSGCGWPSFYQPVSEEAIRYIDDFSHGMQRVEIRCGNCDAHLGHVFPDGPQPTGERYCVNSASLAFSDEKNGDQLKG

SEQ ID NO: 2205 - protein, 466 aa, Robiginitalea biformata HTCC2501
MKSYDVAIIGSGPGGYVAAIRCAQLGMKTALIEKYDTLGGTCLNVGCIPSKALLDSSHHYHDAITHFEKHGIDIPGDVKVNLKQMIARKQSVVEENTKGIEFLMDKNKVDVYHGLGSFKDATHIEIAGKEKTEIEAKHSIIATGSKPASLPFIELDKERIITSTEALKLQEVPKHLIIIGGGVIGLELGQVYNRLGAQVSVVEYMDRIIPGMDGALSRELTKVLKKQKVKFYLSHKVTGVSRKGEKITVEAEDKKGKSVSLEGDYCLVSVGRKPYTDGLNAEAAGVKLNDRGQVEVDEHLRTSAGNIYAIGDVVRGAMLAHKAEEEGVMVAEILAGQKPHIDYNLIPGVVYTWPEVAAVGKTEEELKEAGVAYKSGQFPMRALGRSRASMDTDGFVKILADKETDEVLGVHMIGARVADLIAEAVVAMEYRASAEDIARMSHAHPTYAEAVKEAALAATDNRPLHS

SEQ ID NO: 2206 - protein, 331 aa, Salmonella enterica subsp. enterica serovar Typhi str. CT18
MTIKVGINGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 2207 - protein, 285 aa, Salmonella enterica subsp. enterica serovar Typhi str. CT18
MKSVKNVTFCGQVTLPAIGQGTWYMGERADQRQREVSALRAGLDLGLRLIDTAEMYADGGAEKVVGEALAGRRDEAFLVSKVYPWNAGGQKIVAACEESLRRLKTDYLDLYLLHWAGGFSFEETVEGMERLIAQGKIRRWGVSNLDYDDMQALWRIPGGQQCATNQVLYHLASRGIEYDLLPWCQQQRMPVMAYSPLAQAGRLRSGLLNHPVVNEIAQAHNATAAQILLTWVIAHPGVMAIPKAGSTEHVKQNAAALEITLSANELALLDNAWPAPKGKTALDMV

SEQ ID NO: 2208 - protein, 434 aa, Chlamydomonas reinhardtii
MSAAAAPAGAVKVDTTLNPLVASVKPSKTMALTDLATSMKESGIDVIGLAAGEPDFDTPAAIVEAGVAALRQGYTRYTPNTGTSALRKAICKKLKGRAGGVGVRGSVWVAYEKGKACGKSGRAATDICTRGGAGGLLAPSHETYEALSTRAGARALRLPTRVPVSHALTHSPELDRAPPHTPTRPRSRLLILCTPSNPTGAVYPKEHLEALAAVIAKHPRLLVLSDEIYEYITYAPATHVSFGALPGMFERTLTVNGFSKAYAMTGWRLGYLAAPKHYAKAAAIIQSQSTSGASSISQQAALAALALGPGGGEPVQAMVRAFRERRDYVSARLKAIPGVNLAEPAGAFYVLPEMSAFFGPGAAAQGFGAVPDSDTFCRYLIEVANVAVVPGDAFGADSCIRISYAASLETLGKALDRIAAALDPAVYTLRTDRQ

SEQ ID NO: 2209 - protein, 406 aa, Bacteroides thetaiotaomicron VPI-5482
MHYNEYTLPNGLRIIHEPTLSKVAYCGFAIDAGTRDEAEDEQGMAHFVEHLIFKGTEKRKAWHILNRMENVGGDLNAYTNKEETVVYAAFLTGHLERALELLGDIVFHSTFPQHEIEKETEVIIDEIQSYEDNPSELIFDDFEDMIFRNHPLGRNILGKPELLRSFRTEDVLSFTRRFYQPGNMVFFVQGQYDFKKIIRLAEKHLSDIPAVTVDNQRMPPPLYVPERLVVPKDTHQAHVMIGSRGYNAYDDKRTALYLLNNVLGGPGMNSKLNVSLRERRGLVYNVESNLTSYTDTGAFCIYFGTDIEDMDICLKLTYKELKRMRDVKMTSSQLAAAKKQLIGQIGVASDNFENNALGMAKTYLHYHKYESSESVFHRIEALTAEQLLEVANEMFAEEYLSTLIYK

SEQ ID NO: 2210 - protein, 331 aa, Enterococcus faecalis
MLSGKARAHTNIALIKYWGKANEEYILPMNSSLSLTLDAFYTETTVTFDAHYSEDVFILNGILQNEKQTKKVKEFLNLVRQQADCTWFAKVESQNFVPTAAGLASSASGLAALAGACNVALGLNLSAKDLSRLARRGSGSACRSIFGGFAQWNKGHSDETSFAENIPANNWENELAMLFILINDGEKDVSSRDGMKRTVETSSFYQGWLDNVEKDLSQVHEAIKTKDFPRLGEIIEANGLRMHGTTLGAVPPFTYWSPGSLQAMALVRQARAKGIPCYFTMDAGPNVKVLVEKKNLEALKTFLSEHFSKEQLVPAFAGPGIELFETKGMDK

SEQ ID NO: 2211 - protein, 406 aa, Geobacillus kaustophilus HTA426
MNVNEIRALFPILHQQVNGHPLVYFDSAATSQKPLPVIETLDRYYREYNSNVHRGVHTLGTKATDAYEGAREKVRRFLNAQSAQEIIFTRGTTAALNLVAASYGRANVKEGDEIVITYMEHHSNLIPWQQLAKQTGATLKYIPLQEDGTIDLRDVEAAITKAAKIVAIAHVSNVLGTINPVREIARIAHERGAVVVVDAAQSAPHMKVDVQELDCDFLALSGHKMCGPTGIGVLYGKKKWLAQMEPIEFGGEMIDFVELYDSTWKELPWKFEGGTPIIAGAIGLGAAIDFLEQVGLDAIAAHEHELAQYALERMADIEGVTVYGPKERAGLVTFNIDGVHPHDVATVLDAEGIAIRAGHHCAQPLMKWLGVTANARASFYLYNTKEEIDAFIAALQKAKEYFSHVF

SEQ ID NO: 2212 - protein, 171 aa, Zea mays
  misc_feature (17)..(17): Xaa can be any naturally occurring amino acid
  misc_feature (35)..(35): Xaa can be any naturally occurring amino acid
  misc_feature (46)..(46): Xaa can be any naturally occurring amino acid
  misc_feature (49)..(49): Xaa can be any naturally occurring amino acid
  misc_feature (71)..(71): Xaa can be any naturally occurring amino acid
  misc_feature (79)..(79): Xaa can be any naturally occurring amino acid
  misc_feature (97)..(97): Xaa can be any naturally occurring amino acid
  misc_feature (105)..(105): Xaa can be any naturally occurring amino acid
TSDQKVPDEVELLLYGXVETPTEGHCSAPQPCNSXMTARAQCTACXEMXGTPTEKAMEKYIDLVTQLYPDXNESGSKPXLISDELECPMLPELICIXYEAPSDNXTMIDVVLVFAKNMRCRETYGWGIENAVPAHARKIVHAEHHCMGLYRPCSSLTVLKALLDKNPISEC

SEQ ID NO: 2213 - protein, 506 aa, Burkholderia sp. 383
MNPVPAYTSDADVGHYVDGAPVAGRSGRFQDVLNPALGRAVRRVALADDNEVQQAVASANAAFPAWAATPPIRRARVMHRFLQLMNEHRDALAAIITAEHGKVFSDAQGEVARGIDIIEFACGVPQLLKGDFTDQVSTGIDNWTMRQPLGVVAGITPFNFPCMVPCWMFPVAIATGNTFVLKPSERDPSAALFIADLLTQAGLPAGVFNVVQGDKGAVDALLDHPDVQAVSFVGSTPIAAYVQQRAVQSGKRVQALGGAKNHLVVMPDANLEQAVDALIGAAYGSAGERCMAISVAVLVGDIADKIVPLVAERARKLVIGDGMSPEVEMGPIVTGEALKRIEGYIEQGVNEGAQLVVDGRGLRVPGREAGFFTGGTLFDHVTPDMRIYKEEIFGPVLGCVRVKDFGEAVDLINAHEFGNGVSCFTSDGGIAREFSRRIQVGMVGINVPIPVPMAWHGFGGWKKSLFGDMHAYGEEGVRFYTRQKSVMQRWSSSIGKGAEFAMPTAK

SEQ ID NO: 2214 - protein, 681 aa, Staphylococcus aureus subsp. aureus MRSA252
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHSGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 2215 - protein, 336 aa, Neisseria meningitidis FAM18
MNDNTHTLPPRHLSVAPMLDWTDRHYRYMARQITRNTWLYSEMVNAGAIVYGDKDRFLMFNEGEQPVALQLGGSDPSDLAKAAKAAEAYGYNEVNLNCGCPSPRVQKGSFGACLMNEVGLVADCLNAMQDAVGIPVTVKHRIGVDRQTEYQTVADFVGTLRDKTACKTFIVHARNAWLDGLSPKENRDVPPLKYDYVYRLKQEFPGLEIIINGGITTNEAIAGHLQHVDGVMVGREAYHNPMVMREWDRLFYGDTRSPIEYADLVQCLYTYSQAQIQAGRGTILRHIVRHSLGLMHGLKGARTWRRMLSDATLLKDNDGSLILEAWKEVERANTRE

SEQ ID NO: 2216 - protein, 431 aa, Arabidopsis thaliana
MTLIASLSLPPPAIQRQSLSEFHNLPAKSQSFNCQFRSSSSPLSSLHSSSLSNFLDFRLRRRNSGLVPVVACSTTPFMGRVGLHWRDGNMSLLSFCGGTDVTERADSSQFWSALLPFVVALTAVAALSYPPSFTWVSKDLYAPALGGIMLSIGIQLSVDDFALAFKRPVPLSVGFVAQYVLKPLLGVLVANAFGMPRTFYAGFILTCCVAGAQLSSYASSLSKADVAMSILLTSSTTIASVIFTPLLSGLLIGSVVPVDAVAMSKSILQVVLVPITLGLVLNTYAKPVVTLLQPVMPFVAMVCTSLCIGSPLSINRSQILSAEGLGLIVPIVTFHAVAFALGYWFSKIPGLRQEEEVSRTISLCTGMQSSTLAGLLASQFLGSSQAVPAACSVVVMAIMGLCLASFWGNGFRIRDVLSLSTPQSRGYTTES

SEQ ID NO: 2217 - protein, 275 aa, Bacillus halodurans C-125
MKKYLWGKTCLVVSLSVMVTACSSAPSTEPVDEPSETHEETSGGAHEVHWSYTGDTGPEHWAELDSEYGACAQGEEQSPINLDKAEAVDTDTEIQVHYEPSAFTIKNNGHTIQAETTSDGNTIEIDGKEYTLVQFHFHIPSEHEMEGKNLDMELHFVHKNENDELAVLGVLMKAGEENEELAKLWSKLPAEETEENISLDESIDLNALLPESKEGFHYNGSLTTPPCSEGVKWTVLSEPITVSQEQIDAFAEIFPDNHRPVQPWNDRDVYDVITE

SEQ ID NO: 2218 - protein, 344 aa, Physcomitrella patens subsp. patens
LEKVRIGINGFGRFGRLVARVALERDDIELVVVNDPFISTDYMAYMFAYDSVHGQKCAMADIYAQDAHTVSFAGKKVAVYGQKDLAKIPWGKHRVDYVVECTGNYTDKDRAAAHLKGGAKKVIITGYSKDAPTFIVGVNERDYRPEHNVVSMAGCTTNCMIPLMKVLHDRFGVAEAQMTTVHSLTAITKSLEGPSLKDWRSGAVAGFNLIPSSTTASKAIGRLIPTLNGKIRSQAFRIPTPDASLVDLTVRFYRRVPYEEICAAIREEAEGKMKDILGYSDDDPVSSEFVGDSRSGIFDAKAGFAMADNFVKLVAWYDNEWGYSHRVVDLIVHMSSVQHSRYHF

SEQ ID NO: 2219 - protein, 399 aa, Clostridium perfringens SM101
MISYEFLFDLALILISTKLFGLITKKIRMPQVVGALVAGVVLGPAFLNVLSETEFIQNLAELGVIVLMFTAGLETDINQLKKTGKASFIIAVLGVIIPLVGGFFIASIFNKGNDVNTILQNVFIGIILTATSVSITVETLKEMGKLNTRAGNAILGAAIIDDILGIIALTITTSLADPSINVIIVLIKIVMFFIFAGFAGYLFHWAFIKLDEKYQRDLRRFVIIAFVFCLLLSFCAEEFFEVADITGAFIAGLVISDSNRSKYLNSRFETLSYMLLSPIFFASIGIKIKLTAMTKTIFIFSILLLLVAILSKVFGCALGAKICRYSNIEAIQIGTGMISRGEVALIVANKGIAMGLMLQEFLAPVVIMVVVTTIVTPILLKVVFKNRSKSVDLNLKANV

SEQ ID NO: 2220 - protein, 295 aa, Triticum aestivum
  misc_feature (137)..(137): Xaa can be any naturally occurring amino acid
MAGAAQGKQSREAHGNNDISVTKDYLDPPAVRLFDAGELGQWSLYRAIIAEFTASLLFVYVSIATVIGHKRQTDAEACSGAGVLGIAWAFGGMIAVLVYCTAGISGGHVNPAVTFGLLLARKLSLPRAFLYTSAQCXGAICGAAMVRAVHGARYYELYGGGANEVAPGYSKAGGLLAEAAGTFVLVYTVFSATDPKRMARDTHVPVLAPLLIGFAVVVAHLATIPVTGTGINPARSLGAAVVYNNSKAWSEQWIFWVGPFSGAAVAMAYHQYILRGGAAAKPHFNFDNGFRRLGC

SEQ ID NO: 2221 - protein, 473 aa, Oceanobacillus iheyensis HTE831
MATEYDLVILGGGTGGYVAAIRASQLKMKVAIVEKAELGGTCLHRGCIPSKALLRSAEVYQQTTRADEFGIQVAKPVLDFSKVQQRKQKIIDQLHQGVQGLMKKGKIDVYQGFGRILGPSIFSPMPGTISVEYSDGKENDMLLPKNVLIATGSRPNQLPGFEFDHNYILSSDDALALETLPDSIVIIGGGVIGIEWASMLNDFEVDVTILENQDRILSTEDAEISKEMSKLLSQKGINIITNANVKADSVKKDQGVSLQVDVDGEIQTHQAEKVLMSVGRKGNIENIGLENTDIVTDRNLIMTNEFYQTKESHIYAIGDVIGGLQLAHVASHEGIKAVEHMAGHTVEKIKANAIPSCIYSSPEAASIGLTEAQAKEKDYEVKVGKFPFKAVGKALVYGESEGFVKIVSDKNTNDLLGVHMIGPHVTDMIAEASLAKFLDATPWEISESIHPHPTLSEVIGEAALAVEGNQIHG

SEQ ID NO: 2222 - protein, 242 aa, Guillardia theta
MMACAMAAAVMSQGEAFMHTTGSSKLHVPTLRSNNAISPQMAMKPQIEVSSKQVASFVAGALILGSSVLPLDVQADSSLKFNFPPIDRKAKDRCTFRSSAIGQANAARDKLYDLRECPMAGKDATGFDLAGALMQKGDFSKVKFKDAVMSKVFADEATFDGADFSNAVMDRGTWRKSSFKGAIFANAVLSGSEFEGSDLTDSDFSDTYMGDFDNKKICKNPTLQGTNPVTGVDTRASASCRK

SEQ ID NO: 2223 - protein, 108 aa, Nitrosomonas europaea ATCC 19718
MSQHIHYVTDASFESEVLQCPVPVLVDYWAEWCGPCRMIAPLLDEIASEYGDRLKIAKLNIDENQSTPQKYGIRGIPTLMIFKNGNIEATKVGALSKSQLTAFVDSHL

SEQ ID NO: 2224 - protein, 464 aa, Oceanobacillus iheyensis HTE831
MKVAKFGGSSVANAEQIQKVANIIKADPSRKVVVVSAPGKRFKDDVKITDLLIEFAGSHQRKQFEQSEKTLTIIMDRFKEIVDNLNLHTSIIDDIKQTIEEDLNKDLSPNQLLDAIKAIGEDSSAKIVSAYLQHIGIDATYMNPKDAGIYVSNEPGHAQLLPESFPIIKKLRDIDKVVVIPGFFGYAENGELVTFSRGGSDITGSILAAGTKAELYENFTDVDSVYAVNPTIVNNPKEINVLTYKEMRELSYAGFSVFHDEALIPAFREQIPVCIKNTNNPDSPGTMIVSERDARDNCVVGIASDVGFCSLYVSKFLMNREVGFGRKLLNIFEDEDISFEHAPSGIDDMSVIFRDHKFTPEKERIVIDRIKNELHVDTVSIHRDLAVIMVVGEGLVNTIGVAARATSSFSKARVNIEMINQGSSEVSMMFGIHAEDIDKAIQSLYHEFFEVSQKVEEAETKILT

SEQ ID NO: 2225 - protein, 123 aa, Zea mays
  misc_feature (15)..(15): Xaa can be any naturally occurring amino acid
  misc_feature (23)..(23): Xaa can be any naturally occurring amino acid
MLWVEGRGLFMATGXRSPTSFAXIKYWGKRHEALILPVYDSISVALDPDHVSATTTVAAGPSFPSDRMWITVAEISLLGAGFQSCLAEITKRARDSEDKETCVKIDKEDWDKWPGHIASYYNF

SEQ ID NO: 2226 - protein, 161 aa, Ostreococcus tauri
MEVAKRAPASAATTSGAPRANPRDGELAKDTEEDDGEAFVRRKGTFAKDLSYMMYGFGDAKEPDPESVELMEDMLVEYLTNVAHRAMEVAERRGRMQTEDLLYVIRNDRKKFARVDELLEMNAKLKDARKNFDLHDPQAVLAQQREAEEARRREAEAKANA

SEQ ID NO: 2227 - protein, 106 aa, Triticum aestivum
DSKSAMQRLSVSKDDSEIVAMIKELLETRIRPAVQDDGGDIEYRGFEPETGIVKLKMQGACSGCPSSSVTLKSGIENMLMHYVPEVKGVEQEFDGDEEAELAGQME

SEQ ID NO: 2228 - protein, 314 aa, Cyanidium sp. 3-8 CR
NGFGRIGRLVLRAALESKLIRVTAINDPFIGSDPAYVAYLLTHDTAQGRFFGEIRVDDDCIMIDSVPIRCFAVHDPAEIPWQQAGVEYVVEASGKFVTREGAEKHLLAGARKVIVSAPAKDVPMFVVGVNHSQYHPSMDIVSNASCTTNCLAPLAKILDEHFGIEQGLMSTIHAVTGTQRTVDGPSSKDWRRGRSALGNVIPTSTGAARAVGKVYPKLEGKITGLAYRVPLAVVSIVDFTVVLQKPVTLSQLKEVMRAASEHPTYRGIVGYTEDAVVATDMAHSAFSTVFDAEASIVLSPTFVKIVAWYDNEWG

SEQ ID NO: 2229 - protein, 325 aa, Enterococcus faecium
MFKGKARAYTNIALIKYWGKKNEELILPMNNSLSLTLDAFYTETEVIFSDSYMVDEFYLDGTLQDEKATKKVSQFLDLFRKEAGLSLKASVISQNFVPTAAGLASSASGLAALAGACNTALKLGLDDLSLSRFARRGSGSACRSIFGGFVEWEKGHDDLSSYAKPVPSDSFEDDLAMVFVLINDQKKEVSSRNGMRRTVETSNFYQGWLDSVEGDLYQLKQAIKTKDFQLLGETMERNGLKMHGTTLAAQPPFTYWSPNSLKAMDAVRQLRKQGIPCYFTMDAGPNVKVLVENSHLSEVQETFTKLFSKEQVITAHAGPGIAIIE

SEQ ID NO: 2230 - protein, 738 aa, Oryza sativa
MGSSSVVLWWEEWQLRILVLGSLFLQCFLAFAAVHRRRSIPASLRFFIWLAYLGSDALAIYALATLFNRHKTDNQGGSHVLATLVSPQGKGGGDDTGLEVFWAPVLLLHLAGPDSITSYNIEDNELWRRHVLTVISQVTVSLYVFCKSWSGENKLLRAAVLLFIAGTLKCIDKPMALKSASIYGLVTSSPFHDQKSQNNDQGENRSLEAYIQEAKGYFSNLKINDVYTELVAAAQNKDLRVMPFWLFVDLASTLCHRLRVLRFFLVLDNKSADSLLQTALCGSFVRLYTKKSMLLSYFWAKDKRNALISTYSHLNRLLAVCLTISAVALFHQSHKQGYNNSDVKVTYTLLWCTAALEVYALFGPKYKFFTWCKNVAQYNLVGFFARDQTPTRLLKLASCFWCKDYVDQHWYVNQCSSSFAITELVIEQVKAGWKNYIEDTSTYWMFNDRRGQLTIQHELCDEELCKSLDVPFDESIIVWHIATDICFYEGAPAANHHHLKAATRCREISNYMLYLLVVNPDILMSGTRANILSNTCKELRSMFEDEKPPSDESDLTREIHRRAQSSNVDAAATEELIPRASKLASQLLAMDGDKRWKVMQGVWVEMLCFSASRCRGYLHAKSLGQGGEYLSYVWLLLWYMGLESVAERQQRSDFRSHVERVASRQLPCTETESSQEPEIQEEEGAVVPLFQEGDIGVAVRSNVEDEEAGAVTLEIQDDEEAATTAHASKATVPGDNKV

SEQ ID NO: 2231 - protein, 294 aa, Burkholderia sp. 383
MLKVTKAVFPVAGLGTRFLPATKASPKEMLPVVDKPLIQYAVEEAIAAGITEMIFVTGRSKRAIEDHFDKSYEVEAELEARGKEKLLELVRSIKPSHVDCFYVRQPEALGLGHAVLCAEKLVADNPFAVILADDLLDGNPPVMKQMVDVFDHYHSSVIGVEEIPPSETKSYGIVDGKEWEESIVKMSAIVEKPAPEVAPSNLGVVGRYILKPRIFEHLRALKPGAGGELQLTDAIQALLADEQVLAYKYQGTRYDCGSKLGYLKATVEFALRHAEVGAEFDTYLRTRNGGRPAD

SEQ ID NO: 2232 - protein, 540 aa, Chlamydomonas reinhardtii
MATNHVFFEPPKSLLSILEEDKDLSVPALTKLGCTLGPQSRTVEVLEDLLRAGMTVARFDFSWGSMEYHQETLDNLRIAMRNTKRLCCTMLDTMGPEIIVLNRPEAPISLTAGQTLTLTCNKSVAASETVLPISYPSLAGTGLAPGSQVFVGQYLFTGSETSSVYLTVQEVKGDEAVCTCNNTCILEGLALTVHIAHMRNEAPILADSDMSAIRQWGAANKIDYVCLSFTRNAADIGVVRAVLDSCGLEQTRVMAKIENLEGLVHAGDIVEAADSVLLSRGNLGICLDAEKMFLAQKKLLRACNLAGKPVMVTRVVDTMTDAPRPTRAEATDVANLVLDGADGILLGSETFRGKYAVSTVKTVCAICKQAELCFDNQSYYRSLMEYFGCYTLHPNLGKREALASSAVRAAAKINAALIIVFTVTGQTARLVAKYKPACPILTVVCPDIKSDGLKWTLLGEVQARQCMLYRGVLPIMADPDFSLPGGAILDYAIAYAKQVGMVRSGDKVVVSQCPRTGYSDVMEEAGVVKLITVDDHVIPG

SEQ ID NO: 2233 - protein, 272 aa, Thermotoga sp. RQ2
MKKEKVEERIREILRPGWDLLTEEAMLYSATVGGKRIRPLLVLTLGEDLGVEEEKLLDVAVAVELFHTASLIHDDLPPIDNADFRRGKPSCHRTYGEDIALLAGDGLFFLAFSQISKIGNSKIFEEFSETAYKLLLGEAMDVEFERRKMEISQEMVERMYAFKTGALFAFCFSAPFILKGKDHTKMKLLGEKFGVAFQIYDDLKDILGSFEKVGKDLGKDTEKVTLVKKVGIQKAREMADKYYEEVLKGIESEGLFRTLFLLKELKQMVEER

SEQ ID NO: 2234 - protein, 490 aa, Saccharophagus degradans 2-40
MSSGKLNLLDFTKENIRTLHLTWFAFFLTFVVWFSHAPLKPLIMQAFDMSLAQWKALLILNVALTIPARIVIGILVDKFGPRIVYSALLVTSGFLCVAFASSQSYEQLALLRFAMGFVGAGFVIGIRMVGEWFPARQVGLAEGVYGGWGNFGSAAAAFTLPTLALIFGGDDGWRYAIGITGVIAGFYGIFFYWRARNTPKGSTYFKPKKSGGLEVTSKRDFWFYIAMNVPMYLILAVLAWKLSPSGVNLLTQTAVNVLYVGLVALFIFQFTQIYKVNKDMLKNGAPEHDKYPFKQVAVLDWAYFVTFGSELAVVSMLPAFFLETFTDLSLAQAGMLGAAFAFMNLIARPGGGYISDRFGRRKSLSIFIAGLAVGYFVLSQVGASWPVAAAVLAVMCCSFFVQAGEGAVFAMVPLIKRRMTGQIAGMAGAYGNVGAVTFLTVYSFVDASTFFMIIGASAAVVFGIVQFIEEPQGHTTEVMEDGTVQKIEVS

SEQ ID NO: 2235 - protein, 496 aa, Saccharophagus degradans 2-40
MSTANFNVLHFSDPKVRTLHLAWIAFFITFFMWFCHVPLMPLIKDTFGLSMAEAKALLFLNVALTIPARTIVGSLVDKYGPRVMYSALLAISGCICFMFAWAQDYTQLAAARFLLGFAGAGFVIGIRLVTDWFPAKTAGAAQGIYGGWGNFGAAIANWALPAMSSILIGYVGVAYSWRVAITIAGVVAIGYSFIFYIMVRNTPKGATYFAPKKVGAMEVSNKADFVLYMIMLSPIFLAMGVICWRLSPAQVGLLSEFVTYAIWAGLLLWFCWQAFGAYKLNAEAIHEGVVGIHKYKFKQVALLDLSYAVTFGSEVAVVSMMPLMFSNEDTYAFSLAKASVMAGCFMAMNLIARPGGGWLSDKLGRKKTLMLTVAGSAIGYAGLSMMTPDWSLLAIGAVVVFCSFFVQAGAGATFGVVPTIKRRLTGQIAGMTGAYGNVGAALFLLVNSFYAPNVFFGVITGACIVVLGLLFLFMEEPKGQIAEVLPDGTVEMIDVG

SEQ ID NO: 2236 - protein, 261 aa, Chlamydomonas reinhardtii
MSGKQRNIRKRVASEDEDAPDVSAEPECQRDKLAETRLMQQLRKRSAGTGVGALAMGGGGPGIGPASREGSVEPGSEGGEGAGTVVMDAYVKAKSIAVQMDEDAHMQKYVEEQLAARLGKTAEAEAEENDPEVKRRKLEQELYALPSDFTTQLEQELVLPGMVSTLAEVPLAAKDKLKSIEATEALKRSLLAQVGGSTLVLEEDAEARDREAARIRRGQFVKSFGAQKARVHREPEELEAEARKRRFVSERRSAPVGKPRK

SEQ ID NO: 2237 - protein, 396 aa, Robiginitalea biformata HTCC2501
MFKKSGPGMLIAAAFIGPGTVTTCLRAGVEMGYALLWALLLSVVATIVLQEMAGRLGLVTRRGLPSLIRKRVTLPWLRILMVGLILVAIVAGNAAYEAGNIAGGVLGLEALLGSGAFGVYPWICGSLAFILLWLGSYKALERVFTGLVLLMSLSFLITAFLVQPDIPALFRGLVTPNLDGDSIFTVLALIGTTVVPYNLFLYTALVTEKWENSGAVQSMRRDIFWSVAIGGVVSMSIVVTAAGSGMGVVADVLDLAAALEPIYGKAARFGLGVGLFAAGISSAITAPLAAAYVSRQTFDWPADRKDWRFRSVWVGVLIIGVLSLSLEYRPLEIIYVAQIANAIVLPVIAAFLWWMIRSRQLMGDQRNTVARDLVALVIIGIVTLLAAKTIYSILIE

SEQ ID NO: 2238 - protein, 396 aa, Desulfovibrio desulfuricans G20
MRRLYLKKGEERRLRIGHQWIFSNEVDTGKSPLHDFTPGENVTVCNSGGSPVASAYVNPSSVIAARVVSQQPDTPFDAGLLHRRITEALAMRQMIFDRPYYRMVFAEGDWLPGLIVDRYGDFLVAQLTTAGAEAAKPQITAVLKDVVRPRGLLYRNDSANRGMEGLKSYVEQAFGHIPDTLEIEENGVRFYAPLMEGQKTGWFYDQRINRRDFASFAQGKKVLDAFCYAGGFGVTAAAAGAAQTTFLDASPLALQTVEANAALNRVSGSVKTVAGDALETLARLRDQGRRYDVICVDPPAFIKRRKHQKQGLKAYQRVNELAMELAEDGGILMSCSCSQHLSADELRRVLNRAARRAGCRIQTLTQGHQGPDHPVHPAMPETNYLKTFTVRVNRTS

SEQ ID NO: 2239 - protein, 391 aa, Desulfovibrio desulfuricans G20
MLNKPRMLTPGPTPIPAAVRLAMAQDMIHHRKPAFKAVMAETQRLLRPLFGTAQPVLPLSCSGTGAMTAAVTNLFSAGEKVVVVEGGKFGQRWTEIARSHGLVPVVIEVPWGSAVTAQAVKQTLEQHGDAAGVLVQCSETSTGVMHPVREIAAVTRSAETLLVVDGISSVGLSPCPMDEWGVDCLLTGSQKGLMLPPGLALIALSERAWARTATVTPSCFYFNLRAERKNAEADQTLFTTPVSLIIGLRESLRMYEETGLEEVFRKQWALTQMVRTGVSAMGLAPFVAADYGWGLTSIALPGGIDGTAVLAHAAQHYGVIMAGGQDHLKGRIIRMGHMGWVDWGDIAAGLHALAESYRACGGYIGCRDYIEQALQAYNEALLSYAENNPFA

SEQ ID NO: 2240 - protein, 601 aa, Triticum aestivum
HKPTPPPLLSSLHAPSLTPLSPTRTFRSRLPLFLLPSDPSSPALIRSTSSFLPGVDPTRRRVDRRTNEVVIVQAAPLRRWRAAAGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGYILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDMHGYIQHAITASKEIKIVSLALFAFLGVPLAILYSVPFAVTAQLAANRGGGQGLCTGVLNIAIVIPQVIIAVGAGPWDELFGKGNIPAFGMASAFALIGGIVGIFLLPKISRRQFRAVSGGGH

SEQ ID NO: 2241 - protein, 456 aa, Arabidopsis thaliana
MEEKSKYLSLVGAGALIGSISTVALLKLLSRSSLKQLNENPETNFLGNGIESETRPDTVANGQDLLKDEIVSEHLTRNIQFFGLESQHKVTGSYVVVIGLGGVGSHAASMLLRSGVGKLLLVDFDQVSLSSLNRHAVATRADVGIPKAMCLKKHFSSIFPECHIEAKVMLYDSSSEEEILSGKPDFVLDCIDNIDTKVGLLAACVKRGLKVLSATGAGARADPTRIRVADIRESTIDPLSRSVRHRLRRKHGIEGGIPVVFSLEKPKAKLLPFEGTNGEDENPLDYQVVPGFRVRIIPVLGTIPAIFGQIMASYVITQLAGVQVQMEPIVNLDLDHYRLLHQRLIEHEETVYGTSAEVEVDVEEVMYIVKELWHGRSARDETAKDVGRGMWRAMNELMLVRWDAKKPATVSNLVLLKFKEADEHETKTLEEVKESETEFFERVSCVLKKAELDFYG

SEQ ID NO: 2242 - protein, 789 aa, Shewanella sp. MR-4
MQQYVLWYQELGMGDVNLVGGKNASLGEMISNLANAGVQVPGGFATTSYAFNEFLEQSGVNQKIYDILATLDVDDVNALAQVGAQIRQWVIDTPFQPALEQAIREAYDKLAAETSDASFAVRSSATAEDMPDASFAGQQETFLNVKGFDSVLVAIKHVFASLFNDRAISYRVHQGYEHHGVALSAGVQRMVRSDKAASGVMFTMDTESGNNDVVFITSSFGLGEMVVQGAVNPDEFYVHKPILTQGHKAVVRRNIGSKLIQMVYSDDASHGKQVKIEDVAAEKRRQFSINDAEVMELAKQAMVIEKHYGRPMDIEWAKDGNDGKLYIVQARPETVRSREDVQLIERYHLKSRGAVISEGRAIGHKVGSGVAKVLTSIADMDQIQPGDVLVTDMTDPDWEPIMKRASAIVTNRGGRTCHAAIIARELGVPAVVGCGDVTDRIKNGQLVTVSCAEGDTGYIYEGKQEFEVVSNRVDALPELPMKIMMNVGNPDRAFDFARLPNEGVGLARLEFIINRMIGIHPKALLEFNQQDAALQEEINEMIAGYDSPVEFYIARLVEGIASIGSAFYPKKVIVRMSDFKSNEYANLVGGDRYEPEEENPMLGFRGASRYISESFRDCFALECEAIKRVRNEMGLKNVEVMIPFVRTVKEAEQVIGLLKEQGLERGKDGLRVIMMCEVPSNALLADQFLEHFDGFSIGSNDLTQLSLGLDRDSGIISHLFDERNEAVKILLSMAIKAAKAKGAYIGICGQGPSDHADFAAWLVEQGIDTVSLNPDTVIDTWLYLAEAHA

SEQ ID NO: 2243 - protein, 455 aa, Aspergillus nidulans FGSC A4
MTDYHLSKRAAYNSVHGDVWGPREQSMGNPWSPFNPTGTVNLRLAENSLMHEEIAQSIKSEINVLPLEHLTYSTGPRGSRRLRGAAAEFLNQAFHSCQPITANDIFVTPGLASGIDALAWCICNDGDGILIPQPLYNGFRVDLLSRSNAHVVPVPYTGVDGYSSLDDLFRPDVNRKALKAAFERAQDSGITPPETIEEFILFCAAHRLHLISDEIYAHSVFKNPALPNATPFVSILSLNLVNSHTIDPTMIHVLYGASKDFCANGLRLGIVCTRNQGIIRAMSSISMFSWSPHLLHDVWARMLEDEQWLKSFMARKRELMADHYEIAARFFRECGIPFYEMNAGLFFWINLQHLIFPDSKSSSESASTDTSKKPSSLSITSSDSDEHRRREQRICNICMEHGVLIAPGHVYMAEEPGWFRITFTVGREALEEGLKRLKKSLLRVRAESEEGVKPQ

SEQ ID NO: 2244 - protein, 270 aa, Mannheimia succiniciproducens MBEL55E
MAIPLRTEAELEKIRIACKLASDILVMIEPHIKEGVSTGELDRICHEYIERVQGATPANVGYHGFPKATCISLNDVVCHGIPSEDKILKNGDILNLDVTVIKDGYYGDNSKMYIVGGETSVRSKLLCEVTQEALYVGIRAVRAGVRLNQIGKAIQQYVEKQGFSVVREYCGHGIGDQYHTEPQVLHYFGDDGGVVLKPGMVFTIEPMVNAGKKEVRLMGDGWTVKTKDRSHSAQFEHELVVTETGCEVMTIREEEEKEGRISRIMVNAEA

SEQ ID NO: 2245 - protein, 249 aa, Sinorhizobium meliloti 1021
MERRDFLRGLALLAACPLCVKTAYAAEGVHWRYEGEEGPEHWGSLAKENSACSAGSQQSPIDIRGAVKADIPELTADWKSGGTILNNGHTIQVNAAGGTLRRGDKSYDLVQYHFHSPSEHFVDGKSFPMEAHFVHKNAETGTLGVLGVFLVPGAANSTFASLAEKFPRNPGEESPLITIDPKGLLPSSLSYWTYEGSLTTPPCSEIVDWMVAMEAVEVDPGDIKKFTALYSMNARPALAGNRRYVLSSS

SEQ ID NO: 2246 - protein, 607 aa, Oryza sativa Indica Group
MSRRHARPLLPLLRRHLHRSATVHRSPAPAPPDGIPSSSSAPPDPAAARWPSSWSPAAPPLHSFAASHLREAVSPIAAAILALPGVDPDPLPALVEHNFPTLLAVSPLASLELLSLLRPNPQLGLAVFSSRRTLSPPATLPEFVLAISLAGRARDPAAAARLFAEASTAYCPDQALYNALMSSYMHSGLADRCIEAFHTLERDPRCGPPNADSYNILIALFGRSLLVDHMEATLLSLDASGHPRTIGTYNAIIAGYLTAWMWEKMESVFDEMVSGHVAPDKTTYLLMLRGYAHAGMIYKMELAYERARQHVGQVDMVHIRAMICAYCKFKHVDRIQKIEELLQKLGPDDYRPWLAVLLIRAYAQEGLVERMEQWIAEALERNTIVTTVQVMRSIITSYFQCDAVDKLAHFIRQAEEAGWKLCRSLYHCKMVMYGKQHRLPEMHWVLDEMEFFRFDRTKKTFWIMYKAYVNSGRMAEANTILCMMGKHGFGFPRGGTGADVEEASDGIGGGDVSGVRDSPVLGVDSSEVAAPYLHQCGRSQRQRRWRLVEGEVMGMALTWAAGKTALTAPNQIGSRGACMDGGAQCDTRRKCPAKKRRRLGGEDHTDI

SEQ ID NO: 2247 - protein, 168 aa, Zea mays
SFQKELDQIAEKADTSTPAGLSYVLTETTLALLRHPDCCISAYSSVDVKRSVDDGEKRFNQLSIEERGKFDEETLVNVNSIKRNKGGSQRSSGFSNEYIVITILVAAEGVHKLPVINSSNDLKTALQKMGAIPSSKILAVEVLWTPQNENDTLSERELLEDYPLLRPL

SEQ ID NO: 2248 - protein, 531 aa, Arabidopsis thaliana
MEALSSLTFKGSLPEAIFEAKGKKKLFVVYISGEDEESDKLNRLTWTDASVADSLSKYCILVHIQAGSVDATNFSAIYPYSSVPCIAAIGFSGTQVWRTEGFITAEDLASSLEKAWLGLHIQETTASIFSAALASQNSETPVSSASSVVLPPGSVPLDAAVASPSTASSVQPSETKSTVTSASTTENNDGTVAVKGKESAEPSNLCDTTKNQPAPSVDGTKANVEHEATETPLRVQAEKEPIRPTAPGTNDNTSRVRSSVDRKRKQGTVINEEDSGVGVSGRDINLTKSVDTKETMKPKDEGGEEEDGEKSKKASDVHLNIRLPDGSSLQEKFSVTSILRMVKDYVNSNQTIGLGAYDLAVPYPRKVYTDQDLDKSLSELRLFDRQALVVVPRKRATVYQRGTSYSESNNNTNPNSGGYFAYVRRVLSYANPFSYFGGGTANASSSVPERQTRPNTEVRNNLGQVGTSFQDPSEGRSNVRNRRPTTSRIGSNIHTLNHNEDEAPFGDGNAFWNGNSTQYGGGSGGDSNDRR

SEQ ID NO: 2249 - protein, 471 aa, Oryza sativa Indica Group
MARFILSLLELGVSATVHLLFGLYVFSTAVAADISQAAAASGCLLLRRPAAPGLVNVAAAGEEEERRGAAPVVLDGSPPPIVLVHGIFGFGKGRLGGLSYFAGAEKKDDRVLVPDLGSLTSIHDRARELFYYLKGGQVDYGEEHSKVFGHTRFGRTYDTGHYPVWDEQNPVHFVGHSAGVQVVRVLHQMLADKAFPGHDTSEDWVLSLTSLSGALNGTTRTYYDGMLAEDGRSMKSICLLQLCRIGVIVYDWLDIPWLKNYYNFGFDHFEMSWRKVGLSGLIDLLLGHTGPFASGDWILPDLTIQGSLKLNSTLRTFPNTFYFSYATKRTRKLFGITVPSSVLGIHPMLFLRVLQMCMWRHPQNAPLPYKGYRDEDWEDNDGALNTISMTHPRIPTEHPNRLVVDDSDCHPLQPGIWYYKIIEADHILFIVNRERAGVQFDLLYDGIFQRCRKHAFRRSPPTVPNESSQSQ

SEQ ID NO: 2250 - protein, 428 aa, Nitrosomonas europaea ATCC 19718 [sequence omitted]

SEQ ID NO: 2251 - protein, 294 aa, Oceanobacillus iheyensis HTE831
MNENLQRYLEIYREKLEATYNTYFSHLDIPNNLKESMLYSLNAGGKRLRPILILASYEVYGKTLDKVMSSAVAIEMIHTYSLIHDDLPAMDDDDYRRGKLTNHKQFNEATAILAGDALLTYSFQLISSDDLLTSDEKVELIRILSEASGPAGMVAGQILDMEAEKQAVTLEEMEEIHALKTGELIRFAIIAGAYLGGATDNQLKHLTDYAYYLGLIFQVQDDILDITGDASKIGKPVGSDELNEKSTYPKLLGLQGAIDQKNLYVEKAYKSLHLAGAEDSLLAELTKYFSERDH

SEQ ID NO: 2252 - protein, 300 aa, Clostridium perfringens SM101
MVFNSLLSLIGNTPILKANNLFEGNNVFVKLEKFNPGGSIKDRAALGMIEEAEKNGLLKENGVIVEPTSGNTGIAIAMIGKIKGYKVIITMPETMSKERRDMIKAYGAEIILTEGSKGMKGAIEEAERLASTNGYFMPQQFLNEANAKKHYETTAEEIIRDIPDLDVFIAGVGTGGTITGVGRKLKEYNPNIKIVAVEPSDSAVLSGENSGPHKIQGIGAGFVPKIYDSSVVDEIIKVKNEDAYTMAKNFADKEGILVGISSGAALKGAKYILKNIEKDKKVLVIAPDGGEKYFSTGLYE

SEQ ID NO: 2253 - protein, 710 aa, Oryza sativa Indica Group
MALTTFSISRGGFVGALPQEGHFAPAAAELSLHKLQSRPHKARRRSSSSISASLSTEREAAEYHSQRPPTPLLDTVNYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEPAYVRLAGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSLAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQALIRRLASSHEVLLTVEEGSIGGFGSHVAQFMALDGLLDGKLKWRPLVLPDRYIDHGSPADQLAEAGLTPSHIAATVFNVLGQAREALAIMTVPNA

SEQ ID NO: 2254 - protein, 280 aa, Oryza sativa Indica Group
MPPLARPSLAALLALCAFAAVERPPAGVGAANVPITTCRSFCGNITVDYPFALRAGCGHAGFRELLYCINGALMLHLPSGSYRVLDIDYAYRGLTLHDPAMSDCRALDRSRGGRGNGFVVEPWRAPYLAPDPDNVFLLLGCRASSPLFQGFPDRHLPCRNVSGMGCGEYYGCPAWDDYGGRRPSGAAYGAAAPTECCAVSWDAIRAVNANRGFCGACRATGGVCGHDGDSHGDLCLCGDWNSTSNCDSSADAARPNAASAAPRAIVALCLGVLASGFSFL

SEQ ID NO: 2255 - protein, 374 aa, Guillardia theta
GHTSNFTSIILSGVHAADLLHCLQELNFGVSAHVERASVAVARHSTMAVPSLSLMEIGARPSDPKPHILVVVLDPLGDVMRAQLLNVIGKLFAIAEVMAAAGAEAAGFYSSPVMQLRGGGDRRFLIAGNWKMNPETMDEAKALASSVVESAKSVKKGVDICICCPHPFLATCAQICKDSEVKIGAQDIFTEEKGAFTGGVSIKQVESIGCKYVLIGHSERRHGNIASESNAMINKKVKMTIDSGLVACLCIGETKAEFEAKKNKEVCAKQLAEGLAGVTKEQLANVVLAYEPVWAIGTGYTASPEIAQDVHNYVRQWLEQNYDKATAESVRILYGGSVTPDNVDQLMACPDIDGALVGGASLVGEKFARIMNFK

SEQ ID NO: 2256 - protein, 295 aa, Clostridium difficile 630
MEFKQCLKEKASFVEKVLKEYMPKEEGYQKTVIEAMNYSLSAGGKRLRPILTLEACKIVGGNEDEAIPFAIAIEMIHTYSLIHDDLPALDNDDLRRGRPTNHKVYGEAMGILAGDALLNYAFEVMLAGSINKENPEKYLKAINEIAKGAGIYGMIGGQVVDVESENKQIEKEKLDYIHMNKTAAMMVGCMRAGATIGGANSEQMEEITKYAKNIGLSFQIVDDILDIVGDEAKLGKKVGSDIENHKSTYPSLLGLDKSKEIAHNLIDEAKKSIEKLSDDVDFLKGLAEYIIDREY

SEQ ID NO: 2257 - protein, 621 aa, Clostridium difficile 630
MYKYLDKVNSPKNIKNMSIEEMDLLAKDIRKFLVKSVSKTGGHLASNLGVVELTLALHKVFDSPKDKIVWDVGHQSYVHKIVTGRKDCFVSLRQFNGLSGFPKENESPHDIFDTGHSSTSISIATGIACARDIKKENYSVISVIGDGSITGGMALEALNQLGYIDTNMIVILNDNEMSIDKNVGGMSKYLSSIIRNSTVEKMTDEVDKILNVTQTGEILSKTAHRFKDKLMYSFSPQDCSFFDSLGIRYYGPIDGHNTKELIDILRKAKHKKGPVLLHVITKKGKGYRFAEEQPDKYHGVSKFDIKTGVTSAKVKSMSISVGEKLVDMANSNENIVAITAAMPSGTGLNLFESAYPKRYYDVGIAEQHATGFAAGLAKNGMKPYFAVYSSFLQRAYDQVIHDVCITKKPVTFLIDRAGLVGNDGETHHGMFDLSYLNSIPNIVVMAPKDTREMELMMDLSLKLDCPLAIRYPRGSSYYLDKGEYGEIVLGKYEVLDDGQDTVILCIGSMVKHALEAKEILSREGINPTIVNARFLKPIDEGMLKALLKNHKNVVTIEDNIVTGGFGSRINKFIIDNEYNVNILNIAIPEEFVKHGNIDELYDFVGLSPKSIADKIRKLVIE

SEQ ID NO: 2258 - protein, 706 aa, Ostreococcus tauri
MPARRPRPDRALVVVPTLARVAEIIDRASIPRGALELDARSPPSSSATDRPWPSTSRAATRWIDLIDSTSDCFTSTLISCTDRAPIEHRSSTGRAPIEHRSSTDRAPIEHRSSTDRAPIEHRSSTDRAPIEHRSSTDRAGAGAMTTPRRRRLDDAWSRRRARRRHARATGARGRLGRGQRCRATRAGGRGVSAGESTPRAMSSANGIEKLVRRACDGTSPSVDEDAMRAIKRAAKADDNALKCAHEALMRVMASTRSGAATRAHAVTATSELFTRSRLFRELTMDKLEIIMKHAVGTDDDFPLPDVPKGEADRLRQHAVSVLDEWERKFKNQYKQLTLARKFVTERLGEDAPEVRAERARVLALEKERQVQRNLQRQWLSTKGELPALLREVRETLHAAGECFCMLFGDTFETRFNREVERKAHALEDDADETWEDVADGAADWRFAQEFGDADESPETTSTTGIALRETDENAPIIEQLRGLYRSTKARYLACLTEVLQILGHIQPEQITDDGVVVISQDERLSTVNVVGDLKQLLTSFVGRCETLRLIRSRGGDEGADPNANTSSKPEPSEPVDDGESRRDASNASVGVLLDRAAKRQKRGVTQSRRVREAKAKQESERDIGRRAQQMLASQIRAHNDEVLAEAGLDFFEMERRKQNTASEAKANEIIEEEIERREALEVRGKTARQRIEKSLRQLRRQKNRKI

SEQ ID NO: 2259 - protein, 245 aa, Glycine max
MALCVPTATATLPFKCIIDSHSSKPTSLFSFSPKKLNTTPHLNLILQVQVADSGKWRNMVSFFPGFLTKGSDVQKLKVELYEAIAPLDRGAEATPEDQQRVDQIARKLEAVNPVKEPLKSGLLNGKWELFYTTSQSILQTQRPKLLRPNGKIYQAINVDTLRAQNIETWPFYNQATANLVPLNSKRVAVKFDFFKIASLIPIKSPGSGRGQLEITYLDEDLRISRGNRGNLFILKMVDPSYRVPL

SEQ ID NO: 2260 - protein, 370 aa, Cryptococcus neoformans var. neoformans JEC21
MAPRDIGRVFMDVAFFAASQVALYYTLRYVVSSLDPASGSSRKAKEKSKSLLAQTGLSEAQLASLELDEYEQAIAAEIVPPSSIDVTFEGIGGLDDIIASLRETVIYPLTFPELFGSGNGLLSAPKGVLLYGHPGCGKTMLAKALAKESGATFINLPLSSLTNKWFGESNKLVAGLFSLAKKLQPSIIFIDEIDSLFRERSAGDHEVTAMMKAEFMTLWDGLTTGSDSRILVLGATNRPNDIDPAILRRMPKRFAIRLPNHEQRVKILTLMLMHTRLASDFSIEKLAQRTDGLSGSDLRETCRNAVMTPVQELMREKGKSGVQGLEKARKEGFQIRPLNMDDFVLHDSHAYAYVDPSRRPPGAYVTESLD

SEQ ID NO: 2261 - protein, 552 aa, Thermotoga sp. RQ2
MKVYVSGKGTLMDALRKELEDSEWQLSESIEDAGLIVSSEILEILSSNQRIVDLYPIKEKSIPFYKEESIRFASIFPVFHGEFAYSEFYVVEKVSDEAIENFLDFLRKLGVVLKDVLWDDYVKLLDRSCAVFYLGSAFRDPFLIDHVSHLLSWEEEKESFLRRGKEVIANLSEGSTPEETPNIVSKVLAALRDPSNITEMRHKIRLIDFILLRFIEERMKVARDVAREKKKTDSPIDIRDIEEQKIKEILDRTDLNPVRMRRIFEEIMKLAKEEEYRLLGISRTVAVLGPMGSFSDEMAMKLIGSRIPLKYCSTTDEIIEMVEKGEVDYGIVPIENSTYGTVIPVLDALLNHEVEVFGEAKLEIHHCLVSKKKLDLKEIKRIYSHPQAISQSLGFINTYLSHAEIRYTSSTSDAVNLLDDESAAIMSESAAKMYGLLILRRSIQDLKEKNITRFYIIRRKTGKMEGKYTSLFFGVQDRPGSLKAVLDIFASRGINLRKLESRPARTFLGDYVFFVEVEAPLKEEDIRDLEKVTAFYKIIGVFDEVEELDVFK

SEQ ID NO: 2262 - protein, 686 aa, Zea mays
MPANDHHPNGLLQESAPGLQHDDMENQQQQVCWERFLLKDTLNVLLVESDASTRQVVSALLRCCMYQVISAKNGQQAWSYLEDKGNNIDLVLTEVFMPGVSGISLLNRIMRHSVFKNIPVIMMSSSDDMSTVFKCLSKGAVDFLVKPIRKNELKNLWQHVWRQRCHSSSGSGSESGIQTQKCAKSKGVNESGNNSGSNDDEAGMGLNARDDSDNGSGTQAQNLWTKLAVEIDSPQATSLDQLADPPNSTCAQVIHSKSEICSNRWLPDKSNRNCKKPKNTNDDFKGKDLEIGGPENLYMGHQSSPNGRSIKAADHENNSKESMMENLEEPTVRAADLIGSMAKNMDTQQAARAAEDTPNFSSKVPEGKGKNNQNDKYVLPSLELSLKRSRSCGDGANNKNTVKDDEQRNCVLRRSNLSAFTRYHTSAASNQGGTGLVGSCSPHDNSSEAVKTDSTYNMKSNSDAAPIKQGSNGSSNDNDMGSTTKDVVTKPMLPSAIKANGYTSAFHPVQQWMVPANATAGKTKADENTARNHYVHFENGGSGALQCGSSNVFDPPLEGQATNNYGGVKAGSNSGSNKGQNNGSTAAANAGLAETEIQAMDKSGVGGGNGNGSGSGSGNDTYVRRLAANMTPRQAQLKKYREKKKDRNFGKKVRYQSRKRLADQRPRVRGQFVKQAVQNQDGARER

SEQ ID NO: 2263 - protein, 364 aa, Shewanella oneidensis MR-1
MSYQIAVLAGDGIGPEVMAEARKVLKAVEARFGLNIEYTEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREISRIARIAFEAARGRRKKVTSVDKANVLACSVLWRQVVEEVAVDFPDVELEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVTKALNSGYLTGELLSSDQRHKAKTTVQMGDFIADAVKAGV

SEQ ID NO: 2264 - protein, 175 aa, Robiginitalea biformata HTCC2501
MDNQWFTISVYSENHVGLLNRISGIFLKRHINIESLNVSKSEIEGISKFTIVVHTTENWTRHIVAQIEKQIEVIKAFYHTDEETIYQESALFKIASHLLFDERQIQNIIKDSHAQIVTVSRDYFVLAKTGRRSEIDQMHDDLEPFGIMQFVRSGRITVTKAEMPITALLANFQQS

SEQ ID NO: 2265 - protein, 183 aa, Rickettsiella grylli
MLNALVTLGPGKKIPDEINVVIEIPSHSDPIKYEVDKETGALCVDRFLGTAMYYPCNYGYVPSTLSEDGDPVDVLVVAPFPLLVGCVICCRLIGMLKMKDESGNDAKILAVPIDKLSSLYHTIKTWKDLPQQLIQSIQHFFEHYKDLENGKWVQVEGWVGPEEAKMEMVTSIERYKKTLSLLR

SEQ ID NO: 2266 - protein, 398 aa, Chlamydomonas reinhardtii
SVISQFNLVCGSAWKSQLANAGFFMGYLIGSGVFGGVSDSRGRKPVLFGCTAFGAACTVGVGLAPNYVVYFIMRLLTGIGAAGQALTAYILATESVGPAWRGTAGVTTQCVFIFGEFVLVLIAYVARPWRVLSFTVAVVNAAQLLLWPFLPESPRWLLVRGRVEEATAVLAKIAAGNGRAMPSEPLASAAHSGDSGTAKPLGLTAMLLSDRHMLRRFLVLAYVWMVVCMTYYGISLALSGLPGSIYVSFMIAAAAELPANLVAAWAIDRFGRHNTMAWGMLLGGAACLACAFVPAGPASSAFAALGKFGCAGAFTIASIFTSEMFPTLVRSAVLGAENEAARVGGIAAPFIVLVGGAMPFIIFGIASLVAGAAIFTLPETLGTRLPDTMQGERPLCIP

SEQ ID NO: 2267 - protein, 287 aa, Bacillus cereus ATCC 14579
MKISVYVASAFSKEHKGGNKAGVVFIENTNTLTTTQKIEIAKQLGYAETAFISESEIADYKFEYFTPKEEVDLCGHATIGSFAILMYLNKLFRNRYTIETNSGVLTITIKDDIIFMEQNKPRFYDVVSPNEFIDCFDSKDIDNKYPIQIVSTGLKDILIPIKSEIQLHALQPNFEKIKEISKYYNVVGMHLYTFNDNRIICRNFAPLYDINEEAATGTSNGALACYLYEQHYLQKEVYVFEQGYSLHSPSEILVKLATNSKNKIEKVYVGGKGYYCETKCLNIENIE

SEQ ID NO: 2268 - protein, 345 aa, Bacillus cereus ATCC 14579
MKAVVVNKNSKANIEVIEKELRPLHSGEALVDVEYCGVCHTDLHVANHDFGNTDGRILGHEGVGIVTKIADDVTSLKIGDRVSIAWMFQSCGRCEYCVTGRETFCREVKNAGYSVDGGMAEQCIVTADYAVKVPEGLDPAQASSITCAGVTTYKAIKVSDIKPSQPIVIYGCGGLGNLAIQYAKNVFGAKVIAVDINDDKLALAKEVGADMTINPISQGPADKIVQEKFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKKHNCDCK

SEQ ID NO: 2269 - protein, 584 aa, Neisseria meningitidis FAM18
MLLDAAGGVPEIRQSRCRLLNYILLHFNPVLKNQGKQMNAFTRAWYALERHYQDTRHVLLRDRFACEPDRFERMHERLDGMLFDYSKNRLGEDTLQLLCRLAETADLEGKMRALRTGAKVNGSEGRAALHTALRLPDGADAVYVDGRDVLPEIRRELNRALEFAHSLDDGSYQGITGKRITDFVHIGIGGSDLGPAMCVQALEPFRRHIAVHFAANADPACLDAVLCRLNPETTVFCVASKSFKTPETLLNAQAVKAWYRGAGFSESETACHFCAVSADTAAAAAFGIAAERVFAMYDWVGGRYSVWSSVGLPVMVAVGGARFRELLAGAHAMDSHFFHTPPRRNIPVLMALIAVWYNNFQHADGQTAVPYSHNLRLLPVWLNQLDMESLGKSRASDGSPAVCKTGGIVFGGEGVNCQHAYFQLLHQGTRLIPCDFIVPMTAQGVEDGRSRFTVANAFAQAEALMKGKTLDEARAELADLPEAERERLAPHKEFPGNRPSNSILLDRLTPYNLGMLMAAYEHKTFVQGTIWNVNPFDQWGVEYGKQLAKTIIGELEGGTSVHDASTEGLMAFYRECRLKGGGAA

SEQ ID NO: 2270 - protein, 507 aa, Vibrio vulnificus YJ016
MRIVVWSAFIRSRRMELKQRLSQQLKESRDAFLRNPYPTYQKRLENLNKLESLIKAHQAEIIYAIEQDFGTRSISETGLLELFTSIETIRDAKKQLKKWMKPSHRHTSVWFFPAKNRVVPQPLGVVGVIVPWNYPLMLTIGPLVAALAAGNRVMLKMSQNSPHLAQLLVELFEAQFNRDEVAIYADEAEMGPEFSKLKFDHLLFTGSTKTGRAVMQSAANNLVPVTLELGGKSPVILDEKFDVKIALERLLGGKLYNCGQTCIAPDYLFVPQSRLNEVVETTKAIMAKRFRTIQHQDYTSIIDANAFERLTHLLSDAKEKGAKLINCIPNSEPERGSRKLPFYLVTEVESDMAVMQEEIFGPILPIITYQHIDEVFHYIAQRPRPLALYLFSEDKWIQKKFTQETLSGGLCINDVMLHVAQHDLPFGGVGESGMGHYHGREGFNTFSKLKPVMTQSRFALTPLFYSPYSGFAKSILNVMINRKIGNYESAIQQKLTSLLRIIGRDVS

SEQ ID NO: 2271 - protein, 393 aa, Oryza sativa Japonica Group
MELCRIRTFQKSLLRPLLLLQHAPCRTLQTLGRSPSPSVFRPPRRRPPLLLLLLRSSFASVSPGPAPGSGTGECPPPPPAPLPPDELASDDDAYYHEHILEATQEDQSRLVPVKAYFPCTSINLKSLQSQNSFNVIPPTSRATNYVVLRYYDVKGDPEGFKAGIIDESHCHYMVVFQYGSIVLFNVSDHEADGYLKIVEKHASGLLPEMRKDDYAVVEKPTLETWMQGGLDFIILRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIVQEQM

SEQ ID NO: 2272 - protein, 479 aa, Aspergillus nidulans FGSC A4
MASRRLAYNFNQALRSRAALKSIQPVKRGFASPVALPSTTQSTTLSNGFTIATEYSPWAQTSTVGVWIDAGSRAETDKTNGTAHFLEHLAFKGTSKRSQHQLELEIENMGAHLNAYTSRENTVYYAKSFNNDVPKAVDILADILQNSKLESAAIERERDVILREQEEVDKQLEEVVFDHLHATAYQHQPLGRTILGPKENIQTITRDNLTDYIKTNYTADRMVLVGAGGIPHEQLVKLAEQHFGSLPSKPPTSALAALTAEQKRQPEFIGSEIRIRDDTLPTAHIALAVEGVSWKDDDYFTALVAQAIVGNWDRAMGNSPYLGSKLSSFVERNNLANSFMSFSTSYSDTGLWGIYLVSENMTGLDDLIHFALREWSRLSFNVTAAEVERAKAQLKASILLSLDGTTAIAEDIGRQIITTGRRLSPEDIERTIGQITEKDVMDFANRKLWDQDIAMSAVGSIEGILDYNRIRSDMSRNAY

SEQ ID NO: 2273 - protein, 557 aa, Oryza sativa Japonica Group
MQNSIDLVLTEVVMPGVSGISLLSRIMNHNICKNIPVIMMSSNDAMGTVFKCLSKGAVDFLVKPIRKNELKNLWQHVWRRCHSSSGSGSESGIQTQKCAKSKSGDESNNNNGSNDDDDDDGVIMGLNARDGSDNGSGTQAQSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARAANAPNCSSKVPEGKDKNRDNIMPSLELSLKRYHTPVASNQGGTGFMGSCSLHDNSSEAMKTDSAYNMKSNSDAAPINQGSNGSSNNNDMGSTTKNVVTKPSTNKERHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVNAERPNMEIANGTINKSGPGGGNGSGSGSGNDMWTYNTTPVVCACGVKLERTTPYLSMSCTATMRRECSAL

SEQ ID NO: 2274 - protein, 472 aa, Staphylococcus aureus subsp. aureus MRSA252
MENTVKYRKFILPIVVGLLIWALTPFKPDTVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDESSRKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVIALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 2275 - protein, 443 aa, Solanum tuberosum
MFGRAPKKSDNTKYYEILGVPKTAAPEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCSKCKGKGSKSGASMKCSGCQGSGMKVTIRQLGPSMIQQMQHPCNECKGTGEMINDKDRCGQCKGEKVVQEKKVLEVVVEKGMQNGQKITFPGEADEAPDTVTGDIVFVLQQKEHPKFKRKGDDLFVEHTLSLTEALCGFQFILTHLDNRQLIIKPQPGEVVKPDQFKAINDEGMPMYQRPFMRGKLYIHFTVEFPDTLSPEQCKNLEAVLPPKPKTQMTDMELDECEETTLHDVHIEEEMRRKQQQAQEAYDEDDEDMHGGAQRSSMCTTVIWHHGSCTKELTSRFNSCFHVFV

SEQ ID NO: 2276 - protein, 342 aa, Physcomitrella patens subsp. patens
MAPDKIRIGVNGFGRFGRLVARVILERDDIDLIAVNDPFISTDYMAYMFKFDTVHGRMMDIDIYAEDEQTLSFDGKKVTVLSYKELHEIPWSELGVDYVVECTGNYTTKERAAEHLKGGAKKVIITEFSKDAPMFVMGVNEWEYRPEYNVVAMASCTTNCLMPLLKLLNDRYGVVEGVLTTVHSLTATQKLLDGPSLTDWRGGRANILASSTSAAKAIGRLVPRMSGRIRAMALRVPTADASLVDLVVKLDKQVSYEKVCEVIKEEAAGNLKDVLGYTEEDAVSHDFLGDSRSSIFDAKSGFEFGNGFLKLVAWFDNEWGYSHRVVDLIKHMASLQPLPLHH

SEQ ID NO: 2277 - protein, 629 aa, Candida albicans SC5314
MTPIQQTPSVHNTIDDSSNGFPNQISLGEYLFYRISQANPKLKSIFGIPGDFNLNLLEHVYSPIIAEREIKFINTCNELNCAYAADGYSRVIGGMSAMITTFGVGELSAINGIAGAFAEHCPVLHIVGTTSMKDRLRAPNEMINIHHLVPNHDPLKPPNHDVYKSMVENISVVQESLDYDTKKNLIKIDNVLKKIIQEARPGYLFIPCDVPDLPVPGKMLFSDPFTAATRYTNSILSKQVLNDVTNAILEKMYDAKNPSIFSDCLTTRFGFQNDLNRFIDQIPETVKLFTANLARNLDESRNNFVGVYNGNGSSDDKTKQEFESSDFILTLGFFPNEMNTGGHTSNFSMIKDVVIVHPDYIKVNHQIYHIKQNDGERLFTLGEFLCTLTEKFDPSKLSVAAAEPKKIYQYQPSQQYSPSNLDYIPQGKLIDHFNSTLKPNDLFILETSSFVFGLPDMKFPTNVQLLTSPYYGSIGYAVPATFGATLAVNDLKSDRRIIVVQGDGSAQMTVQELSSFVRYKEILPNMPHIYLINNDGYTIERKIKGPNRSYNDINGKWKWRNLLNVFGGVEGEMYDSCVLKNSSELDQFFNGDKTKPISSHKLQFYEIIAGKFDVPQRVDNMMCISKNKN

SEQ ID NO: 2278 - protein, 163 aa, Mannheimia succiniciproducens MBEL55E
MRRILSVLLENESGALSRVVALFSQRAFNIESLTVAPTDDPTLSRMTIEASGDEAILEQIEKQLHKLVDVFKVINLSDCEHVEREVMLLKLRATGSTRDEIKRLTDIFRGQIVDVTTKSYTIQLAGTKDKLNAFVSAVKEETTIIEIVRSGLISLSRGEKNCL

SEQ ID NO: 2279 - protein, 280 aa, Pisum sativum
SARGKPKMGTMESLKFLVSSRYIRDLATLVVAYGISINLVEVTWKSKLKAQFPSPNEYSSFMGDFSTATGIATFIMMLLSQYIFDKYGWGVAAKITPTVLLLTGVGFFSLILFGGPIAPGLASLGMTPLLAAVYVGALQNIFSKSAKYSLFDPCKEMAYIPLDEDTKVKGKAAIDVVCNPLGKSGGALIQQFMILTFGSLANSTPYLGGVLLVIVLAWLGAAKSLDTQFTALRKEEELEKEMERAAAVKIPVVSENDGGNGSLTSDSSNSPSEASTPRNN

SEQ ID NO: 2280 - protein, 253 aa, Brassica napus
VKRDFRLVVRGAARNMVKILNGSDNEVLIIKSVTHRDFNEMIKTIPNPVYLFQGIVLRRGAKGTGMKSIELALSMCDIVDIYGFTVDPGYTEWTRYFSTPRRGHNPLQGRAYYQLLECLGVIRIHSPMRSERKEDWSSVPSREMITRAHASALRLQRSQQATSLKKDGLGQFGNCKVWGDADPRKGPVSGSPDMSEVRKKSDYKKWEVMPFTSLRKEARDHYVQMQGVSQYKMDGNKLDDLVCVRHRPLESET

SEQ ID NO: 2281 - protein, 508 aa, Shewanella sp. MR-4
MQNHSNLNDIGVIGLGVMGKNLALNIADNQYRVSAFDLDPVKVNGVLQQEKQERVGQDLRITGCANLSEMLASLAQPRILVLSVPAGAPVDGVCHALISAGIEADDIVIDTGNSLWTDTVEREKRYQGKFIFFSSAVSGGEVGARFGPSLMPSGDLGAWQHVAPIWKAIAAKVDPQTGLPIERFEPGNPVTEGEPCTTYIGPAGAGHYVKMVHNGIEYADMQLICEAYQLMHDGLGMSAAQVGEVFERWNKGSLNSYLMGISAEVLKQADPLTGLPLVEMILDKAGQKGTGLWTAVSSLQIGCPAPTIAEAVYARAVSTQKSLRVELSKKLAGPVSVAMDDAQKAVLIDALESALYCAKVCCYAQGFQLMAMTAQEQKWQLDFAEIAKIWRAGCIIRATFLQSITQAYQADADLSCLLMADTFATTLSEKQTEWRSAVAAAVMQGIPVPCISSALAYYDSYRSETLPANLLQGQRDFFGAHTFERSDKPAGEKYHLDWSAPNRVLIKL

SEQ ID NO: 2282 - protein, 698 aa, Cryptococcus neoformans var. neoformans JEC21
MSTAPPDTEILNPEDEEFYASWGLCILCVLLIGALISSYYLQVKRIRAVHETVISIFAGMVVGLIIRLAPGHMIRDMMSFKHTFFFNALLPPIILNSGYELKQENFFRNFAVILTFAFLGTFITAVGVGVLVYIWSFLGLEGLKFTLLECLIFGSTLSATDPVTILAIFNTAKVDPKLYSIIFGESILNDAVSIVMYETLSHFHGEDIYVSSLFHGVGIFLFSFLISMALGVSFGLACSLGLKHSHLASYPHIESCIITLVAYTSYFFSNGLAMSGIVSLLFCGITLKHYAYHTMSRRTQRTTKYMFGVLAQLSENFIFIYLGLNLFTQDVQVFKPLFILVSAIAVMASRYAAVFPLSELINWIFHTRGQRTEEIPHSYQMMLFWAGLRGAVGVALAAGITGDNADALRTTILVVVVLTVIVFGGTTSRMLEVLGIRVGVEDEDASSDDEEPWTAQPGHLALQSGAGFRRYPYSSQNSRGWEDPSELDLQSPEGSPYNQTLKLSHSRQARSSSYGQGRYGYGVRSGFSTNSDESDEEVLPSAGPSGSYGDGYDPEANVPGTSSDNRAGEGKGPSMIFRDGQWFTALDERYLLPLFSNSVTARRHHAKKAVRKGALAASGAGGRDTPGTGSKSGSTSGTPRRASLELGDDGYGGDGESENGKNKGLPRTFSGSVSDFFFSKSEPSPLPSTSLPLDERGK

SEQ ID NO: 2283 - protein, 176 aa, Glycine max
  misc_feature (66)..(66): Xaa can be any naturally occurring amino acid
  misc_feature (154)..(154): Xaa can be any naturally occurring amino acid
VNASNLTIAWSAGNAYLYMSSRALYALAISGQAPRVFLRCTKGGVPYAAVLACGLFGFLAYLNCGXNSSSPVFPWFVTITNTSGFVSWICCCIVYLRFRAACKRQGVHELPYRSWLQPYGAWFGLVFFIVLALINGFNVFFPSQLTASSFLTAXNSLPAFAIIYPSHKLLVGRYNP

SEQ ID NO: 2284 - protein, 334 aa, Mycobacterium sp. MCS
MSYVASGGEFNRDTDYITDRITADGRDGYPVEPGRYRLIVARACPWANRTIIVRRLLGLEDALSIGFCGPTHDERSWTFDLDPDGVDPVLKIPRLQDAYFKRFTDYPKGITVPAVVEVSTGQVVTNDFPQITLDFSTEWTAHHRDGAPDLYPEKHRDEIDEVAQRIYTEVNNGVYRCGFAGSQRAYEKAYDRLFTALDWLEDRLAGQRYLVGDTITEADVRLFTTLARFDPVYHGHFKCNRAKLSEMPALWGYARDLFQTPGFGDTVDFVQIKQHYYIVHSDINPTQVVPKGPDLANWLTSHGREALGGRPFGDGTPPGPAREGERVAAGHTPL

SEQ ID NO: 2285 - protein, 444 aa, Mannheimia succiniciproducens MBEL55E
MTILVLGINHKTASVALREKVAFSPEKRDLAFQQIAQSELAQSEVILSTCNRTEIYLHNKHISPEADQENQRWLEQCIQWFADVHQLDVDELRNCLYIKQNQSAVNHLMRVSCGLDSLVLGEPQILGQVKQAYQYSEDYCQAQHMPMSSEFSRLFQKTFSVAKRVRTETNIGNSAVSVAYAACSLARQIFEGLKDLNILLVGAGETIELVARHLLRHGVKKLMISNRTLARAELLVEKLEHNKYIQVLSLQQLQDGLNQADIVISSTGSPIVLITAEMVKQAQQKRRNAPMLIVDIAVPRDVDERVEKLDGVYHYTVDDLHSIIQRNLSEREKASKEAETIIDAEASDFFEWMKVHQFSNLIRTYRESAEQIRQDLLEKAVQAIGQNEDPETVLQELSYKLMNKLIHSPTQAMQAMMKQGSIQGLRSFSSALGIADKKERNPQK

SEQ ID NO: 2286 - protein, 154 aa, Brassica napus
  misc_feature (22)..(22): Xaa can be any naturally occurring amino acid
  misc_feature (24)..(24): Xaa can be any naturally occurring amino acid
  misc_feature (30)..(30): Xaa can be any naturally occurring amino acid
  misc_feature (32)..(32): Xaa can be any naturally occurring amino acid
  misc_feature (36)..(36): Xaa can be any naturally occurring amino acid
  misc_feature (38)..(38): Xaa can be any naturally occurring amino acid
  misc_feature (40)..(40): Xaa can be any naturally occurring amino acid
  misc_feature (42)..(42): Xaa can be any naturally occurring amino acid
  misc_feature (44)..(44): Xaa can be any naturally occurring amino acid
  misc_feature (58)..(59): Xaa can be any naturally occurring amino acid
  misc_feature (83)..(83): Xaa can be any naturally occurring amino acid
  misc_feature (110)..(110): Xaa can be any naturally occurring amino acid
  misc_feature (114)..(115): Xaa can be any naturally occurring amino acid
  misc_feature (117)..(117): Xaa can be any naturally occurring amino acid
  misc_feature (126)..(126): Xaa can be any naturally occurring amino acid
  misc_feature (128)..(128): Xaa can be any naturally occurring amino acid
  misc_feature (132)..(132): Xaa can be any naturally occurring amino acid
  misc_feature (136)..(136): Xaa can be any naturally occurring amino acid
  misc_feature (139)..(139): Xaa can be any naturally occurring amino acid
KKITDIHPTPPNTTSLSSYFLXFXNASPTXFXAVHXSXRXLXHXGYEQLSERDDWKLXXGKKYFFTRNYSTIVAFAVGKKYEXGNGFHIIGAHTDSPCLKLKPVSKVTKXGCLXXGXQTYGGGLWXLXFDRXLTAXPHXVIPPYPVFPYPSILS

SEQ ID NO: 2287 - protein, 433 aa, Shewanella sp. MR-4
MRFESFSFCPEILRAISDCGYQKMTPIQQQAIPAIRRGQDVLASAQTGTGKTAAFALPILQKMAENPSETLKSNARVLILTPTRELAAQVADNVEAYSKYLNFSVLTIYGGVKVETQAQKLKRGADIIVATPGRLLEHLTACNLSLSSIDFLVLDEADRMLDMGFNADIQKILQAVNKKRQNLLFSATFSSAVKKLANEMMVKPQVISADKQNTTADTVSQVVYPVEQRRKRELLSELIGKKNWQQVLVFTATRDAADTLVKELNLDGIPSEVVHGEKAQGSRRRALREFMSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRLDNVSEQIVAEKSMQGRRVKMKVGQAPSKAKKLK

SEQ ID NO: 2288 - protein, 459 aa, Geobacillus kaustophilus HTA426
MAYSYEQLEQWDKQYVWHPFTQMKQYAKERPLIIERGQGSYLYDVDGNRYLDGYASLWVNVHGHNDPELNAALREQLEKIAHSTLLGSANVPSILLAKRLLEYWPHMSKVFYSDTGAAAVEIALKIAYQYWKNIDPVQYAKKNKFVSLKEAYHGDTVGAVSVGGMETFHRIFAPLLFERIEVPSPYVYRMDEYGSEQEIVGYCLRELERVLEEQHDQIAAVVIEPLVQGAAGIIVHPRGFLKGVERLCRRYGVLFICDEVAVGFGRTGTMFACEQEEVKPDLVCLGKGITGGYLPLAATLVTEEIYAAFLGDVDEDKTFYHGHTYTGNQLTCSVALKNIELIEKRSLIDSVKRKARRLAEWLERLYEIPIVGDIRQKGLMCGIEIVKDRRTKEVFPRAAMVEHRIILEARRRGLVIRPLGPVLTFIPVLSMSEDEMAEAVRILFDSLACLYEQARAELL

SEQ ID NO: 2289 - protein, 578 aa, Glycine max
MSQVVATRSIHSSLTRPTSGSAHHRAQTLLKPPTFASKLFGAQRNNPSKVCSRSCLVNARKSAPAKVVPVSPEDDSKIEEELQHLRGMQQLGDTSVGMWSKPTFRRKTKVVCTIGPSTNTREMIWKLAEAGMNVARLNMSHGDHASHQKIIDLVKEYNAQSKDNVIAIMLDTKGPEVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIISICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGRQPIWRFQSTHNIQVRTVKTK

SEQ ID NO: 2290 - protein, 208 aa, Glycine max
MAMAAGNNNPIVFDPSTSMYLVSCDGLTIETTITDKSGIVDKWIQVVSSTYAGKQRIVGLDTEWTTAKKPKMKVAILQLCIENKCLIIQLFHMDNIPQSLRSFLMDSNFEFVGVGVINDLRMLKNDYGLECNKGIDVSLLAKEKWPHRISSGALKYLAKELVGLEMEKSKAVCTSEWQSKELTQTQIEYACIDAYASFKIGKMILNQD

SEQ ID NO: 2291 - protein, 482 aa, Burkholderia mallei ATCC 23344
MIDRRMLIGGAWCEAEHGATFERRDPVTGALASRAPAASAADAERAVAAAHAAFPAWAALAPTERRRRLLKAADLMDARGAAFVAAGVAETGATPAWIGLNVALAANVLREAASMATRISGDVMPSDVPGNLALAVRAPCGVVLGIAPWNAPVILGTRALAMPLACGNTVVLKASELCPGVHALIGAALHDAGLGDGVVNVLTHAAADAPALVERLIADPRVRRVNFTGSTHVGRIVARLAAEHLKPALLELGGKAPVVVLDDADLDAAVDAIAFGAFFNQGQICMSTERVIAARAIADALVDKLAAKARTLAAGDPRAGLPLGAMVSRDAAARAAALVDDAASRGAALPLGCRVDGAIMQPTIVDRVTPDMRLYREESFAPVVAVLRAGDDEHAIALANDSAFGLAASVFGRDLARALAVARRIESGICHVNGPTVHDEAQMPFGGVKASGYGRFGGAASIAEFTELRWLTVQTAPRAYPI

SEQ ID NO: 2292 - protein, 310 aa, Bacillus anthracis str. Ames
MKKVLFLGDPGIDDSLAIMYGLLHPDIDIVGVVTGYGNVTQEKATSNAAYLLQLAGREDIPIINGAKIPLSGDITTYYPEIHGAEGLGPIRPPKNLSPNIRPFCEFFDILEKYKGELIIVDAGRSTTLATAFILEKPLMKYVKEYYIMGGAFLMPGNVTPVAEANFHGDPIASQLVMQNAKNVTLVPLNVTSEAIITPEMVKYITKHSKTSFNKLIEPIFTYYYKAYRKLNPKITGSPVHDVVTMMVAANPSILDYVYRRVDVDTVGIAKGESIADFRPQPDAKALKNWVRIGWSLHYKKFLEDFVKIMT

SEQ ID NO: 2293 - protein, 660 aa, Geobacillus kaustophilus HTA426
MWFKNHIAKNDFLFLSYSTGEWRRFFSVLIWGGGEYIKVKPHFSQGLVPLMHDKRDLGARLAAFYRGMAEWVGQKQKYFPLPSHEESRDQLLAYLYMREHMPSDLHEAMEDAGWRLEGQEAHLIDAIEQVLAYLRTRVDGGWELRKMTRKEAKQLLHKRAEAVFGSPSSVRPTRIMVTMDEAWVDEPGLIERLLLYGMDIARINCAYGSPETWEALVAIIRQAEKQLEQQLQGRRCRIYMDLPGPKIRVDRLAVNAGPMKLSVKKNLYGEPMEPLFGLISFSSSPPPSPLPRDVSFLWQLTAEDGATVEEGDELLFTDVRGKKRKLRVTEQIAPSCFKVLLSRTAYVQKGMKLRRGSASFTLCSVLFIPMKAFVTVGTPLYIYFDDAAFAQAQNGCGVKMTTTLAKAWRNVRAGDRLYLNDGQIAARVVKVHERHVEAKVVADGGKRKAIKQGTGIHLPDSFLHLTVPPLTDRDLEWIPFIARWADIVGLSFVQAPHDLRKLYHLLAEQGAGSLPVIAKIETRAALHNFVRILLEGLKFPAFGVMIARGDLALEIGFEHLAAAQNDVLALCRAAHIPVIWATQVLEQMAKKGIPSRAEISDVFVGKQAQCIMLNKGRHIAEAVRLLSSLLEKEERQSGSLAMPKTDGERMNLLNLWEDEG

SEQ ID NO: 2294 - protein, 769 aa, Oryza sativa Japonica Group
MENGRLYPERPRTFSTVRTKSSLPPIFRVLMRINPRAFIVLLLLVFSGVLYVGASTSPIVLFVFCICTLSLFFSLYLTKWVLAKDEGPPEMSEIYAVFFIGCLLDVQISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLASLFCLSCNIIDKNAKLSSDNSYPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALFLNTAGGAWDNAKKYIETGALGGKGSESHKAAVTGDTGKQVRKYGFRK

SEQ ID NO: 2295 - protein, 193 aa, Zea mays
MGSASNPLVTSSVVDDSPLPSNLNQDDLKKLAAYKAVEYVKSGMVVGLGTGSTAKHAVARISELLRQGKLRDIIGIPTSTTTHEQAVSLGIPLSDLDSHPVVDLSIDGADEVDPALNLVKGRGGSLLREKMVEGASKKFVVIVDESKLVKHLGGSGLAVPVEVVPFCCDFTRGKLEELFREAGCKAKLRVKSG

SEQ ID NO: 2296 - protein, 151 aa, Burkholderia sp. 383
MRVSDILKVKGNTLFTVTPDKPLREAVDTMAEHDIGSLVVMEYGDLVGMLTFREIILRLHVNGGAIGDVQVRKVMDEPLTCTPETDVNEVRRMMLERHARYMPVLDKKVLMGVISFYDVAKTVVEAQSFENRMLKAYIRDWPESEAEAHKP

SEQ ID NO: 2297 - protein, 336 aa, Chlamydomonas reinhardtii
MAGRATTVGVIGGGSWGTALAIHCARRGHDTVVWARGAATVEAINSRHENTEYLKGHPCPPSLRASNDLAEVITRSELLLMVVPTQYIIHTLGEAAKLLQPHQILVSCSKGISLDSLETVAELLEERVVPPEFRPRLAYLSGPSFAAEVAAGLPTAVTVAAKDEELAARVQALLSTPRFRCYRSTDVVGVELGGALKNVLAIACGISDGMGFGNNSRAALITRGLYEITKLAVARGAHPLTMSGLAGMGDLVLTCTGACVRNRTVGLRLGRGERLEDIQASMGGAVAEGVPTAVAIRRLASKMGVEVPIMEGIHAVIHLGANAQKVVTDVMSRELK

SEQ ID NO: 2298 - protein, 357 aa, Oryza sativa
MDKMTPAADGDDDETTCIRALELIFTFVVPMTLKATIKLGLLDALTGGGHALTADELAAAAQLPAEAASSVDRMLRLLASLDVVKCAPTDTGGEAAVRRYTPAPVCRWFAGERSLAPLAMFLLDDDYLSTWNQLPAAVAGGDGQVAFEKARGMPMFEYMGTNRRLNTLFNQAMVQQSTVVIGKLLERFQGFDGVSVLVDVGGGTGATLEMITSRYKNITGVNFDLPHVIAQAPSLPGVKHIAGNMFESVPNGDAIFLKSMLHLHNDEDCIKILKKCHQALTHNGKVIAVEILLPAIPEPVPTAQNPFRMDMIMLNNHWGGKERTEPEFAKLAVECGYTGVFQATYIFANYWALEFSK

SEQ ID NO: 2299 - protein, 419 aa, Glycine max
  misc_feature (133)..(133): Xaa can be any naturally occurring amino acid
MVGSGTTTTTDRSKEAVGMMALHEALRSVCLNSDWTYSVFWTIRPRPRVRGGNGCKVGDDNGSLMLMWEDGFCRGRVSDCLEEIDGEDPIRKSFSKMSIQLYNYGEGLMGKVTSDKCHKWVFKEPTECEPNIXNYWQGSFDALPPEWIDQFESGIQTIAVIQAGHGLLQLGSCKIIPEDLHFVLRMRHTFESLGYQSGFYLSQLFSSTRSTSSSTSIPSKPSTIPIRPPPPLLNWGQRPLESSASMLSSPSFQHAAARMGFPQAKDETRMFLMPNASSEQLARMGDIMGEHENDIKWPNGLSIFNALTGRSDDAKLLFNQDSLGAKPSSDHNHRHTLNPNPNAGSVANPNEFLSLDGHTEGRGGARKVDKFKRCFTLPARIMTSSSSSTSMDHHQQQAGVEYRNSEGSMYQDVMETFLE

SEQ ID NO: 2300 - protein, 252 aa, Triticum aestivum
  misc_feature (200)..(200): Xaa can be any naturally occurring amino acid
MADKENAAPAAAAGPRLTRAAAKRAATCSAGPSGGAKRKRVALSELPIVSNAGIVLRQPSKPAKPAAAAEGEEQHGGLSRCASTSPTPVGEEVSGGGGITQLSGSYASDIYTYLRTMEVEAPRRPAADYIEAVQTDVTAIMRAILIDWLVEVAEEYKLVADTLYLTVSYVDRFLSANPLGRNKLQLLGVAAMLIASKYEXEISPPHVEDFCYITDNTYTRQELLTMESDILKLLNFEIGSPTHQTFPQRFTR

SEQ ID NO: 2301 - protein, 235 aa, Aspergillus nidulans FGSC A4
MDDEYNYSADDAERETIRVWRTWRTVFEMLQDRGYEVTEEEVKIDLDEFKRKYVGEKGYPSREKLKIQARPTEAMKAKYTPLPTPSNRDPQPDCGTIYIEFCPDDSGIGTKQVRTFNHTVDEGNFHTGIFITKTPISPSAVRLLSGIPGRICEHFQEQDLLVNITRHELVPKHVLLSPEEKSKLLQRYRLKESQLPRIQVSDPVARYLGLRRGQVVKIIRKSETAGRYASYRWVI

SEQ ID NO: 2302 - protein, 332 aa, Sulfolobus solfataricus
MSSDDLSLYFNEIVNNVNFRIKNFVKSNFKTLEEASFHLFTAGGKRLRPLVLVSSSDLIGGDRERAYKAAAAVEILHNFTLVHDDIMDNDGLRRGLPTVHVKWGEPMAILAGDYLHAKAFESLNESLKGLDGNTFYKAFSIFITSIEIISEGQAMDMSFENRLDVTEEEYIQMIKGKTAMLFSCSAALGGIINKANDDVVKKLTEYGLNLGISFQIVDDILGIIGDEKELGKPIYSDIREGKKTILVIKTLSEATEDEKKILVSTLGNKEAKKEDLERASEIIRKHSLQYAYDLAKKYSDLAIENLREIPVSNKTAEKALKYLAQFTIQRRK

SEQ ID NO: 2303 - protein, 545 aa, Staphylococcus aureus subsp. aureus MW2
MNKDKQLHNDKINLSQLVLLGLGSLIGSGWLFGAWEASSIAGPAAIISWVLGFLVIGTIAYNYIEIGTMFPQSGGMSNYAQYTHGSLLGFIAAWANWVSLVTIIPIEAVSAVQYMSSWPWHWAKPMRYLMENGSISTYGLLAVYLIIVIFSLLNYWSVKLLTSFTSLISVFKLGVPMLTIIMLMLSGFDTSNYGHSASTFMPYGSAPIFAATTASGIIFSFNSFQTIINMGSEIKNPEKNIARGIAISLSISAVLYIILQSTFITSMPQSMLQHSGWNGINFNSPFADLAILLGINWLAILLYIEAFVSPFGTGVSFVAVTGRVLRAMEKNGHIPKFLGKMNEKYHIPRVAIIFNAIISMIMVTLFRDWGTLAAVISTATLVAYLTGPTTVIALRKMGPTMTRPFRAKILKVMAPLSFVLASLAIYWAMWPTTAEVILIIILGLPIYFFYEYRMNWRNTKKQIGGSLWIIVYLIVLSILSFIGSKEFKGLNMIHYPFDFIVIIVVALIFYYIGTTSSFESVYFRRATRINTKMRESLNNESKSSH

SEQ ID NO: 2304 - protein, 348 aa, Chlamydomonas reinhardtii
MARYSVAMVGSGAWACAAVRMIAQNTQVVSQSFVDEVRMWVYEEDFEVRPWGGKKLTEVINQTHTNPKYFPGFDLGPNVVAVPNIVDAVADADLIVFCAPHQFLHHICKQLVGKIKPGAAAISLTKGMRVRPEGPQLISQMVRRLLGIDCCVLMGANIATDIGREQLSEAVIGYDNLDAATLFQKIFQRPYFRVNLLPDPVGAEMCGTLKNIVALGAGMVDGLGLGPNSKAAIIRQGLVEMRAFSKALYPSVRDDTFMESCGVGDLVATCYGGRNRLVACEWTKAQMPRTFEDLETDLLKGQKLQGVLTSNEVQEILKVRGWESQYPLFTTVNRIINGYLPPKYVVEF

SEQ ID NO: 2305 - protein, 259 aa, Marinobacter sp. ELB17
MQGIPADAAISENGAGQFEINMHHVADPLRAADDAVLFKRLVRGIARKHGLAATFMAKPYGDLSGSGFHTHFSLIDENGINVFDNGGDEGTPLLLNAVAGLLATMQQNTLTFAPHENSYRRLLPGAHAPTSVSWGYENRTAAIRIPGGDPIARRIEHRVAGADANPYLVLASILGGALLGIENEMQPAAPITGNAYSMNLDNLPLDWATAIDAFRKGADVPTIFSKRLQTMLVECKMQELRKFARYVTKFEYDSYLEIV

SEQ ID NO: 2306 - protein, 647 aa, Zea mays
  misc_feature (620)..(620): Xaa can be any naturally occurring amino acid
  misc_feature (622)..(622): Xaa can be any naturally occurring amino acid
MGGSADANGAGSVRVPVPPARPFLDTFRGNLKETFFPDDPFRGVVRERGAGRRTVAALRYFFPFLEWAPAYALSTFKSDLIAGITIASLAIPQGISYAKLANLPPVLGLYSSFVPPLVYALMGSSKDLAVGTVAVASLLISSMLGSEVSPTENPVLYLHLAFTATFFAGVFQASLGLLRLGFIVDLLSHATIVGFMAGAATVVCLQQLKGMLGLVHFTTSTDVVSVMESVFSQTHQWRWESVLLGCGFLFFLLVTRFISKRRPKLFWISAAAPLTSVVLGSVLVYLTHAENHGIEVIGYLKKGLNPPSVTSLQFSPPYMMLALKTGIITGVIALAEGIAVGRSFAMFKNYHIDGNKEMIAIGTMNVLGSLTSCYLTTGPFSRSAVNYNAGCRTAMSNVVMSLAVMVTLLFLTPLFHYTPLVVLSAIIVSAMLGLVDFGAALHLWRVDKVDFCVCAGAYLGVVFGSVEVGLVVAVAVSLLRVLLFVARPRTTVLGNIPGTMVYRRMDQYAAAQTVPGVLVLRVDAPVYFANASYLRERISRWIDDEEERTKSQGEMGVRYVVLDMGAIGSIDTSGTSMLDELNKSLDRRGMQIVLANPGSEIMKKLDSSKVLEQIGHEWVXRXGGEGGGRLPAGLRPLGIGGHRRRPL

SEQ ID NO: 2307 - protein, 467 aa, Mycobacterium sp. MCS
MDTTHSESSDYLAKRTLKQGTAGWLLLAGLGVGYVISGDYSGWNFGLAEGGFGGLLIAGVIIAGMYLAMVLGMAEMSSALPAAGGGYTFARRALGPWGGFATGTAILIEYAIAPAAIATFIGAYVESLGLFGITDGWWVYLAVYLLFIGIHLSGVGEALKVMFVITAIALAGLIVFAIGAVGRFDAANLTDIAPTDAAGASSFLPFGYLGIWAAVPFAIWFFLAIEGVPLAAEEAKDPSRNVPRGILAAMGVLLVTGSTVLVLAAGSGGAELISASGNPLVEALGDTTTSKVVNYIGLAGLVASFFSIIYAYSRQLFALSRAGYLPRRLSVVNSRKAPTLALVVPGIIGFILSLTGQGAMLLNMAVFGAALSYVLMMVSHIALRVREPDMPRPYRTPGGVVTTGFALVIAALAVVATFLVDSTAATWCLVVFAAFMAYFGLYSRHHLVANSPDEEFAALADAEKDIL

SEQ ID NO: 2308 - protein, 445 aa, Arabidopsis thaliana
MATRANVPEQVRGAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPKMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMLAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 2309 - protein, 192 aa, Chlamydomonas reinhardtii
MSFYRGTASHPWHDLHPGNDAPNFVSCVIEIPRGSKVKYELDKDTGLCFVDRILYSSVVYPHNYGFVPKTLCEDGDPLDVLVLMQEPVVPMCFLRAKPIGVMQMLDQGERDDKLIAVHADDPEYKGFTDISQLPPHRLAEIKRFFEDYKKNEHKEVVVDDFLGAEEAKKVVKDSLNMYQEHYVPRKLRNVYE

SEQ ID NO: 2310 - protein, 503 aa, Geobacillus kaustophilus HTA426
MAVQPKVLHYINGQFVEGAAGAYFDNINPFTNGTINQIAEGRKEDIDAAVRAAKEAFDHGPWRTMPVERRLRYLFRIADLIEQYADDIAYLEALDTGIPISQAKKQAARAAENFRFYAEMVKTRLVGEAYHVNGQFLNYTVYKPVGVAGLITPWNTPFMLETWKVAPALATGNTVVLKPAEWSPLTANKLAEIIDEAGLPRGVFNVVHGFGETAGAALVAHPDVRLISFTGETTTGMEIIRNSAATLKKTSMELGGKSPLIVFADADLERALDAAVWGVFSLNGERCTANSRLLLEQSIYDEFVARLKERVDRIVIGDPMAPATELGPLIHRAHWERVNRYIDIAKQEGADVYAPSVPTGLEKGNFVPPTLLLGCHNGMRVAQEEIFGPVMAVMSFADEEEAIRLANDVKYGLAAYVWTNDMKRGHRVAQAIESGMAWVNSPNVRDLRIPFGGTKYSGIGREGGHYSFDFYTEVQVVHVAVGDPPIPSFGKAKPPSALSAEQK

SEQ ID NO: 2311 - protein, 438 aa, Ustilago maydis 521
MARKSTRAANKCDEHKPVCKPARITETSASLSTTAHQSEAGGITDTSANASTARHEVLLAEQPMPQTTPASTNAELTASEAVPQAEPSTCASTGKPTMEERQARLSALRSKMSASSRANRREILDEQSRARTLSQAGASTSSRKLAKAHRLLEERDMLECGIDIERQRNLNYSVQDSEAWDLKLEQKHRKKDAGLIDFVDAAERAYQRQVNALKPHTSRSTTQKDQHAVHASSPATGTLVRNQSTPIDELQYGSHVPTDDAVDRVITHLNHEKQLIRNRSRARNNDDSDINYINDSNRHFNKKLKRFYDKQTQEIRENLERAPQHHNASGIRHQASGIRHQLSPSLPARATQPKMETPRIASLYLGSAFDRAILAVVAQKHCDTATNSSSLTRPTAEQRRFPIDSTAAYKSCEARTIELRRDTAIDSNSLTRPTAEQR

SEQ ID NO: 2312 - protein, 474 aa, Bacillus cereus ATCC 14579
MKKHLYINGSWKSVNTYKPLYAPYSEETLAEIAQGTEEDVKEAVTAAKNAMTKMNKLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPNGALNIISGPGPTVGEAIVKNDYVASITFTGSPKVGIGIKQKAGLKRVTLELGSNAAVIIDEDVELTDEIIERVKWGAFVNNGQVCISVQRVFVHETKIHEFLSKLKKAMESVVVGDPSLEETDVSALISKKDVERIDMWVQEAIKEGATVLCGGKKQDARIFEPTVLTNVPDHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 2313 - protein, 751 aa, Robiginitalea biformata HTCC2501
MKPLFREIERRFGIVPRSATPLEGYEDRTYLLESARGRWVLKEHTARPGLGTRLDLEARMMEHFREGSGFAFPNQLRSGSGETHFMFDGKSYRILEYLEGAFMAESQQDGPLLESLGRLLGEMANLSASFGPVATSPEPSAWDLQHLGLSLPYIQEIADINLQSRVAYMVQQYEAEVTPKAYRLRRGLIHNDANDWNILVRDGRVTGLIDFGDACHSWLAADLAVGLTYALMAAEDPLQAAEPILRSYCSVFPLEELEADLLYYLIGGRLCMSLCQAAHAAKIRPDSGYITISQEPAQRLLRKWIRLGPRAASRAFRRAAGLEVTASPTAEAYQKRRSGLLSPSLSLSYDTPIVMERAAFQYMFAGDGTTYLDAYNNIIQVGHCHPEVVGRTRDALRKLNTNTRYHYDSLLDYAETLLGYFPPPLSRVFLVNSGSAATDLALRLARAFTGRQRVVALEHGYHGNTAAAIAISPYKHRPGDKHPQTTICPMPKVFGSGWADDGTAGRQFSGPCLDRIRDEAEAPAAFIAEPIMGCGGQVPLPKGYLEAIYPAIRARGGLCISDEVQVGFGRLGNSFLGFQKYGVVPDLVILGKPMGNGHPLGAVVCTPEIADAFANGPEFFSSFGGNPVSCAAGKAVLDVIRHEGLQAHAAKTGNYLMEGLRSLGKLYPNLADVRGEGLFVGAELVDGEGNPATSLAARVKNALKEKRVLVGTDGPHDNVLKIKPPLPFDTGNCDELIEKLGAILAIQNNSK

SEQ ID NO: 2314 - protein, 424 aa, Saccharomyces cerevisiae
MSEATLSSKQTIEWENKYSAHNYHPLPVVFHKAKGAHVWDPEGKLYLDFLSAYSAVNQGHCHPHIIKALTEQAQTLTLSSRAFHNDVYAQFAKFVTEFFGFETVLPMNTGAEAVETALKLARRWGYMKKNIPQDKAIILGAEGNFHGRTFGAISLSTDYEDSKLHFGPFVPNVASGHSVHKIRYGHAEDFVPILESPEGKNVAAIILEPIQGEAGIVVPPADYFPKVSALCRKHNVLLIVDEIQTGIGRTGELLCYDHYKAEAKPDIVLLGKALSGGVLPVSCVLSSHDIMSCFTPGSHGSTFGGNPLASRVAIAALEVIRDEKLCQRAAQLGSSFIAQLKALQAKSNGIISEVRGMGLLTAIVIDPSKANGKTAWDLCLLMKDHGLLAKPTHDHIIRLAPPLVISEEDLQTGVETIAKCIDLL

SEQ ID NO: 2315 - protein, 436 aa, Bacillus cereus ATCC 14579
MRDYLIKPLVGQPYPMISHGKGVYLYDQNGNKYFDGSSGAITAGIGHGVKEIADVIKKQAEEIAFVYRSQFTSEPAEKLAKKLSDLSVGDLNWSFFVNSGTEANETAMKIAIQHFQERGIQGKHKILSRWMSYHGIPMGALSMSGHPLRRQRFVSILEDYPTIPAPYCFRCPVQKVYPTCQLACATELERSIERIGAEHIAAFIAEPIIGAAGGAVVPPKDYYKVIKEICDHYDILFIADEVMTGLGRTGAWFAMEHWGVEPDIMTLGKGLGAGYTPMAATVVSDRVMEPILRGSRSVMSGHTLSANPLSAATALAVIEYMEKHNLPEKTAEKGEYLIKGLQKVQQQSTIIADVRGKGLLIGVELQPFTKASELISVAAKNGLLLYQAVSGQAGKEDSALLVAPPMTTTYSELDELLSIFSKSVEEMMQKGGHSIA

SEQ ID NO: 2316 - protein, 322 aa, Gluconobacter oxydans 621H
MMTQAGSAPIAPRRIVIDTDPGQDDAVAILLALASPELTVEAITTVAGNVPVALTTKNACALLELAGRTDIPVFAGAARPLHRAPISAEHVHGETGMAGADLPEPTLRPQAIDAATWLVDLLRREPEGAITLVCLGPMTNLALALTHAPDIASRIAGVVAMGGAQREGGNITPTAEFNFFVDPHAARIVMHSGIPITLLPLDVTHRAIATPARLALIAAVGTPVTDMVVRMLGAEDRFEKLKYGWEGGALHDPLTIGFLLWPELFSGRDCNVEIEVDAPLCMGQSVVDLWNVTDRVPNALWINDVDSDAFYSLLTERLALLD

SEQ ID NO: 2317 - protein, 438 aa, Cryphonectria parasitica
MPISKIHARYVYDSRGNPTVEVDLVTETGLHRAIVPSGASTGQHEACELRDGDKSKWLGKGVLKAVENVNTVLGPELIKAGLDVKDQTAVDEFLIKLDGTANKTKLGANAILGVSLAVAKAGAAEKGVPLYAHVSDLAGTKKPYVLPVPFQNVLNGGSHAGGRLAFQEFMIVPSAAPSFSEGLRWGAETYHQLKSLAKKKYGQSAGNVGDEGGVAPDIQTAEEALELISEAIEKAGYTGKMKIAMDVASSEFYKEDVKKYDLDFKNPDSDPSNWLTYEQLAALYADLTKKYPIVSIEDPFAEDDWEAWSYFYKTQDIQLVADDLTVTNPIRIKKAIELKAANALLLKVNQIGTLTESIQAAKDSYADGWGVMVSHRSGETEDVTIADIVVGIRAGQIKTGAPARSERLAKLNQILRIEEELGSNAIYAGEDFRKSVTL

SEQ ID NO: 2318 - protein, 397 aa, Bacillus halodurans C-125
MANPNLKEEAIALHQKHSGKLEIVGKMEITDEKDLSLVYTPGVADVCKQIAEQPDKVNSLTSRGNMVAIVTDGTAVLGLGNIGPKAAMPVMEGKALLFKKFANIDGFPVCLNTQDTDEIVQIIKALSPTFAGINLEDIAAPRCFEIEERLKEELDIPVFHDDQHGTAIVVLAALTNALKVVNKLNQPIKMVINGAGAAGTAIANLLLHAGFKDITLVSLEGVVAKGEAWLNPMQAKMAEVTNLAGVKGTLKDAITDADVFIGVSGPGAMKKEHIQAMAKDPIVLALANPIPEIYPEEAIEAGAAVVGTGRSDYPNQVNNLLAFPGIFRGALDAGAKTITMEMKIAAAYAIADVLSDKEVNANMIIPDALDARVAQRVAEAVATTALQRERVAALSAN

SEQ ID NO: 2319 - protein, 123 aa, Physcomitrella patens subsp. patens
MQAVRAAVLKRMQVGVAASWVQGPAFAYGFRLFSTEAHGTYLDKHVVTDRVLNVVKKMQKVDTAKVTPNAHFQNDLGLDSLDTVEVVMAFEEEFQIEIPDADADKIFSCGDAIEYIASQPRAK

SEQ ID NO: 2320 - protein, 413 aa, Aspergillus nidulans FGSC A4
MATVLSDLATTIGTALSSLPPPDQIQDAERMQVLGAISRLQEALEPPAMAVQRMGLSKTRDEQYYHISVIRIAQGMGIFDAFAESGGAEMTVQELYSKTKGDETLLKRMPSDPPERVMRVLCAHRVYEATAAGTYRPLPLAMALATGSMPENFMKHMHTAMQVSAKLFEYFENRGYRSPEDAYDGPFQFAYGTSEHYFDWLKKHPEPQHAFNVTMTATEQDGADYWFDVYPVKETLTSPDPDRVLVVDIGGGVGHTLTALKRRFPDLSGKLILEDLPQVIDDIKEPLSDNISAIKYDMFEPQPVRGAKVYYMRRVLHDWPDKQALMALSRIREAMAEDSVLIIHDYTFPDGHDGPDVLPFAAIVDFQLMELMSSHERTQQQWVALLEKAGFSEVNIYKGKSSAHPSALFEATL

SEQ ID NO: 2321 - protein, 715 aa, Mycobacterium sp. MCS
MAENTITWEQDSDGIVTLTLDDPTGSANVMNDHYKESMHNAVERLVAEKDSITGVVITSAKKTFFAGGDLKSMINTGPDDAEAVFENVESIKADLRKLETLGKPVVAAINGAALGGGLEIALACHHRIAADVKGSVIGLPEVTLGLLPGGGGVTRTVRMFGIQKAFMEVLSQGTRFKPGKAVEIGLVDRLVQSVDELIPAAKAWIKANPEAHTQPWDVKGYKMPGGTPSSPGLASILPSFPALLKKQLKGAPMPAPRAILDAAVEGAQVDFDSASRIESRYFVSLVTGQVAKNMIQAFFLDLQTINGGGSRPDGIAKQDIKKIGVLGAGMMGAGIAYVSAKAGYDVVLKDVSLENAQKGKAYSEKIEAKALERGRTTKEKSDALLARITPAADPADLKGVDFVIEAVFENQELKHKVFQEIEDIVEPNALLGSNTSTLPITGLATGVKRQEDFIGIHFFSPVDKMPLVEIIKGEKTSDEALARVFDYTLAIGKTPIVVNDSRGFFTSRVIGTFVNEALAMLGEGVEPASIERAGSMAGYPAPPLQLSDELNLELMQKIATETRKATEAAGGTHDPHPAEAVVNKMIEIGRPSRLKGAGFYEYVDGKRTGLWPGLRETFGVGSADIPLQDMIDRMLFAEAIETQKCLDEGVLTSTADANIGSIMGIGYPPYTGGSAQYIVGYEGALGTGKEAFVARARELAERYGDRFTPPDSLTK

SEQ ID NO: 2322 - protein, 512 aa, Oryza sativa Indica Group
MEFTSSSAMWLAMAILAITAALTKIALGGGRRRCLSESSDLTCKTPPPPPVVNCIALLGLLPALFRGDVPATMQQLYAKFGSVFTVSVAGLLKATFLVGPEVSAHFFQGLESEVSHGDLFEFTVPMFGKEVGHGVDNATRIEQGRFFAEALKPARLRIHVDPMVQEVEDYFAKWGQHGTVDLKHELEQLLLLISGRCLLGKEVMGTKFDEVCNLFRDIEGGVNLMSVFFPYTPLIPSNRRRDMARERLHAIFSDIVRSRKQQQGDQVEVNDKDVLQSFIDSRYKADGRATTEAEVAGLITGVLFAAKHTSTHTSVWTGARLLTHEKFLAAAVDEQDQIVRKHGIINGRIVTDHYGFLMEMHMLHICIKETLRLHPPAPMIVRTALRQFTVRTREGHEYCVPAGHTMASPIVISNRVPYIYKDAHLYDPDRFGPRREEDKVGGKFSYTSFGGGRNSCVGENYAYMQIKAIWSHLLRNFELKLLSPFPKTDWSKLVPEPQGKVMEYPVLDLIMR

SEQ ID NO: 2323 - protein, 667 aa, Shewanella sp. MR-4
MQKPQPLNQTREQITHLDNELLSLLAERRRLSLEVARSKEVDVRPIRDTQREKELLARLVTAGREKGLDAHYVISLYQSIIEDSVLNQQAYLHGRANPETQKQQYCIAYLGARGSYSYLAASRYCQRRQVEMLDLGCQSFDEIVQAVESGHADYGFLPIENTSSGSINEVYDVLQHTSLSIVGETTIEVSHCLLGKPGSKLSDIKTVYAHPQPISQCSRYLSQHKDLRLEYCSSSAEAMEKVNQSADNSAAAIGSTEGGALYQLESIESGLANQKINQSRFIVVARKAVAVPEQLPAKTTLIMATGQKAGALVEALLVLKAHQLNMSKLESRPIPGTPWEEMFYLDIDANISSEAMQQGLKQLERITRFIKVLGCYPCETVKPTQLSNSQLLIEPNTSKAEVISTVSLDPSPYRFSKAYKAQASEIHCGPFTIGAGHIGAIAKITLSKSLLQQESSQAALSAFERRVKQLKEAGFQAVILDGCNSLASAEAIIPKLRQTLHQYDLLCVIAIEQATDMPLATGHADMLFLTGKQMFNQSLLTQAGTLPIPLFLERNDMASYDEFMAATETILSQGNQQLILCDSGIRTYNNANLPTLDLASLIQIKANSHLPIVINPCYAISEDALPLQTQGIKQLKADGLMLNCSLEEDKAHDSLALMSEVVRELYR

SEQ ID NO: 2324 - protein, 434 aa, Shewanella sp. MR-4
MTSYQILCILCALALVTSVASSRLHKLQETVAITALALGMSLLLLLGGKALGGHVYGYFVAGLEKLDFQALLLNGMLGFLLFAGALQIRLKILRHQKWEILILAFVSTLLSTFIVGGLLYYIAPMLGLPLALSHCLLFGALISPTDPIAVLAILKKMGAPEDIAIQVEGESLFNDGIGLVIFVAISHLAFSTEPLTFSQISLLFIQEALGGVVYGAVLGVLLHHFFRYCEEETQLMLVTLLIPTAGYVIAEVLGVSGPLAMVSAGMIIGNYSVPKYFARQERVKLYTFWSLIESFFNALLFLLLGLLLLLVTFKAPLWWFMLVAIPLVLTARAVSVLLPYIGFRLVKSYNPYAESILIWGGLRGGLALAMAMSLPEGVIIDSQSGAELRELVLVMTYAVVVFSILVQGSSMTGLIRRSNAVTTEANHQIATERT

SEQ ID NO: 2325 - protein, 465 aa, Oryza sativa Indica Group
MAIILAITAAITKIARGGRRRSATDPTCKMPPPPPVVNSIALLRLLPTLFRSGLPAILHELYTKFGNVFTINLAGLLKMTFLVGPEVSAHFFQGLESEISHGNLLEFTVPMFGKEIAHGVDSATRNEQARFFVDALKPARLRIRVDPMVQEIEDYFAKWGQHGTVDLRRELEQLLLLISGRCLLGKEVMGTMFDEVCNLFRDIEGGVNLMSVFFPYTPLIPSNRRRDMARKRLHAIFSDIVRSRKQREGDNVDKDVLQSLIDSSHERFLTAAVDEQDKIAREHSNINGGGRITDDRYGSLMEMRTLHSCIKETLRLHPPVPMLVRTAHKQFTVRTREGHEYAVPAGHTIASPIVISNQVPYIYMDGHLYDPDRFGPAGREEDKVGGKFSYASFGGGRTGCVGEGYAYMQIKAIWSHLLRNFELRLLSPLPKSDFTKFVPEPHGELMTQMLKVNLLWMCLCYILQT

SEQ ID NO: 2326 - protein, 1658 aa, Ustilago maydis 521
MPFDGTDGHPVDQTTTSTCTPNGSSDLAFTSSDSNNPSSLPFQRTGSPSKSSFQWPSEPLNDGRRSLPQHSQQSIEDANRDILQRITQANHDATTHPQSSPIPRLDQPRLSVQLSATLNILEDERKEQLSPTNTSLPILSPQPQNMNRSSSNGTNKSTTSDRPDAPPPTSQYPGFLPDMFRNAASMPLNLLRSLIPDNAFPASTDESLSASTLQVPVTSFNALFEACKALEWLATQASQLDLPDKATTTRRNSSTAPNQSEDNVDFSQFDYLQLLQKVADVVSGLAAAKGIDLVLDLDPQLQGPPANNQRHYKLGSCTVWADRLALTFLFMSCISRLLHNAPVQSIVIITSTLTPKDDSVLPIDLDPQMKLMILSLGLRLVLPRTRAATQDLMSSISGTPASLLLDAFGARLTTEQSTTLLSGNPLPGIPDRAVIDHSISVPVGQLAEAQQPASQEPEFESSLNKASKHIAGPDQDELVHFASTLQSNKVALYSTSQSVFARQLFTFLSGLGCDVAPVLTDSVDESSFEGSDHIFGKSTHTAVALTAGRPALVSYTSDIDQRAHPVSTSTSDKTTSATQIRQDGLPASTADTAVLDPVIGVPVTFDNSSYQSPIADQTPGSSHQVSDQAQLTPQTQVDQVGRRVVPFNFVIIDDDIATLQKELLRIRSAVPLLKSALGSKSSPNNPAATHQKMPRPTLDHRTKSSPQVNRLMASQPDLVSPRSFGSLGSALMHSESGTESLDSMDEAVSQTIIFFTSMKSYRLVRDTVQPIIDSASFRGVSSPPEIMVLPKPAGAKRILTALYVAQHKPVVRLPFLPIATSPLSPLVSHSKSWWTSDSSQQQDDHGFMTLTRRETASTDADFDTTPPTPWSPVDAFKAAEQIATPDIPLADENMPSTGEPALKGTSVRTITKETGPGAAPSTAASTTKSTSRSTASRHQNGSKPNANPADAVLTHRGSHAGPAPASTASLSASVHQARSQPVVSPMPAEALEYFSETAAKMGGSAASGMVIQSPDGRPAGIFFQPKASLSTPSLSGSKPALSRGVSASSLRRSHQVSSEHSDRSESAHRDRRMSNRSTDSTGGSIRGSGADGQQSRASNLHTLTEQAASGIAAEHGDLRVTQLPLPGANKYPTGSIFAPQVGIHSVLNSSRPPMTTPLAPSLSSPIQDSSEGGAEGQVSAAHESSQRGDGGKQADSHTDANVAVSSTGERLEKANSGVDSDSAKVDEAARSSGARPRQPVASAKNSAIASPNARTSAIGASRVAARQSLNASVTASPSDSKNKPSAVPQSGFMMGMGFTASARRGRGPKKAPVREAVLPPIKVLIVEDNPINQRILSMFMGKKKIKYDVANNGREAVEKWKTGGYHLILMDIQLPVMDGIEATKEIRKLERSANIGILPNTPPAGAESRMEVPSSSLSGGSRTLTAKGLMKHAVAGCGNVGAPEGDKRLPSKQPGPKVSSTIGGSNASCSELVSGLGIADRVSTNIRGASGSINAFRASVIIVALTASVLSSDRVEALAAGCNDFLNKPVSLPWLNQKILEWGSMMYLMYSGLSSDDIHLDKQSGGGVGGASKTDRAQLHLGFGYGPAEKAKALANNLHLGDTLAAKKKKRSEQRERIEASREKREHVVAKSAQQKGSALADDAARRVESTGKLDARI

SEQ ID NO: 2327 - protein, 342 aa, Helicobacter pylori
  misc_feature (1)..(1): Xaa can be any naturally occurring amino acid
  misc_feature (6)..(6): Xaa can be any naturally occurring amino acid
  misc_feature (18)..(18): Xaa can be any naturally occurring amino acid
  misc_feature (65)..(65): Xaa can be any naturally occurring amino acid
  misc_feature (137)..(137): Xaa can be any naturally occurring amino acid
  misc_feature (178)..(178): Xaa can be any naturally occurring amino acid
  misc_feature (236)..(236): Xaa can be any naturally occurring amino acid
  misc_feature (329)..(329): Xaa can be any naturally occurring amino acid
XSLKRXLAEFEKIQAILXAFPHEFSDWAYCIKEARESFLNIIQTIAKHAKVLVCVHTNDTIGYEXLKNLPGVEIAKVDTNDTWARDFGAISIENHGVLECLDFGFNGWGLKYPSNLDNQVNFKLKSLGFLKHPLKTXPYVLEGGSIESDGAGSILTNTQCLLEKNRNPHLNQNGIETXLKKELGAKQVLWYSYGYLKGDDTDSHTDTLARFLDKDTIVYSACEDKNDEHYTALKKXQEELKTFKKLDKTPYKLIPLEIPKAIFDENQQRLPATYVNFLLCNDALIVPTYNDPKDALILETLKQHTPLEVIGVDCNTLIKQHGSLHCVTXQLYEGGSHHHHHH

SEQ ID NO: 2328 - protein, 572 aa, Robiginitalea biformata HTCC2501
MRLTFIPPTRTVLRAFLICFLILGTAGCRKAPPEPTGLVAEKAMVVSARAEASRIGVEILQKGGNAFDAMIATEMALTVAYPFAGSLGGGGFMVYRLADGTTGSIDYREKAPLAATADMYLDSLGNPDPAKSRMGATAVGVPGAIAGIFEVHERFGTLPMDTLLAPAIELARKGVVVTENQARRLERVRADMIAVNGDSILFANHCRPGDTLRYAALAETLERIARNGRDEFYKGETARILAAFIQEAGGYITEEDLARYQAKWRDPVEFTYKDLKIISMAPPSSGGVTMNQILKMIEPYDLSGMGMHSARSIQLFTEAARRAYADRNYYLGDPDFVDIPLDTLLSEDYLRGRMASFSFDAATPSSEIAEGELAAYESMETTHYSIVDASGNSVSATVTLNGAYGSKLYCAPLGFFLNNEMDDFSAKPGVPNMFGLIGAEANSIAPEKRMLSSMTPTLVERDGKLWMSVGTPGGSTIITAVAQTILNVYEFGLSMQQSVDAPRFHHQWLPDLLVFEPEGFPESLKDSLRARGYILNEDYTPIIGKVDGIRVLPDGRLEGGADHRGDDTAVGF

SEQ ID NO: 2329 - protein, 78 aa, Bacteroides thetaiotaomicron VPI-5482
MSEIASRVKAIIVDKLGVEESEVTNEASFTNDLGADSLDTVELIMEFEKEFGISIPDDQAEKIGTVGDAVSYIEEHAK

SEQ ID NO: 2330 - protein, 1387 aa, Oryza sativa
  misc_feature (1357)..(1357): Xaa can be any naturally occurring amino acid
MRLGKQRVFIFTASTEISGVSTREHGEGYGFLYCKSHVTAEQHLQPTQDFWIAASPSKVVQADAAALGTIAADMAPVVDGFSADDDELDLDSPTEGFSSIPEAIEDIRQGKYVIVVDDEDRENEGDLIMAASKVTPEAMAFIVRHGTGIVCVSMKEDDLERLELPLMVTTKENEEKLRTAFTVSVDAKEGTTTGVSAKDRANTVLALASPNSKPEDFNRPGHIFPLKYREGGVLKRAGHTEASVDLAMLAGLPPAAVLCEIVDDDDGSMALLPKLQDFARRENLKIISIADLIRYRRKRDRLVERVCVTPLQLQWGSFQSYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANEDLGLPVDSREYGIGAQILRDLGVRTMRLMTNNPAKYTGLKGYGLSVLGRVPLLTPITNENRRYMETKRLKMGHVYGTRPSGNTSTLADGGIKKEQDQIDSASEQDTSKIYTLEKVYGFRLVCRSVVDLRSQKFHTRVYKRKSYFRSSASECEKIIHSARWLEFRRQRVAFQRTRRTIHLIPLASQDDSSGLSVNGSPQVDSASEMDDIRVKLVKALQSEDISTGLVQSIHDAARSIELAFLDHSKSSKNSWFPKEWLGVDNNEWIKPLSYQAAVGSLLQAVIDVSSRGNGRDRDINVFVQRSLSRLLSSLEGAIQNELSKREPTLYQWYSSDQNPLVVRTFVNSFENDPRFNSATAICHERQQMNTSESDLSLLMLGLTCLAAITKLGSTKVSCQQFFSMVPDIIGRFMDMLLEFVPLSKAYTLTKDIGLQREFLCNFGPRAADPKFSSDREVEISFWIDLVQKQLLRALDREKIWSRLTTSESIEVLEKDLAIFGFFIALGRSTQTYLSSNHLTNLDDSINDIVSSHLNKLTIIQVVCEELEWLPFYSGDVPAATIEGREDVHKGEIISRVLNVCSYWMTSFIKYSSWLENPSNVKAARFLSKGHSMLSDCMKELDLTKYDMPKDQTFPEAKEHLVARTELASFDKSLESVEEALVKLEDLLQELHLSSSNSGKEDLRAACSDLEMIRRLKKEAEFLEASFRAKTEFLEADASSRPLSPAVEEGRGKTASNANESSTPQKPANRVENKRRPIWDLFGRPSGRRVQLVQQTSDQNVSVANVDNKDTQSNDILRFEQLRRELIELEKRVQKSADNAQKEETYVANETLDSSVSSSPVSMPSGPASKKENVITKSVEKVKETTTTVVQGTQLLAIDTGAAMGLLRRALIGDELTHKEKQALQRTLTDLASVVPIGILMLLPIPSTYAPERLDLLRQLEXVKEMGVAEGSSEEMVEACFGTRQKMVSFRL

SEQ ID NO: 2331 - protein, 259 aa, Oryza sativa Japonica Group
MAVGRSLRTVTFLATILPSARPWCAEARYQIPDHPHPWAQKYYAPYASDPDAIRRVIQEDMPYAFVKEYPREYRPKWGHMSFLVDILRPTVEEGSSWYHFLKKASGGCSDLMYSGHMLVAVLTAMAWTEAYGGWISVVIWFLVLHSAQREIRERHHYSVDCIVAIYVGILLWRMTGFIWSAIDNSHARRLAKLDKVQNRLFQAAKDSDMDEIRGLLNEVELAGQERKGFSQRVILSFSSAMIVFTLSCVLLAFTLTSDG

SEQ ID NO: 2332 - protein, 257 aa, Saccharophagus degradans 2-40
MARLSLKNAEELSVMRESGRLLATVFDYLDGFIEVGVSTMEINDLAEKYITDKLHARPASKGQYGYQYALNSSLNRVVCHGVPSDTQKLKSGDIVNIDITLEQGGFIADSSKMYMVGDVTPAARCLVNKTYEAMWEGIRKVRPGASLGDIGHAIQSHAQKHGYSVVREYCGHGIGREMHEEPQVLHYGQAGKGLVLQEGMVFTIEPMINQGKAKVKLKKDGWTVVTSDKKLSAQWEHTIAVTSDGYEVLTLRAEECE

SEQ ID NO: 2333 - protein, 186 aa, Xylella fastidiosa Dixon
MIRKNPRGDLPDVHESAFVDPTAILCGCVIVEAGVFIGPYAVIRADETTAEGDINPIRIGIGANIQDGVVIHSKSGAAVTIGARTSIAHRAIVHGPCTIGERVFIGFNSVLFNCVVGDGCVVRHNAVIDGCDLPSGFYVPSTERIGPSTDLGTIPRVTVAASEFSEDVAQTNNRLVEGYRRLRNEL

SEQ ID NO: 2334 - protein, 519 aa, Pisum sativum
TTQSISFPSKPSTFNPFSKPHFPIHANSSPPPSPSPPTKSEPLPTILQGAKPIPFLLSISIGLIVRFFVPKPVEVTAQAWQLLSIFLSTIAGLVLSPLPVGAWAFLGLTTSVVTKTLTFTAAFSAFTNEVIWLIVISFFFARGFVKTGLGDRIATYFVKWMGKSTLGLSYGLVFSEVLIAPAMPSTTARAGGVFLPIIKSLALSAGSEPNSPTSKRLGSFLVQNQFQCAANSSALFLTAAAQNLLCVKLAEELGVIISNPWVTWFKAASLPAFVCLLATPLILYKLCPPEIKDTPEAPAMATKKLETMGPVTKNEWIMVSTMLFAVSLWILGDAIGIASAVTAMVGLSILLVSGVLDWQDCLNEKSAWDTLAWFAILVGMASQLTNLGIVGWMSDCVANSLQTFSLSWPASLAVLQSAYFFIHYLFASQTGHVGALFSAFLAMQRAAGVPGVLAALALGYNTNLFGAISHYSSGQAAVYYGAGYVDLPDIFRTGFIMAVINAIIWGGVGSVWWKFLGLY

SEQ ID NO: 2335 - protein, 499 aa, Arabidopsis thaliana
MVVEEQSLENGGSVHVVKGESNFRNVVCGPVRWLKMLSSELHWSFVFGVVSLYGINQGLGGSLGRVATEYYMKDVQKVQPSESQALTAITKIPWIIKPLWGILTDVLPIFGFHRRPYFILAGVLGVVSLLFISLHSNLHLYLALFWMTISSAAMAIADVTIDACTAYNSIKHPSLASDMQSLCSLSSSIGALLGFFMSGILVHLVGSKGVFGLLTFPFALVSVVGIVFSEPHVPGFSYKQVNQKFTDAGKAMWRTMKCSDVWRPSLYMYISLTLGLNIHEGLFYWFTDSKDGPLFAQETVGFILSIGSIGSILAATLYQLVLKDHPFRGLCLWTQLLFALSGMLDLILVFRLNLKFGLPDYLFIVVDEIVSQMIGRLKWMPLLVLTSKLCPHGIEGTFFALLMSIDNAGLMTSSWLGGIMLHVLKVTRTEFGNLWLAVLVRNVMRLLPLCFLFLVPEGDQNTFKLPDEIMGEDSDEEKDEKEGTRNLELASLVHSVDRR

SEQ ID NO: 2336 - protein, 272 aa, Staphylococcus aureus subsp. aureus MW2
MKRLENKVAVVTGASTGIGQASAIALAQEGAYVLAVDIAEAVSETVDKIKSNGDKAKAYIVDIASEQQIDNFASEIREQIGHVDVLFNNAGVDNAAGRIHEYPTDVYDKIMNVDMRGTFLMTKMMLPLMMTKGGSIVNTSSFSGQAADLYRSGYNAAKGAVINFTKSIAIEYGRDGIRANAIAPGTIETPLVDKLTGTSEDKEGKAFRENQKWMTPLGRLGKPEEVGKLVVFLASDESSFITGETIRIDGGVMAYTWPGEMLSDDSWKRTLE

SEQ ID NO: 2337 - protein, 389 aa, Mycobacterium sp. MCS
MTVSRLRPYAVTVFAEMSALAARIGAVNLGQGFPDEDGPASMLEVARQAIADGVNQYPPGLGIAPLREAIAAQRKRVHGVDYDPDTEVLVTNGATEAIAAAVLGLVEPGSEVLLVEPFYDSYSPVLAMAGCHRVAVPMVEHGRGFAIDVDGLRRAITPRTSALIVNSPHNPTGMVASDAELAAIAELAVEHDLLVITDEVYEHLVFDGYEHRPLAAYPGMSGRTVTISSAAKMFNVTGWKIGWACGAADLIAGVRAAKQYLTYVGGAPFQPAVAHALDHEDAWVAALRDSFQHKRDRLGSALAELGFAVHDSAGTYFLCADPRPLGYDDSTTFCADLPERAGVAAIPMSAFCDPHSPHIDRWNHLVRFAFCKRDDTLDEAIRRLQVLRR

SEQ ID NO: 2338 - protein, 398 aa, Shewanella sp. MR-4
MSIEIKVPVLPESVADATIATWHVKVGEQVSRDQNLVDIETDKVVLEVVAPEDGHIGEFLFQEGDTVLGEQVIAKFIAGAVSGQEVTKAEAEAAAPVAAAATEESNDALSPSVRRLLAEHNVDASKVKGTGVGGRITKEDVEAFIKSAPKAAAAPAAPAVQPLAAGRSEKRVPMTRLRKTIANRLLEAKNSTAMLTTFNEVNMKPIMDIRKQYQDIFEKRHGIRLGFMSFYVKAVTEALKRFPEVNASIDGDDIVYHNYFDVSIAVSTPRGLVTPVLRDTDTMSLADIEKAVRDLAIKGRDGKLTVADMTGGNFTVTNGGVFGSLMSTPILNLPQSAILGMHAIKDRPMAVNGQVEILPMMYLALSYDHRIVDGRESVGFLVAIKDFLEDPTRLLLDL

SEQ ID NO: 2339 - protein, 310 aa, Gluconobacter oxydans 621H
MKIVACNSNLPLARAVAHELRMPLCKTVVKRFADGEVFVEIQENVRGEDVFVVQSTCMPTNDHLMELLVMLDALRRGSAKRVTAVMPYFGYARQDRKSGPRTPISAKLVANLLTEAGANRILTMDLHAMQIQGFFDIPTDNLYAAPLFVRDLKARLPDRELIIVSPDVGGVVRARQLAQRLNVDLAIIDKRRERAGVSEVMNVIGDVAGRYCVLVDDIIDSGGSLCNAANALMSRGAEGVEAYVTHGVLTGNACQRVKDSPLNMLTLTDSIPATEALLETPNIRQITTANLLARAMSAVADESSVSSLFD

SEQ ID NO: 2340 - protein, 257 aa, Solanum tuberosum
MARKFFVGGNWKCNGTVEEVKKIVTTLSEAEVPSEDVVEVVISPPFVFLPLVKTLLRRDFSIAAQNCWVRKGGAFTGEVSAEMLVNLGIPWVILGHSERRLLLNESNDFVADKVAYALSQGLKVIACVGETLEQRESGSTMAVVAAQTKAIAEQVMHWSNVVLAYEPVWAIGTGKVATPAQAQEVHFELRKWLHVNVGAEVAASTRIIYGGSVNGANCKELAAQPDVDGFLVGGASLKPEFIDIIKSATVKTTAKSE

SEQ ID NO: 2341 - protein, 475 aa, Oryza sativa Indica Group
MVTTKLARVRRPITLNPKSKRPLPPVVNVIALLEHLPRLCTKGVIAVMHDLYTRFGSVFTVSLFGLKATFLVGPEVSAHFYQGMDSEISQGDLYEFNVPLFGKGVGFDIDNATRTEHLRFFIDAIKTSKLRNHVNSMVQEVEDYFAKWGENGIVDIKHEFEKLLMLISGHCLLGKEVRDNMFDEVFSLFHELDSGVGLGSVIFPYIPIPSHIRRDKAHAKLAKIFSKIVRSRRDSNRPAEQDVLQYLIDSKHRDGSSTTEQEVTGWIISMVFAGKHTSTNSTTWTGACLLTHDKFLTEALDEQKHMIQKHGDHIDYNVLLDMDILHCCIKEALRMHPVAPIIYRKAQKSFVVRTREGDAYDIPEGHNLLSPMIFNNRLPYIYKDPHMYDLDRFAPKREEDKVGGMFSYTSFGGGRHICIGEAYAYMQIKVIWSHLLRNFELKLESPFPKTNWSKILLEPWGKVMVSYKRRRLPTA

SEQ ID NO: 2342 - protein, 388 aa, Shewanella sp. MR-4
MNLHEYQAKSLFAEYGLPVSEGFACDTAQEAVEAAGRIGGNLWVVKCQVHAGGRGKAGGVKVTGDKEEIRAFAEHWLGKNLVTYQTDEKGQPVAKILVESCTDIANELYLGAVVDRATRRVVFMASTEGGVEIEKVAEETPELIHKAIIDPLTGPQPYQARDLGFKLGLNPTQMKQFTKIFMGLATMFVDHDFALLEINPLVITTEGNLHCLDGKIGIDGNALFRQPKIKAMHDPSQDDAREAHAAMFELNYVALDGNVGCMVNGAGLAMGTMDIVNLHGGKPANFLDVGGGATKERVAEAFKIILSDSNVKAVLVNIFGGIVRCDMIAEGIIGAVKEVGVKVPVVVRLEGTNAELGREVLAKSGLDIIAANSLTDAAEQVVKAAEGK

SEQ ID NO: 2343 - protein, 486 aa, Bacillus halodurans C-125
MNIQQLKNEWFGNVRGDVLAGIVVALALIPEAIAFSIIAGVDPMVGLYASFCIAVVIAFVGGRPGMISAATGAMALLMINLVADHGLHYLLAATILTGVLQILFGVFKLASVMKFVPRSVMIGFVNALAILIFTSQLQHFVGETWVMYALVALTLAIIYLLPKVTTAVPSTLVAIIIVTAIVIFGNIGVRTVGDLGTLTQSLPTFLIPSVPFSFETLMIIFPYSLALAIVGLLESLLTANIVDDMTDTESDKNKESRGQGIANIVTGFFGGMAGCAMIGQSVINVKSGGRGRLSALVAGVFLMFLIIVLGNVVVQIPMAALAGVMIMVSIGTFDWSSLRNLHKIPRTDATVMVVTVGTVVYTHDLSKGVLAGVVLSAIFFAAKISRVKVEEMTSATPELKRYKVQGQLFFASVSDLPAKFSYMANVNEVEIDLSEAHVWDDSAVGALDKIEMKFEQQNIKVTFTGLNTESRKLVQRMGGLSKASGH

SEQ ID NO: 2344 - protein, 368 aa, Lactobacillus paracasei
  misc_feature (332)..(332): Xaa can be any naturally occurring amino acid
  misc_feature (335)..(335): Xaa can be any naturally occurring amino acid
  misc_feature (337)..(337): Xaa can be any naturally occurring amino acid
  misc_feature (343)..(344): Xaa can be any naturally occurring amino acid
  misc_feature (352)..(352): Xaa can be any naturally occurring amino acid
  misc_feature (359)..(361): Xaa can be any naturally occurring amino acid
  misc_feature (365)..(366): Xaa can be any naturally occurring amino acid
MAFEFKLPELGEGLAEGEIVKWDVKPGDDIKEDDTLLEVQSDISVEEIPSPVSGKILKILVPEGETASVGDVLVEIDDGSGPAAAPAAPATATAAPATPAPATPGVQPAPAQSVYQFKLPELGEGLAEGEIVKWSVKPGDQIKEDDTLLEVQSDKSVEEIPSPVAGTVVKILVPEGETATVGEALVDIDAPGHNDTSVATEAGAAPQPVAATPAATPAAPAAGGVPAITDPNREILAMPSVRQYAREQGIDISQVPATGKHGRITKADVDAFKTGASAASAQPAAPAAQAQPQPATAKPAAPAAPKPQAVAPYVSSGNEAELETREKMTPTXKAXAXAMPASXXRSPHVTSXDDVEVSXXXAHRXXSS

SEQ ID NO: 2345 - protein, 613 aa, Coccidioides immitis RS
MAPITFSDPVRPGAGAARDSLELASLASSESRNQTSRSSSPSGISSSRRVSLENQDPLSDSPYDITRQRHARSYSVSSAFDFGSNLFPLSQTVGGYAPLGAPSASSLEHHVGLVDGSLEKRKTLTYLNGLSLIIGLIIGSGIFSSPGRVSTNTGSPGASLIIWAVAGVLAWTGAASYAELGGAIPLNGGAQVYLAKIFGELAGFLFAWCAVFVLKPGSAAIIAIIFGEYVVRAIVGADADMISPWINKGVALLGIVFVTFMNCISTRLGTRIGDLFMFFKFVALLGVTITGIIVACTGLSYDGKPNMDWKTTGWFEGTNKDISSWAVALYAGLWAFDGWDNTNYVTGEFKHANRDLPRVIHTAMPLVILCYILANVAYFFVLPSSTIAATNTVAVQFGGKVFGPIGALIIALVVSGSCIGALNATTFTSGRLVYAAGREGYLPSIFSKIGIGGSASPTGGRLRTRSWFHKLLIRLLGDDIGIGYTPIYAMIFNSTLCVCYVAVGEFGTLVTFYGVAGYTFYFLTVLGLIVLRIREPHLERPYKTWIATPIIFCCLLSLQPVFRYISGEYPSEMGKANWQGGGGSSGGDGGGSEGGKPPFASIYHRSNVFKQVG

SEQ ID NO: 2346 - protein, 118 aa, Brassica napus
  misc_feature (16)..(16): Xaa can be any naturally occurring amino acid
  misc_feature (21)..(21): Xaa can be any naturally occurring amino acid
  misc_feature (39)..(39): Xaa can be any naturally occurring amino acid
  misc_feature (42)..(42): Xaa can be any naturally occurring amino acid
  misc_feature (53)..(53): Xaa can be any naturally occurring amino acid
  misc_feature (56)..(56): Xaa can be any naturally occurring amino acid
  misc_feature (60)..(60): Xaa can be any naturally occurring amino acid
  misc_feature (64)..(64): Xaa can be any naturally occurring amino acid
  misc_feature (67)..(67): Xaa can be any naturally occurring amino acid
  misc_feature (82)..(82): Xaa can be any naturally occurring amino acid
  misc_feature (84)..(85): Xaa can be any naturally occurring amino acid
  misc_feature (89)..(89): Xaa can be any naturally occurring amino acid
  misc_feature (93)..(95): Xaa can be any naturally occurring amino acid
  misc_feature (97)..(97): Xaa can be any naturally occurring amino acid
  misc_feature (99)..(99): Xaa can be any naturally occurring amino acid
MASSMLSSAAVVTSPXQATMXAPFTGLKSSAAFPVTRKXNNXITSIASNGGRXSCXKVWXTSWXRRXLRPSSYLPDLTEVQXVXXKVDXLPPXXXGXPXVPVGTGFFGTSPTVYALLF

SEQ ID NO: 2347 - protein, 298 aa, Ostreococcus tauri
MRATSSVTRGTFVPRARTLGKGRGGARRTRSRVMSTRAAMTQDELKKLVGYKSVDDHVESGMVVGLGTGSTAYFAVERVGQKLASGELKNVICIPTSERTREQAESLKIPLCTLNEKSELDVAIDGADEVDPALALVKGGGGALLREKMVEVMAKKFVVIVDESKLCKGLGPGFPLPVEITPFCHMHTLRTIAKLPALAGCEAILRMGSSSNNKIDGDNIAVTDNGNYIVDLHFKSPIKDPVAAASQLKNCVGVVDHGLFVDMAYQVIVAGSDGIRVAGTDGEKPWCLLIRNNDESTS

SEQ ID NO: 2348 - protein, 421 aa, Ustilago maydis 521
MHDSRLNGKVTVTSKRFSRLRSRNRRLMGTRTRTFMIATVYTNKRPVVTTAVLVALIDAPFQRTFFRGFDFGGILFLLRFHTKMSSSLSSSSLSTSLVPATLLSRDQAIAAAEHPQHNPCVRTPPPVHSTSYILGATFASAGLGNAISAACTNPADIIKVRQQLLVDKTRANFVGITSDMIRKEGLRSLWNGVTASCLRELTYSTVRFGLYESFKDAYAKALGVADSSFTLKALSGISSGAIGSAFACPTDLVKVRMQAVRPTGQPPYRNTFVGFAHVYREGKPGIVGGIRSLYRGVGPTIIRAAVLTSSQIASYDQVKMVLKHNNVMHEGFALHFSASMVAGFVCSVTSAPFDTVKVRLMQDKSRQFKNALDCLGKLVANEGPLALYKGFGMCWARLGSHTVISLILFERFRTLFGVKPL

SEQ ID NO: 2349 - protein, 430 aa, Geobacillus kaustophilus HTA426
MSAIIDVYAREVLDSRGNPTVEVEVYTEDGGFGRALVPSGASTGEYEAVELRDGDKNRYLGKGVLKAVENVNEIIAPEIIGLEVADQVAIDRKLIELDGTENKSKLGANAILGVSLAVARAAADELGLPLYQYLGGFNAKTLPVPMMNILNGGAHADNNVDIQEFMIMPVGAESFREALRMGAEIFHSLKAVLKAKGYNTAVGDEGGFAPNLKSNEEALQTIIEAIEKAGYKPGEQVMLAMDVASSELYNKEDGKYHLEGEGVVKTSEEMVAWYEELVSKYPIISIEDGLDENDWEGHKLLTERLGKKVQLVGDDLFVTNTKKLAEGIEKGVGNSILIKVNQIGTLTETFDAIEMAKRAGYTAVVSHRSGETEDSTIADIAVATNAGQIKTGAPSRTDRVAKYNQLLRIEDELGHTAIYQGIRSFYNLKK

SEQ ID NO: 2350 - protein, 301 aa, Polaromonas sp. JS666
MSDSLNHATANTSSDLAAVISQLWVYPVKSCAGVSVQEAILTETGLEFDRAWMVVDEKGAFLTQRELPRMALIQPQLRYHDMVLRAPGMLALHVALDEVEGPVRVRVWDDEVAAYDMGPIAAQWFTDFLGTPARLVRFDPEHKRVSSRQWTGDVEALNQFSDGYSLLVLSEASLDNLNARLLASGAAAVGMARFRPNMVLGNADGGEIGPHDEDRLDLLQIATEQGSVQLKPVKPCPRCPIPNIDPATATSSPEVTDMLQTYRQDARVNGALTFGMNAIVLRGIDHLLRVGQKVSANYRFD

SEQ ID NO: 2351 - protein, 363 aa, Polaromonas sp. JS666
MSLKCGIVGLPNVGKSTLFNALTKAGIAAENYPFCTIEPNVGIVEVPDARLDALSAIVNPQKVQRAIVEFVDIAGLVAGASTGEGLGNKFLAHIRETDATINVVRCFEDDNVVHVAGKVDPISDIEVIQTELCLADLAAVEKALHRVTKTARSGDKESARLVAILEKCQAALNEAKPVRTLEFSKEEQPLLAQFFLITAKPAMFVANVAEDGFENNPFLDRLKAYAAEQKAPVVAICAKMEAEMADMEEEDKKMFLAEIGQDEPGLNRLIMAAYKLLGLQTYFTAGVKEVRAWTIHVGDTGPQAAGVIHTDFEKGYIRAQTIAYDDFIAFKGEQGAKDAGKMRSEGKDYVVKDGDVMNFLFSS

SEQ ID NO: 2352 - protein, 692 aa, Arabidopsis thaliana
MEKINTDDLLVKILSFLPTKVAVTTSILSKRGSFFGCGCQSLSMMKTATLNLPIAGGFDVLSEGHCRYIEFRFWKACLSISHCVRELFIDYYPHPYKFATLPFCVYTCKSLETLALSYAILMVVPRMACLPSLKNLLLQGVRYVDESFQLLDESHTVCFPSLKSLHLKEVISSDERYLRSLLANCPVLEELVMELDEYDTLGAVHIIVPSLKSLSLDIDCDRSSNVVEIVAPSLEYIKLNDHSDNKFLIENMPKLEEAYIDANIFEYEKFLGAFTSVKRLRASPSIARNVSAICFNQLESLKICTCKPYWSIILLRLLKGSPNLKVLELTDNKMPLCFKDPLVCWDQVTPVPECLLTSLETFKWTDLPPRQEARDMVDYITNNSPHVVFVCVKQRTVLVLKNEMEPCETLDSGEAYQISRYHNYNQHSSRSSSPWLDLRVFYVRISNFVVEDSTPEVLTINHIPLDPDTLLEINGVRMGMYSEGGSSQLRRDRVDKKSEEATYVSTDNIRLTGSVKFEVYDKNELVLSGTLEMSGSNGFTGESKNRWKMNCEAEVTAGSGFLKEKSINGQELSSPLPTIEVYVTGCFSGTPIILTKTLQLGLKKKQSRRMALDAIPEYETAEPQKDTSYALDLQATTEYGNYKEEYEGDMYWRSVRVGVGIGLGVCVGLGIGVGLLVRTYQSTTRTFRRRLL

SEQ ID NO: 2353 - protein, 309 aa, Bacillus halodurans C-125
MEKVLLFCDPGIDDSVAIMYALLHPGLDVVGIVTGYGNVTQEQATANAFYLLSLAGRSDIPVYAGAQFPLTGEIATYYPEIHGENGLGPIRPPIDLEGELLNFTDLFDLIISYPNDITIIDVGRLTSLSIAYILGEETMGRVKQVIVMGGAFFVPGNVSPVAEANFIGDPVAANLIMERARPLTVVPLNVTSYSVVTDEHIRAITDRYYNPFTPFIQPIYHYYATAYSALIPGLEGALFHDVLAVMALVHPEMFQMMKRDVSVSIAPLTRGQSVADFRPFAPEGELKIAVDFHYPTFIQSFIQVLRREL

SEQ ID NO: 2354 - protein, 232 aa, Methanosarcina barkeri str. Fusaro
MTERNISTDSPEKRAAGIAASRMVESGMVVGLGTGSTVAYTIKELGRRVRDEGLEILGVVTSYQSETLAIEAGIPLTTLAQHSELDIAIDGADQVDSKLHAIKGGGAAHTREKIVSASARRFLVVADESKTSTQLDKPIPVEVLPFAKTLVIKKIKQLGGKPEPRLALRKDGPVITDNGNFVLDANFGVINDPEGLALQLSSIPGVVEHGIFSNVDELYIGKKDGSVEIVKK

SEQ ID NO: 2355 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 2356 - protein, 259 aa, Coccidioides immitis RS
MASPMERLITSLTKGASVETIWTNITGSFSPAGIEFFGTLSVQLVTFWLPSLFFLSLDIWAPSFSNRHKLQPIPKQPTSKEIKSCVLLVLRNQIINSILHIILIFISPQRPYRIEPSLPSLPEIARDFIICLLIREALFYYSHRLLHHRIFYARIHKLHHRFTAPVALAAQYAHPIEHIVANVLPITLPPALLKSHILTFWTFLAYELSNTALVHSGYDFFSGIAKMHDLHHEKFNLNYGSIGLLDWFHGTDKLHKRTE

SEQ ID NO: 2357 - protein, 511 aa, Geobacillus kaustophilus HTA426
MSKQPVALIILDGFALRDETYGNAVAQANKPNFDRYWNEYPHTMLKACGEAVGLPEGQMGNSEVGHLNIGAGRIVYQSLTRVNIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVKGYVAFKPTNLDNTLGEVLSQHGLRQLRIAETEKYPHVTFFMSGGREEKFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 2358 - protein, 253 aa, Geobacillus kaustophilus HTA426
MRKRIIAGNWKMHKTLAEAVQFVENVKGHVPPADEVDSVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQEQIDGALVGGASLEPASFLQLVEAGRHE

SEQ ID NO: 2359 - protein, 418 aa, Salmonella enterica subsp. enterica serovar Typhi str. CT18
MTLLALGINHKTAPVSLRERVTFSPDTLDQALDSLLAQPMVQGGVVLSTCNRTELYLSVEEQDNLQEALIRWLCDYHNLNEDDLRNSLYWHQDNDAVSHLMRVASGLDSLVLGEPQILGQVKKAFADSQKGHLNASALERMFQKSFSVAKRVRTETDIGASAVSVAFAACTLARQIFESLSTVTVLLVGAGETIELVARHLREHKVQKMIIANRTRERAQALADEVGAEVISLSDIDARLQDADIIISSTASPLPIIGKGMVERALKSRRNQPMLLVDIAVPRDVEPEVGKLANAYLYSVDDLQSIISHNLAQRQAAAVEAETIVEQEASEFMAWLRAQGASETIREYRSQSEQIRDELTTKALSALQQGGDAQAILQDLAWKLTNRLIHAPTKSLQQAARDGDDERLNILRDSLGLE

SEQ ID NO: 2360 - protein, 394 aa, Geobacillus kaustophilus HTA426
MNKKTIRDVEVRGKRVFCRVDFNVPMEQGAITDDTRIRAALPTIRYLIEHGAKVILASHLGRPKGKVVEELRLDAVAKRLGELLERPVAKTNEAVGDEVKAAVDRLNEGDVLLLENVRFYPGEEKNDPELAKAFAELADLYVNDAFGAAHRAHASTEGIAHYLPAVAGFLMEKELEVLGKALSNPDRPFTAIIGGAKVKDKIGVIDNLLEKVDNLIIGGGLAYTFVKALGHDVGKSLLEEDKIELAKSFMEKAKEKGVRFYMPVDVVVADRFANDANTKVVAIDAIPSDWEALDIGPKTRELYRDVIRQSKLVVWNGPMGVFEMEAFAHGTKAIAEALAEAPDTYSVIGGGDSAAAVEKFGLADKMDHISTGGGASLEFMEGKQLPGVVALEDK

SEQ ID NO: 2361 - protein, 137 aa, Glycine max
  misc_feature (102)..(102): Xaa can be any naturally occurring amino acid
MDHDKTGCQAPPEGPILCINNCGFFGSAATMNMCSKCHKDMLLKQEQAKLAASSIGNIMNGSSSSTEKEPVVAAAAANVDIPVIPVEPKTVSVQPLFGSGPXGSGEAKLKDGPKRCSSCNKRVGLTGFNCRCGDLFC

SEQ ID NO: 2362 - protein, 335 aa, Geobacillus kaustophilus HTA426
MAVKVGINGFGRIGRNVFRAALKNPDIEVVAVNDLTDANTLAHLLKYDSVHGRLDAEVSVNGNNLVVNGKEIIVKAERDPANLAWGEIGVDIVVESTGRFTKREDAAKHLEAGAKKVIISAPAKDEDITIVMGVNQDKYDPKAHHVISNASCTTNCLAPFAKVLHEKFGIVRGMMTTVHSYTNDQQILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTASSTIDALSTMVIEGKMVKVVSWYDNETGYSHRVVDLAAYIASKGL

SEQ ID NO: 2363 - protein, 315 aa, Salmonella enterica subsp. enterica serovar Typhi str. CT18
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLTDEIKALPNVRTLTLSGMLAEAIRRISNEESISAMFEH

SEQ ID NO: 2364 - protein, 386 aa, Bacteroides thetaiotaomicron VPI-5482
MIQLSEITNSISPSLTRRLFNLAQKYDNVIDFTLGDPDIHPHDKIKEAGCKAILEGRTRYSPNAGLLELREIISSRYKLQYNIEYNPTNEIMVTVGGMEGLYLTLLAILNRGDEVIIPAPYWINYVQMVCMCSGEPIITAPVSTNDLSISIENIRKAITPKTKAIILNTPSNPSGRIISDDSIQQIAQIAIENDLIVITDEVYKTLLYDNAHFKSIVTCDKMKERTVVINSLSKEFCMTGWRLGYIAAPSELISVMTMFQENIAACAPLPSQYAAIEALRNSEKYSAGMIEEFTLRRNVLLEEVAKIKTITVDAPQGTFYAMLNIKSTGLKSEEFAYALLEKEQVAVVPGITYGDCCEDFIRIAFTLDIYKIKEGIQRLKRFVESL

SEQ ID NO: 2365 - protein, 561 aa, Salmonella enterica subsp. enterica serovar Typhi str. CT18
MNKLFSSHVMPFRALIDACWKEKYTASRFTRDVIAGITVGIIAIPLAMALAIGSGVAPQYGLYTSAVAGIVIALTGGSRFSVSGPTAAFVVILYPVSQQFGLAGLLVATLMSGFFLILFGLARLGRLIEYIPVSVTLGFTSGIGITIGTMQIKDFLGLQMAHVPEHYLQKVGALFMALPTVNIGDAAIGVVTLGTLIFWPRLGIRLPGHLPALLAGCAVMGIVNLLGGNVATIGSQFHYVLADGTQGNGIPQLLPQLMLPWSLPGSDFTLSWDSLRALLPAAFSMAMLGAIESLLCAVVLDGMTGTKHKANSELIGQGLGNMVAPFFGGITATAAIARSAANVRAGATSPVSAVIHAILVILALLVLAPLLSWLPLSAMAALLLMVAWNMSEAHKVVDLLRHAPKDDIIVMLLCMSLTVLFDMVIAISVGIVLASLLFMRRIARMTRLAPVNVDVPEDVLVLRVIGPLFFAAAEGLFTDLESRIKGKRIVVLKWDAVPVLDAGGLDAFQRFVKRLPEGCELRISNLEFQPLRTMARAGIKPIPGRLTFFPNRTEALADLLS

SEQ ID NO: 2366 - protein, 100 aa, Zea mays
MALLGTAERGLRIMKDRDADEDAGLSKKFLLVSAAGIAYLTTSRRLADRKTAKFQKNITRRGSVPETAVKKGKGNGYAAGPVVLGFFVFVVIGSCTSLGR

SEQ ID NO: 2367 - protein, 135 aa, Nostoc sp. PCC 7120
MTQSENNGQLEANDSSSHSGSRYWGNVEVIEEGESYRISRIEIKPRHGIKPQIHYHRNEHWVVVSGVAKVTCGDDEVLLGRNQSTYVPAATLHKVDNPGSIPLVILEIQNGEYLGEDDTERPYDLNLVKPGVENK

SEQ ID NO: 2368 - protein, 725 aa, Rickettsiella grylli
MQPLAPLIKDLAVILGVASLVTLLFQKIRQPVVLGYLLSGMIVGPHIPPYDLVADVPSLRTLSELGVIFLMFSLGLDFSFHKLKRVGTPAIITGIFEVVIVLLIGFLLGKFLGWPIYDCIFLGAALSISSTTIIIKAMEELGLKSKHFAELIFGVLIVEDLLAILLLAGLSIVVGTHAVISTTLADSAIKLFIVVGSWFLIGYFLIPTLIRKLVNIANQETLTIVSVALCLILVCIAAYFGYSTALGAFIMGSILAETDLIQFIEQYMRPIRDIFAAVFFISVGMLIDPSIIIQNSGVVLFISILTIVAKIFATATGALVAGQSLTTAVRSGFSMAQIGEFSFIIAGLGLTLQVTRPALFPIIIAVSAVTTFTTPYLILSSATFSQFLEKNLPPRTSAFLNHYAILIHRYLRLKKKRVMYSQYITRLLINSVMVAIIFSLSEKWIFPKINQWISNTYWVNTLSCLIAFLFASPFIWGMIFAYRAFPHRRHTAIKPIIVLGWTFTLTVLTTLAITYFHTWSIILVLLIVALALFSLLHKPLQKFYPWLEKRFLANIKTPSIHETFKDELNAWGINLKGTDIQNNYYFINKTLQELKLFQQFGIHVIALYRGPKIILSPTHHEKIRLYDKLFILGSDEQIDTFSQLLKITTYHEELELFNQLELKTFLLDKNHPFVGLSIAEALKKTHIDGIVLGMERQKARKINPNKETILHKEDLLILLVYKTSH

SEQ ID NO: 2369 - protein, 363 aa, Salmonella enterica subsp. enterica serovar Typhi str. CT18
MGFKCGIVGLPNVGKSTLFNALTKAGIEAANFPFCTIEPNTGVVPMPDPRLDQLAEIVKPQRILPTTMEFVDIAGLVKGASKGEGLGNQFLTNIRETEAIGHVVRCFENDNIIHVAGKVNPAEDIDVINTELALADLDTCERAIHRVQKKAKGGDKDAKAELAALEKCLPHLAEAGMLRSLDLTDEDKAAIRYLSFLTLKPTMYIANVNEDGFENNPYLDQVREIAAKEGSVVVPVCAAVEADIAELDDDERDEFMAELGLEEPGLNRVIRAGYRLLNLQTYFTAGVKEVRAWTIPVGATAPQAAGKIHTDFEKGFIRAQTIAFDDFITYKGEQGAKEAGKMRAEGKDYIVKDGDIMNFLFNV

SEQ ID NO: 2370 - protein, 394 aa, Pirellula sp.
MKIHEYQGKQLFRTAGVPVLDGHMVTTPDEAAAAYDKLGGKIAVVKAQIHAGGRGKGNVIDNPDQKGVVLVKSAEEAKAAAEGLLGKKLVTIQTGPEGQTVSKVFVEAGCDIARELYLGIVVDRAGSKPVLMVSTEGGVEIETVAEETPELIFKEHFDPAVGLDGFQVRKLCKKLGIEGAAAKSAYKFMTAMCRFFVDFDCEMAEINPLVITGDGEMVALDAKIIFDENAMFRHKDLEELRDLSEEEESELRAKKAGLSYVKLDGNIACLVNGAGLAMSTMDIIKYHGGEPANFLDVGGGANAAQVTEAFRILLSDPNCKGVLVNIFGGIARCTTIAGALITASKEVGFNVPLVVRLEGTEVEEGRKMLAESDVDIINAMDLTDAAKKIVAATA

SEQ ID NO: 2371 - protein, 380 aa, Candidatus Kuenenia stuttgartiensis
MKKRIAVLAGDGIGPEIMKEGLKVLDAIAKQFNHIFDYKEALVGGCAYDKYGHPLPDETKEVCNNSDAIYFGAVGGPKWENLPPELTPERGALLPLRGTYNLFANLRPAIIFGPLADAASLKSERLEGGLDILIVRELTGGIYFGRNKVKTLTLHEGALQGNYAVDYMIYSVPEIERIAAVACDAAMKRNKKLTSVDKANVLESSKLWRKVVTDYVQSHFPQIQLNHMYVDNAAMQLATNPKQFDVIVTENMFGDILSDLASAITGSIGMLPSASLAKTGFGLFEPIHGSAPDIAGLNKANPLAQILSGAMLLKYAFGLNRESKAIEEAIMKALENGYRTADLANKTTQEGKILLTSQMGDKVVEYLMVKSETNSNEKMI

SEQ ID NO: 2372 - protein, 971 aa, Arabidopsis thaliana
MADHSWDKTVEEAVNVLESRQILRSLRPICMSRQNEEEIVKSRANGGDGYEVFDGLCQWDRTSVEVSVSIPTFQKWLHDEPSNGEEIFSGDALAECRKGRFKKLLLFSGNDYLGLSSHPTISNAAANAVKEYGMGPKGSALICGYTTYHRLLESSLAQLKKKEDCLVCPTGFAANMAAMVAIGSVASLLAASGKPLKNEKVAIFSDALNHASIIDGVRLAERQGNVEVFVYRHCDMYHLNSLLSNCKMKRKVVVTDSLFSMDGDFAPMEELSQLRKKYGFLLVIDDAHGTFVCGENGGGVAEEFNCEADVDLCVGTLSKAAGCHGGFIACSKKWKQLIQSRGRSFIFSTAIPVPMAAAAYAAVVVARKEIWRRKAIWERVKEFKELSGVDISSPIISLVVGNQEKALKASRYLLKSGFHVMAIRPPTVPPNSCRLRVTLSAAHTTEDVKKLITALSSSSRPKMLDISNYVFFFFTLVTILLSCLVYILTRHSHNPKCANLPPGPKGWPVVGNLLQFARSGKQFFEYVDEMRNIYGPIFTLKMGIRTMIIISDANLAHQALIERGAQFATRPAETPTRKIFSSSDITVHSAMYGPVWRSLRRNMVQNMLCSNRLKEFGSIRKSAIDKLVEKIKSEAKENDGLVWVLRNARFAAFCILLDMCFGVKMEEESIEKMDQMMTEILTAVDPRIHDYLPILTPFYFKERKNSLELRRKLVQFVVGFIEKRRLAIRNLGSDKTASSFAYLDTLFDLRVDGRETSPSDEDLVTLCSEFLNAGTDTTGTAIEWGIAELISNPKIQSRLYDEIKSTVGDDRTVEEKDLNKMVFLQAFVKELLRRHPPTYFTLTHGVTEPTNLAGYDIPVGANVEFYLPGISEDPKIWSKPEKFDPDRFITGGEDADLTGVAGVKMMPFGIGRRICPGLGMAVVHVELMLSRMVQEFEWSSYPPESQVDFTGKLVFAVVMKNPLRARVKARV

SEQ ID NO: 2373 - protein, 388 aa, Vibrio cholerae
MNITIAGTGYVGLSNAMLLAQHHNVIALDIIQQKVDLLNDKISPIVDKEIEFFLKEKKLNFYATTDKQFAYQEADFVIIATPTDYDPETNYFNTSSVEAVIQDVMNINPAAVMVIKSTVPVGFTKSVKEKYGCENIMFSPEFLREGKALYDNLHPSRIIVGERSERAQVFANLLVEGAVKQDIPVLFTDSTEAEAVKLFSNTYLAMRVAYFNELDTYAATHGLDTRQIIEGVGLDPRIGNHYNNPSFGYGGYCLPKDTKQLRANYQDVPNSIISAIVDANTTRKDFIAQSIIAKKPQRVGVYRLIMKAGSDNFRASSVQGIMKRIKAKGIEVVVYEPVLKEESFFNSAVIRDFEQFKQMCDVIVSNRMTPELEDVAEKVYTRDLFGSD

SEQ ID NO: 2374 - protein, 297 aa, Lactobacillus paracasei
  misc_feature (2)..(2): Xaa can be any naturally occurring amino acid
  misc_feature (7)..(8): Xaa can be any naturally occurring amino acid
PXYLKLXXMQLTGSFKFRGAYNKIRHLSDAEKARGVITASAGNHAQGVALTAHLLDIDATVVMPKTAPLAKQQATSGYGAKVVLAGDTFDESRAFMEQKAKEDGLTIVDPYNDPLVIAGQGSIGLEILDQLWDVDTVIVPVGGGGLITGIATVLKHFNPYIHIVGVQSENVHGMTASLQAGKLTRQCTGPTLADGTAVAMPGDITFGLAEELVDEMVLVSEEEIAEAMKDLLQRTKTLAEGAGALPTAALEAHKIAPQWLAGKKVVALVSGGNVDLERVADNIDHFFKSDPTGHFIG

SEQ ID NO: 2375 - protein, 495 aa, Arabidopsis thaliana
MQSDNGKLFIGGISWDTNEERLKEYFSSFGEVIEAVILKDRTTGRARGFGFVVFADPAVAEIVITEKHNIDGRLVEAKKAVPRDDQNMVNRSNSSSIQGSPGGPGRTRKIFVGGLPSSVTESDFKTYFEQFGTTTDVVVMYDHNTQRPRGFGFITYDSEEAVEKVLLKTFHELNGKMVEVKRAVPKELSPGPSRSPLGAGYSYGVNRVNNLLNGYAQGFNPAAVGGYGLRMDGRFSPVGAGRSGFANYSSGYGMNVNFDQGLPTGFTGGTNYNGNVDYGRGMSPYYIGNTNRFGPAVGYEGGNGGGNSSFFSSVTRNLWGNNGGLNYNNNNTNSNSNTYMGGSSSGNNTLSGPFGNSGVNWGAPGGGNNAVSNENVKFGYGGNGESGFGLGTGGYAARNPGANKAAPSSSFSSASATNNTGYDTAGLAEFYGNGAVYSDPTWRSPTPETEGPAPFSYGIGGGVPSSDVSARSSSPGYVGSYSVNKRQPNRGEPSR

SEQ ID NO: 2376 - protein, 417 aa, Gluconobacter oxydans 621H
MKPSLKAAIEAIRAGGMVVMVDDENRENEGDLVMAAQFATPEAINFMVREARGLVCLPLEAEQVDRLGLPPMVTRNRDPRGTAFTVSIEAATGVTTGISAADRARTIVVAANPDATPDDVVSPGHIFPLRAHPEGVLGRNGHTEGSIDIARLAGLEPAGVICEIMADDGSMMRLPELRKYAAKHNMPVVSIADLQDWCREHGRGPVAGHDLICTPVPAAGEMVAESALPSIFGGHDLRIHAFRAVDGVEHVALVKGDPSKGVPLVRLHSECVTGDALGSLRCDCGAQLREALERISASESGVLVYLRGHEGRGIGLANKIRAYELQDHGMDTVEANEALGLPADAREWDAAADLLRHLGVSSLRLLTNNPDKESNLVRFGFDVKSSERLEIEANPFNRAYLATKRTRMGHFLQEQPA

SEQ ID NO: 2377 - protein, 159 aa, Gluconobacter oxydans 621H
MSKHIPVAPDLRLSPAPKMAIVVSRFNTNITGGLKNGSLEWLEERGITDVDVYDAPGAFELPLLAQRLAKSGKYEGVICLGCVIKGDTAHFEFISLGATIGIMQAQLATEVPIAFGILTTYTEQQAVDRSRKDAENKGREAAAACVESVAFLRNVPART

SEQ ID NO: 2378 - protein, 390 aa, Mycobacterium smegmatis str. MC2 155
MTVRRLQPFAVTIFAEMSALATRLGAVNLGQGFPDEDGPVEMLKVAQNAIADGINQYPPGLGVPELRQAIAAQRKRVHGVQYDPDTEVLVTVGATEAIAASVIGLVEPGSEVLVIEPFYDSYSPVIAMAGCERRAVPLVPSGRGFAIDVDALRAAVTPQTKALILNSPHNPTGAVASDAELRAVAALAVEHDLLVITDEVYEALVFDGHRHLTLASYPGMRDRTVTISSAAKMFNATGWKIGWACGAPELIAGVRAAKQYLTYVGGAPFQPAVAHALNHEDGWVADLRDSFQSKRDRLGSALAEIGFEVHDSRGTYFLCADPRPLGYDDSTAFCAELPTRAGVAAIPMSAFCDPDAPHADVWNHLVRFAFCKRDDTLDEAIRRLQALRRC

SEQ ID NO: 2379 - protein, 445 aa, Xanthomonas campestris
MRVAIFGTGYVGLVTGTCLAEVGHHVICVDIDQAKVDGLNRGVIPIYEPGLEPMVKGNHASGRLRFTTDAAEAIAHGEITFIAVGTPPDEDGSADLQYVLAVARTVGRHIDGPSVIVNKSTVPVRTADKVRAAIQEELDARGVDHEFDVVSNPEFLKEGDAVADCMRPDRIVIGAKKPAAIARMRRLYAPFNRNRDRIVEMDVRSAELTKYAANAMLATKISFMNEIANIAERVGADVEHVRNGIGSDPRIGWHFIYPVPATARASRRCAGARKTAHEYGMQPTLLNAVESVNNAQKGHLFELVQRHYADGNGSIAGKTFAVWGLAFKPNTDDMRAASSRRLMASCGKPVPRCARTTPKPRTKPSASSASATTWRSATTPSPHWKRRRAGRGHRVEAVPQPGFRQDQAGSEGRRRVRRPQPVRPAGDRSRRSAYYAIGRGRSLHA

SEQ ID NO: 2380 - protein, 288 aa, Staphylococcus aureus subsp. aureus MW2
MKKIKKAIIPAAGLGTRFLPATKAMPKEMLPILDKPTIQYIVEEAARAGIEDIIIVTGRHKRAIEDHFDSQKELEMVLKEKGKSELLEKVQYSTELANIFYVRQKEQKGLGHAISSARQFIGNEPFAVLLGDDIVESEVPAVKQLIDVYEETGHSVIGVQEVPEADTHRYGIIDPLTKNGRQYEVKKFVEKPAQGTAPSNLAIMGRYVLTPEIFDYLKTQKEGAGNEIQLTDAIERMNNDNQVYAYDFEGERYDVGEKLGFVKTTIEYALKDDSMREELTRFIKELGL

SEQ ID NO: 2381 - protein, 340 aa, Zea mays
MATSTSQHALSSIKLLSTGCLHPDKRNCRVLSVSVGRRCPSARNLGLLCASNSQSSVIEPVQLPRSPKSGVTPKKSGESALILIRHGESLWNEKNLFTGCVDVPLTPKGVDEAIEAGKRICNIPVDVIYTSSLIRAQMTAMLAMMQHRRKKVPIILHNESEQAHMWSQIYSEETKKQSIPVITAWQLNERMYGELQGLNKQETADRFGKEQVHEWRRSYDIPPPNGESLEMCAERAVAYFKDQIIPKLVDGKHVMIAAHGNSLRSIIMHLDKLTSQEIVDRPLVSQVISLELSTGIPMLYIFKEGKFIRRGSPAGPSEAGVYAYTKNLAQYRQKLDGIVQ

SEQ ID NO: 2382 - protein, 58 aa, Triticum aestivum
RQMVSDGQVAGGMIPKVECCVRALAQGVHTASIIDGRVPHSLLLEILTDEGTGTMITG

SEQ ID NO: 2383 - protein, 77 aa, Brassica napus
CRRYESFNVEGNAARNRFKRTNSDRGFGSDHEVDAHSYLPYSSATRNESQTRLMYLRSAFVVYILALQVLVFIKISF

SEQ ID NO: 2384 - protein, 469 aa, Vibrio vulnificus YJ016
MIMNSTNLKLLSLFVLGSVLWFLPVPDGLTEQAWQMMVIFVTTVLSLILAPLPLGAMALLGLTAATLLGVLPIKTALNGFAHPTIWMIAAAFFISRGFITTGFGRRVGYWFISKLGHNSLGLAYGLVLTDLLFAPATPSTTARCGGIIAPLFRSVASAYDSDPEKGTQNRIGAFLVQCIFQCNAITCAMFLTSMAGNPLAANFAKEQGVEITWAGWAAAAIVPGLLCLFLIPLAMYLFFPPELKKTPEMRAIAKEKLQQMGAMTRDEIMVCATFIGMVTLWVLGPTLGIHATVTALIGLVFLLLSRTITWDAVLSEKEAWHTITWFAVLIMMASELNKLGFIKWFSNGIGESLSGFGWATTIILLLLVYYYSHYLMASAMAHISAMYSAFLAIAISAGAPPMLAAIVLGIFSNLYMSTTHYSSGPAPILFGAGFHSLQNWWKIGFVFSLIVIPIFIFVGGMWWKVLGLW

SEQ ID NO: 2385 - protein, 314 aa, Dunaliella tertiolecta
MDAYEKLEKIGEGTYGKVYKARDINTGKLVALKKTRLEMEEEGVPSTTLREVSLLLMLSESNHVVKLIAVEHVEENGKPCLYLVFEYLSTDMKKWMDRNGRGPAHPLPKPAIKSLTYQLIKGLAHCHKHGVMHRDLKPQNLLVDDSIMCCKIADLGLGRAFSIPIKSYTHEIVTLWYRAPEVLLGSTHYSTPVDMWSVGCIFAELVRKTPLFPGDCELQQLLHIFKLLGTPNEEVWPGVSKLRDWHEFPQWHPQDLSRIFPTLEPEGVDLLKRMIEYDPAKRISAKEALKHPYFDDPMIREVDQQENPEVRARD

SEQ ID NO: 2386 - protein, 498 aa, Lactuca sativa
MRMNPTTSGSGVTTLDKKTLGRIAQIIGPVLDVAFPPGKMPNIYNALVVKGRDTAGQPINVTCEVQQLLGNNRVRAVAMSATDGLTRGMDVIDTGAPLSVPVGGATLGRIFNVLGEPVDNLGPVDTSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYDTAQEVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 2387 - protein, 744 aa, Shewanella sp. MR-4
MLNTLRDITQAVASAHSLETALEVLVSSTKAAMETQCCSVYILDQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHALVLGGEISLEQPDVRCEDIALESSRLVAAMGRCKEAIGALSQRFDREQDEEVASIFNALQLLLDDASLGGEYAREVQQGWEAESAVSRVSLRYIQQFLAMEDPYLKERASDIRDLGQKVLRQLIEPERLELEPDKPVILVTREADATLLAEFPRQKLAGIVTELGGVNSHAAILARALGVPAITGVEQLLSADIDQKLLVVNASRGQLMVSPSPAIVSEYRSLISAQKALQRQYAQELALPSVMLDGTRIRLYLNAGLLSGVASEIAEGADGIGLYRTEIPFMLQQRFPSESEQVKVYQQVLSAASARPVVMRTLDVGGDKPLPYFPIKEDNPFLGWRGIRLSLDHPELFLVQLRAMLQAGGEGKQLSILLPMVSNLDEIDQSLAYLEQAYVELKNDVNSQIEMPRIGIMLEVPALLYQLDEVAKRVDFVSVGSNDLTQYLLAVDRNNPRVSSLFDSYHPGILRALHQARLDCDYHELDISICGELAGEPMGAILLVAMGYQHLSMNQGSLARINYLLRRVSRADLTQLLSQALSLSNGFQVRELVKEYLTQQGLATILN

SEQ ID NO: 2388 - protein, 429 aa, Rickettsiella grylli
MTYHAIQIPPFGKAISVNADYSLNVPEEPIIPFIEGDGIGIDITPAMQYVVNAAIKKAYGDKRRIAWMEIYAGDKATRIYGDNQCLPDETLAAIRHYVVSIKGPLTTPVGGGIRSLNVALRQQLDLYVCLRPIRYFKGVPSPLREPDKTHMVIFRENSEDIYAGIEWQADSQEAKKMIAFLQHDMGVKKIRFPAQCGIGIKPVSKEGSQRLVKRAIQYAIDHDLPSVTLVHKGNIMKFTEGAFKEWGYAVAKEQFGAKLLNGGPWMQLKNPKTEKEIIIKDFIADAFLQQILLRPEEYSVIATLNLNGDYISDALAAQVGGIGIAPGANLSDNVAMFEATHGTAPKYAGQNKVNPGSLILSAEMMLRYLGWNEAACHIITGMEGAIQSKTVTYDFARLMNNAKEVSCSDFAQSIVDHMCHKQSLTATTF

SEQ ID NO: 2389 - protein, 389 aa, Salmonella enterica subsp. enterica serovar Typhi str. CT18
MDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTVTGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 2390 - protein, 322 aa, Candidatus Kuenenia stuttgartiensis
MDKKRRIEELDHLKIFSGNANPDLARKICEHLSINLGNAYVGRFPDGEIDLKVNEDVRGADVFLVQPTCAPVNESLTELLIFIDCLKRASAARITAVLPYYGYARKDRKDEGRVPITAKLVANLITTAGADRVLTLDLHAAQIQGFFDIPVDHLLAFPVMMKYFEQLKTEDLVVVTPDVGGIKLARNYSKGLGVKMAIVDKRRVGPEETEVGFIIGEVANKNVIMIDDLIATGGSIAQAAYVLKEKGAREIYVGATHPVFCGSAIEKLSAAPIKEIVITDSIPLSEKARATGDKFKVLSISGLLGDAIMRIHHHESVSSLFV

SEQ ID NO: 2391 - protein, 465 aa, Neisseria meningitidis FAM18
MSQGKIVQIIGAVVDVEFPRDMIPRVYDALKLDENGLTLEVQQLLGDGVVRTIAMGSSDGLKRGMTVSNTGAPITVPVGKGTLGRIVDVLGTPVDEAGPIDTDKSRAIHQAAPKFDELSSTTELLETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDENGKGRDVLFFVDNIYRYTLAGTEVSALLGRMPSAVGYQPTLAEEMGRLQERITSTQTGSITSIQAVYVPADDLTDPSPATTFAHLDATVVLSRDIASLGIYPAVDPLDSTSRQLDPMVLGQEHYDVARGVQSTLQKYKELRDIIAILGMDELSDEDKLTVMRARKIQRFLSQPFHVAEVFTGSPGKYVALRDTIAGFKAILNGEYDHLPEQAFYMVGSIEEAVEKAKTLN

SEQ ID NO: 2392 - protein, 320 aa, Nostoc sp. PCC 7120
MRVARNITELVGRTPLVQLNRIPQEEGCVAQILVKMESMNPSSSVKDRIGVSMINAAEQEGLIAPGKTVLVEPTSGNTGIALAMAAAAKGYRLILTMPETMSGERRAMLRAYGAELELTPGMEGMSGAIRRAQEIVNTTPHAYMLQQFRNPANVKIHRETTAEEIWEDTDGQVDMIVAGVGTGGTITGVAEVLKARKPSFQAIAVEPANSPVLSGGKPGPHKIQGIGAGFVPQVLKTQLIDEVITVTDEEAIAYGRRLAREEGLLSGISSGAALFAAIRVAQRPENAGRLIVLIQPSFGERYLSTPLFQDLETKATASIS

SEQ ID NO: 2393 - protein, 145 aa, Rickettsiella grylli
MTIQRTLSIIKPDAVKKNLIGKITTIFENAGLKVIAARMTLLKREHAEKFYEIHKNRPFFNELIDFICQGPVMIQVLEGPDAILKNRELMGATDPKQASPGTIRALFAENVSKNAVHGSDSIATAQQEIAFFFTPDQCFGSMTHD

SEQ ID NO: 2394 - protein, 478 aa, Oryza sativa
MSHRRVDAAACDSWRPPPTPPPPHARRALALRVGGGGGGPAFASLTVREGGGGGEEGEVGEGKGKQQQLPAAGVLVRHPLAMLALVPNAVALFAAGAAAGAVAKTITAPLDRVKLLMQTHSVRVVGESTKKGIGFLEAIAEIGKEEGLKGYWKGNLPQVAMNMLRDEGLASFYGGLGPSLIGIAPYIAVNFCVFDLMKKSVPEKYKSRPETSLATALLSATFATLMCYPLDTVRRQMQMKGSPYNTVLDAIPGIVERDGLIGLYRGFVPNALKNLPNSRRSYVFIFLVFKVLHNCGKMGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKA

SEQ ID NO: 2395 - protein, 140 aa, Arabidopsis thaliana
LDFGSKPEKSENGWKIERCCVTIASRIMGGNGVVARSVGSSLRQRAGMGLPVGKHIVPDKPLSVNDELMWDNGTAFPEPCIDRIADTVGKYEALAWLSGGLGFFVGLGLLAVLNDKASKVPFTPRVYPYDNLRVELGGEP

SEQ ID NO: 2396 - protein, 393 aa, Glycine max
TQTLPFPLSSPTSPSVTYTYSSSSSASMALTASLAHNSFLKIPTAIHSEASPLCSSFMGSPPTLSRSSTLPGNQSLSRNQFVVFARKISGLEEAMNIRRDRELQVVTKFKKRPPLRCGRVSPRLPVPDHIPRPPYVGSDILPEIASEHQVHDYEGIAKMRAAGELAARVLNFAGTMVRPSVTTNEIDKAVHQMIIDAGAYPSPLGYGGFPKSVCTSVNECMCHGIPDSRQLQNGDIINIDVTVYLDGYHGDTSKTFFCGEVGDELKNLVKVTEECLEKGIAACKDGALFRKIGKRISEHAEKYGYGVVERFVGHGVGTVFHSEPIIMHNRNEKAGRMVEGQTFTIEPILSMGSIDSITWPDNWTTLTADGSPAAQFEHTILITKTGAEILTTC

SEQ ID NO: 2397 - protein, 204 aa, Glycine max
RGRVGGRVGEHIAMVKGDIGDGHDVLVRVHSECLTGDIFGSARCDCGNQLALAMQQIEAAGRGVLVYLRGHEGRGIGLGHKLRAYNLQDDGRDTVEANEELGLPVDSREYGIGAQMLRDLGVRSMKLMTNNPAKYIGLKGYGLTVSGRIPLLTLITSENKRYLETKRVKMGHIYGTEFNGRLSTHDSGNGNATRIEDSNAVTGL

SEQ ID NO: 2398 - protein, 344 aa, Sulfolobus tokodaii str. 7
MEAVILHGGQGTRLRPLTHTGPKQLIKVAGKPVSQWVLEQIRDSGIRDVVIVLGDNTPKRVVDYYGDGSKFGVNITYVYQGKARGLADAVYKVKDVVSKKFLVYLGDNLVPYDLRKFMSFKGSASILLAKVDNPNRFGVAVIKENKVVKLVEKPKEPISDLALVGVYAFTDEIFEVIESLRPSWRGELEITDAIQGLIDEGKEVNYEIVQGWWKDTGTPRDILEANSFLLDRYTERRIEGDVDNSTIDGRVIVEKGTVIKNSVIRGPVYIGRDSKIVNSYVGPFTSIGDSSQVVDSEVEYSVILDNVRIKGVSLMDSLIGNNSVVEKGNRWQRLIIGENSSVIL

SEQ ID NO: 2399 - protein, 120 aa, Zea mays
MMASTASATAAAVAFGAAAKPRGPAAAALRARGPAGGRRRSGVVVRCDAGVEVQAQAVAKASSIAALEQFKISADRYMKERSSVAVIGLSVHTAPVEMREKLAAAEELWARAIQELTTLN

SEQ ID NO: 2400 - protein, 280 aa, Oryza sativa
  misc_feature (266)..(266): Xaa can be any naturally occurring amino acid
MLTLHGTALFIRPSAYQEVKSSPKHAIVPHNNLLGCSAFYNPVEGHHVQKPHIVPSCKVNFTRASHYLYRSLSERTTRHWLHRFHVNASSDEDFRSSRNIAISLFKRYKNVIDRGGGDNLKEFVSAGVNAYALGCTEEGLRKELMDIEDSGLEIEALRSNGGGTSLTFKVHSFEVRECILWLSIVFITILCTPQPTIIRWSTTPPVSADVLHQWKGFCALIANAYYTKGMAWLPVKTLQLEQMAVTGSSEEPSVVASRMQLVFSTXLEVVSPSWAKSVMN

SEQ ID NO: 2401 - protein, 405 aa, Triticum aestivum
  misc_feature (320)..(320): Xaa can be any naturally occurring amino acid
NKFVQKSRLVPVRNSRDIVDPRVRLFTPKEGHGYSEDEDHLALMMEVLGKMPRKIATMGTKSKEYFDRHGDLKRIRRLKFSSIERVLVDKYKIPQSDAREFAEFLCPLLDFAPEKRPTAAHCLKNKWLQRDDGKNVTNIASKSIDVTCNFGSMPDSCAQRIDAKGNTKSSINSNTENADVVRPTERISNSNAKSTCVNPNTGTIMYKDGNNSDVKPHSGSIITNKNAKSSDEKPFTGSISNKDDKTVDTKPITWSSTSTDDKSVDTKSSIGSVTNRDAKSIEGKRNIRSVVNSYMKNFDAKRNTGSIANSEVKDLDVKPXSGDIVSVDTNSTSAKPNTGSVENSDVTGTSVMANTGPANSGAKLQTNTDSVDQDDTDSKPNVGRVAASIQRLESSMSKVQIGRYR

SEQ ID NO: 2402 - protein, 577 aa, Salmonella enterica subsp. enterica serovar Typhi str. CT18
MDAATIISLFILGSILVTSSILLSSFSSRLGIPILVIFLAIGMLAGVDGIGGIPFDNYPFAYMVSNLALAIILLDGGMRTQASSFRVALGPALSLATLGVLITSGLTGMMAAWLFHLDLIEGLLIGAIVGSTDAAAVFSLLGGKGLNERVGSTLEIESGSNDPMAVFLTITLIEMIQKHETGLDWMFAVHIIQQFGLGIVFGLGGGYLLQQMINRISLPSGLYPMLALSGGILIFALTTALEGSGILAVYLCGFLLGNRPIRNRYGILQNFDGLAWLAQIAMFLVLGLLVTPSDLWPIAVPALILSIWMIFFARPLSVFTGLLPFRGFNLRERIFISWVGLRGAVPIILAVFPMMAGLENARLFFNVAFFVVLVSLLLQGTSLSWAAKRAKVVVPPVGWPVSRVGLDIHPDNPWEQFIYQLSADKWCVGAALRDLHMPNETRIAALFRNNELFHPTGSTRLQEGDVLCVIGRERDLPALGKLFSQSPPVSLDQRFFGDFILEANAKFADVALIYGLEEGTEYRDKQQTLGEIIQQLLGAAPVVGDQVEFGGMIWTVAEKEDNVVRKIGVRVAEDEAE

SEQ ID NO: 2403 - protein, 146 aa, Clostridium difficile 630
MQYSDKVMEHFMNPRNMGEIDNASGVGEVGNPTCGDIMKIFLDIDGDVIKDVKFKTFGCGSAIASSSMATEMIKGKTIKDALELTNKAVAEALDGLPPVKMHCSVLAEQAVKAALIDYAQKNNIHIPELDGYVIDDAHDHDVEEEE

SEQ ID NO: 2404 - protein, 868 aa, Oryza sativa
MMVTWPWRALPLAAVLFLFLSPAASVDTVTMEAPLAGNRTIVSAGGTFTLGFFTPDVAPAGRRYLGIWYSNILARTVVWVANRQSPVVGGSPTLKINGNGSLAIVDGQGRVVWASPVMSASVLSAGSAKAQLLDNGNFVLRFASAGVAWQSFDYPTDTLLPGMKLGIDFRTGLDRYMNSWRAADDPSPGEYSFRIDPSGSPEFFLYRWSTRTYGSGPWNGYQFSGVPNLRTNTLLSYQYVSTADEAYYRYEVDDSTTILTRFVMNSSGQIQRLMWIDTTRSWSVFSSYPMDECEAYRACGAYGVCNVEQSPMCGCAEGFEPRYPKAWALRDGSGGCIRRTALNCTGGDGFAVTRNMKLPESANATVDMALGLEECRLSCLSNCACRAYASANVTSADAKGCFMWTADLLDMRQFDNGGQDLFVRLAASDLRTNSVSDNSQTAKLVEIIVPSVVALLLLLAGLVICVIKAKKNRKAIPSALNNGQVTPFGQRNHTASALNNWEITPFWQRNHVAASNDAQDNNSMRPAGQGNHQDLDLPSFVIETILYATNNFSADNKLGQGGFGPVYMGRLDNGQDIAVKRLSRRSTQGLREFKNEVKLIAKLQHRNLVRLLGCCIDGSERMLIYEYMHNRSLNTFLFNEEKQSILNWSKRFNIINGIARGILYLHQDSALRIIHRDLKASNILLDRDMNPKISDFGVARIFGTDQTSAYTKKVVGTYGYMSPEYAMDGVFSMKSDVFSFGVLVLEIVSGKKNRGFYHNELDLNLLRYAWRLWKEGRSLEFLDQSIAGTSSNVTEVLRCIQIGLLCVQEQPRHRPTMSAVTMMLSSESPALLEPCEPAFCTGRSLSDDTEASRSNSARSWTVTVVEGR

SEQ ID NO: 2405 - protein, 374 aa, Oryza sativa Japonica Group
MDHHQRWHPTGGRLGGGAARDTRVMGYATAQLVQPYKDRPNQGTLAIFTEFSPIADPAFEPGRPGESAIELGRVVDRGLRESRAVDMESLCVVAGKHVWSVRVDLHILDNGGELNVPDAMVLSLRNLIDAANIAALAALSTFRRPECTVGGEDGQQVTVHDPEVRDPLPLTIHHLPIAVTFAYFGEGNIMVIDPTYKEEAVMGGRMTATINSNGDVCSIQKAGGEGVMSSVIMQCLRIASVKAADITSKIKNEVNSYTSAKALQKVKRLPASALKKDNAPDVAMKESSDGALETQSTKPSSDGQQINKEPPSVVEDNKQEDVEPMLSECNPEPQSESRLTAGGSDETQEAISPKSLKDAVKPKHKIKKKQHSKS

SEQ ID NO: 2406 - protein, 336 aa, Physcomitrella patens subsp. patens
MLKGCRSVDEFEKLNKIDEGTYGVVFRARDKKTGELVALKKVKMEKERSGFPMTSLREINVLLSFQHPSIVDVKEVVVGVTVDHIFMVMEYMEHDLKGLMETMKQPFSQSEVKCLMLQLFDGIKYLHDNWVLHRDLKTSNLLLNNRGELKICDFGLARQYGDPLKEYTHEVVTLWYRAPELLLGARKYSTAIDMWSLGCIMAEFLAKEPLFPGKSPIDEIDKIFKTLGTPNEKIWPDFVKLPGVRCNFTKQPYNKLREKFPATSFSGRPTLSEKGFDLLNRLLTYDPSKRITAEEALKHDWFREVPLPKAKEFMPTFPVRSTQTRYLCSNFRALGL

SEQ ID NO: 2407 - protein, 150 aa, Zea mays
RVYNVDDLKEVVEANKEDRLRKAMEAQTIITEELKRFEAWRDSLETVPTIKKLRSYADRIRASELEKCLQKIGDDVLTKKMRRAIEELSTGIVNKLLHGPLQHLRCDGSNSRTLDETLENMHALNRMFSLDTEKAIIEQKIKAKVEKTQN

SEQ ID NO: 2408 - protein, 461 aa, Burkholderia mallei ATCC 23344
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAANVLNLVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 2409 - protein, 350 aa, Arabidopsis thaliana
MKISSLGWVLVLIFISITIVSSAPAPKPPKPKPAPAPTPPKPKPTPAPTPPKPKPKPAPTPPKPKPAPAPTPPKPKPAPAPTPPKPKPKPAPTPPNPKPTPAPTPPKPKPAPAPAPTPAPKPKPAPKPAPGGEVEDETEFSYETKGNKGPAKWGTLDAEWKMCGIGKMQSPIDLRDKNVVVSNKFGLLRSQYLPSNTTIKNRGHDIMLKFKGGNKGIGVTIRGTRYQLQQLHWHSPSEHTINGKRFALEEHLVHESKDKRYAVVAFLYNLGASDPFLFSLEKQLKKITDTHASEEHIRTVSSKQVKLLRVAVHDASDSNARPLQAVNKRKVYLYKPKVKLMKKYCNISSY

SEQ ID NO: 2410 - protein, 121 aa, Anabaena variabilis ATCC 29413
MDCIHLTEIRCYGYTGYLPEEQVLGQWFEVDVKLWLDLSAAAKSDEIADTLDYRSVISLIKDLVKTSKFALIERLAGAIADSIIQQCHQVAQVQVKLTKPAAPIPDFGGKISIDLTKTRTT

SEQ ID NO: 2411 - protein, 316 aa, Anabaena variabilis ATCC 29413
MAKIIVTGAAGFIGSHLVETLLKQGEEVIGIDEVNDYYDPLLKRKNIAYLQSSPNFTFIEGDIQFLDWPSLLQDVTVVYHQAAQAGVRASWGKGFRAYTERNINATQVLLEAAKDAQQLTRFVFASTSSVYGDAETLPTHEGIPPQPVSPYGITKLAAERLCGLYHKNFGVPFVALRYFTVYGPRQRPDMAFHKFFKSVLQDEAIPVYGDGQQTRDFTFVSDAVAANLAAASVPTAVGEIFNIGGGSRVVLAEVLDTMEQIVGQPIKRNHIEKAMGDARHTAADVSKARKILGYEPQVSLREGLSLEWQWVKALYA

SEQ ID NO: 2412 - protein, 658 aa, Glycine max
  misc_feature (184)..(184): Xaa can be any naturally occurring amino acid
MPAGFAIQIPTTTFYVTMNTSRSSFLSSILTLAFFFLTTLPQSYSQKNDTHSICSQLSFSCGTLRNISYPFWGGNRPQFCGRNGFKLTCMHDQNTSVQVGSQRFNVLNINQTASTLRMARTDLVYDRCSSNFTNTSLSVSPFSFPSTVQNVTIFYECPSGINSVVGNNFTCQNDSNNKHAFYVXVNGTQLKQFPGLQKCGVSVQMQVSEGVVWDSEGGIGALEKALEKGFDVRYDAELSSQCTACRDSGGACGTNENDLAQFSCYCSGGTHGSLCSTHKSFVATGFALPLIAVIICRNKARIWKFILVQVGKIKKNDQVIEAFLESQGSVGLKRYSFSDIKKITNSFKIKLGEGGYGSVYKGKLLNGCSVAVKILNESKENGEEFINEVASISKTSHVNIVSLLGFCLDGSRKALIYEFMSNGSLEKYIHEKTAETKTTTPSLSWERLHQIAIGIARGLEYLHKGCNTRILHFDIKPHNILLDEAYRPKISDFGLAKLSTRDESIISMSNARGTVGYVAPEVFSKSFGGVSHKSDVYSYGMMLLEMVGGQKNMDVEASRSSEIYFPQLVIYKKLEQGNDLGLDGILSGEENEIAKRMTMVGLWCIQTIPSHRPTISRVIDMLEGSVDSLEMPPKPFLSSPPRSSTDFSTAISKSLASV

SEQ ID NO: 2413 - protein, 56 aa, Glycine max
MRLFDPWPVFFKREWKRNWPFLVGFAVTGTLITKLSLGLSANEEATKSKFVQAHKR

SEQ ID NO: 2414 - protein, 145 aa, Oryza sativa
MMRRRGAVESSEQLVDSFTHRSVDLVGHADAIEAARRGEVKAAPVADTLLPWSHGHRAYNLLDDGHDTVQANVELGFAVDSREYGIGAQVAKFVGLKGYGLAVVGRVPASPRLRHASPLRPPPPPSPSRRHPPPLLLAPASFADK

SEQ ID NO: 2415 - protein, 432 aa, Gluconobacter oxydans 621H
MSPTSAQAFADLALAPTLLRALDEAGYVKPTPIQAQSIPLLLEGRDLLGLAQTGTGKTASFALPLLHRLAATPRPAPKNGARVLVLAPTRELVSQIADGFESFSRHQPVRVTTIFGGVSQVHQVKALEEGVDIIVAAPGRLLDLIEQGLCDLSQLETLVLDEADQMLDMGFAKPIERIVATLPEDRHTVLFSATMPKSIAALVESLLRNPAKVEIAPPSSTVDRIAQSVMFLNASDKKAALLAQLRTPGIGQAVVFTLQKNIANDVCTFLTESGITAEALHGNRSQGQRERALNAFREGDVQVLVATDIAARGIDVDTVTHVINHDLPSLPESYVHRIGRTGRAGRSGFAITLCDAEQRAWLHAVEREIGRTLDVHDSHEWHSEEARNSTMRPPVLGGGPVKQVKPQKVRERRVWTEEEKMAARAAAAAKAS

SEQ ID NO: 2416 - protein, 129 aa, Methanosarcina barkeri str. Fusaro
MYNKKVMDHFMNPRNVGEIEDANGVGEAGNPHGDYMKIFLKIRDDRVEDAKFKTFGCAAAIASSSMATELIKGKTLKEAWELTNEDVAEALEGLPPGKLECSVLSREAIHSAINEYRRKQGLGALPEQT

SEQ ID NO: 2417 - protein, 386 aa, Salmonella enterica subsp. arizonae serovar 62:z4,z23:--
MTSENPLLALRDKISALDEELLVLLAKRRALAIEVGQAKLLSHRPVRDIDRERALLDRLIHLGKAHHLDAHYITRLFQLIIEDSVLTQQALLQQHLNNTHPHSARIAFLGPKGSYSHLAARQYAARHFEQFIESGCAKFADIFHQVETGQADYAVVPIENTSSGAINDVYDLLQHTSLSIVGEMTVTIDHCILVSGATDLNTIETVYSHPQPFQQCSKFLSRYPHWKIDYTESTSAAMEKVAQANSPRVAALGSEAGGTLHGLQVLERIAANQTQNITRFLVLARKAINVSDQVPAKTTLLIATGQQAGALVEALLVLRNHNLIMTKLESRPIHGNPWEEMFYLDIQANLESQVMQNSLKELGEITRSMKVLGCYPSENVVPVEPA

SEQ ID NO: 2418 - protein, 166 aa, Nicotiana tabacum
MASMIESAWTYLITNFSDFQLTCLGGFVLHESVFFLSGLPFLLFERAGWFGKYKIQKENNSPAAQEKCITRLLLYHFCVNLPILIGSYPVFKFMGTRSSLPLPSWKVISTQIIFYFILEDFAFYWGHRILHTKWLYKHVHSVHHEYATPFGLTSEYAHPAEILFLV

SEQ ID NO: 2419 - protein, 119 aa, Zea mays
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALA

SEQ ID NO: 2420 - protein, 313 aa, Arabidopsis thaliana
FRFCEGMDQYGIPVERKEMKHKGRNVIWSVGMDKCLIEALAVQAKNGNKVDKCFNDKAYTAACVAVNTRFNLNLTSQKAINRLKTIKKRYRVMRDILSRDGFWWNSSTKMIDCESDELWRRYIAVNPDAKAFRGKQIEMYEELRTVCGDYQTPGKYNKVKKESSHHLNDVKQFEEDSVSFPLGSSEEHSDTDGTESYAGASEYMHEESQDLPPPRDPLRRPSKRSRNSDPCQEAMLVVASSIRRLADAVVQSKTLINTEELLKAVMEIDELEEAKQMYAFEYLNGDPVKARAFMAYNNRMRKMFLFRQFWWWK

SEQ ID NO: 2421 - protein, 222 aa, Brassica napus
MSSLRPPPETLYLTINIIDRFLSLKPVPRRELQLVGVSALLIASKYEEIWPPQVNDLVYVTDNSYQSKQILVMEKTILGNLEWYLTVPTQYVFLARFIKAAVPDPEMENMVHFLAELGLMHYDALKFCPSMLAATAVYTARCFLSKTPAWTETLTFHTGYSEHELMDCSKLLAFIHSRVGESKLRAVFKKYSKAERCAVALVSSPAKSPLLSSSASCSLEKS

SEQ ID NO: 2422 - protein, 398 aa, Vigna radiata
MAVQAASLVSGYFSVAKEGKPGMSLRNTTMFGLSLEDALKADFSSLSFSCKREFQKKVCPLRVQSVATTPGVTKASPEGKKTLRKGSVIITGASSGLGLATAKALAETGKWHVIMACRDFLKAERAAKSSGISKENYTVMHLDLASLDSVRQFVDNFRQSGRPLDVLVCNAAVYLPTASEPTHTADGFELSVGTNHLGHFLLSRLLLEDLNKSDYPSKRLIIVGSITGNTNTLAGNVPPKANLGDLRGLAGGLNGLNTSAMIDGGSFDGAKAYKDSKVCNMLTMQEFHRRYHEETGITFASLYPGCIATTGLFREHIPLFRLLFPPFQKFITKGFVSEDESGKRLAQVVSDPSLTKSGVYWSWNKASASFENQLSQEASDADKARKVWEISEKLVGLA

SEQ ID NO: 2423 - protein, 409 aa, Legionella pneumophila str. Lens
MSIEVKVPVLPESVADATVAAWHKKVGDKVSRDENLVDLETDKVVLEVPSPVDGVLSDILFNTGDTVGSGDLLAKISQSVSVESQKTEKEEKPVKKEEIKISESESVSTKEDKSTSPVVRRMMAENDLKAGQIQGTGKDGRITKEDVLSYIESNREKSNQTAEVQKESSMKALSFGGREEKRVPMTRLRAKIAERLLQAQHNAAMLTTFNEVNLKAVMDMRSQYKDSFEKKHGVKLGFMSFFTKAVVESLKRFPAVNASIDGQDIVYHGFYDIGIAVSTERGLVVPVIRDADQLSMAEIELAINDAASKARTGKLSMEEMQGGTFTITNGGVFGSLLATPIINPPQTGILGMHKIEERPIVEKGQIVIRPMMYVALSYDHRLIDGKDSVQFLVSVKELLEDPSRLLLNV

SEQ ID NO: 2424 - protein, 347 aa, Pseudomonas fluorescens
MARSPETNSAMPQQIRQLLYSQLISQSIQTFCELRLPDVLQAAGQPTSIERLAEQTHTHISALSRLLKALKPFGLVKETDEGFSLTDLGASLTHDAFASAQPSALLINGEMGQAWRGMAQTIRTGESSFKMYYGISLFEYFEQHPERRAIFDRSQDMGLDLEIPEILENINLNDGENIVDVGGGSGHLLMHMLDKWPESTGILFDLPVAAKIAQQHLHKSGKAGCFEIVAGDFFKSLPDSGSVYLLSHVLHDWGDEDCKAILATCRRSMPDNALLVVVDLVIDQSESAQPNPTGAMMDLYMLSLFGIAGGKERNEDEFRTLIENSGFNVKQVKRLPSGNGIIFAYPK

SEQ ID NO: 2425 - protein, 387 aa, Legionella pneumophila str. Lens
MNLHEYQAKQLFASYGLPVPRGEVAYNVEDALLVASQLSTSRWVVKAQVHAGGRGKAGGVKLVSSKDELAAVAKSMLGTRLVTYQTDARGQPVNAILVEETCEIDKELYLGAVVDRSTRRVVIMASTEGGVEIEKVAHETPEKIFKVVVDPLVGVMPFQCRETAFKLGLKDDQIKQFTHLMMGLGKMFVDCDLSLLEINPLVITKSGQLICLDGKINIDGNALFRQPKLKNMRDVSQEDDRENRASDWELNYIPLDGTIGCMVNGAGLAMATMDVIKLHGGEPANFLDVGGGATKERVSEALKIIVSDEKVKGILVNIFGGIVRCDLIADGILAAVKEVDVKIPVVVRLEGNNAQLGAEILNKSNLNVIAATSLTDAAKKIVAAVSE

SEQ ID NO: 2426 - protein, 501 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLAFKARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 2427 - protein, 166 aa, Bacillus cereus ATCC 10987
MCTFLERYYATEVKIIEGAARPMTAEEPLFFPEIHGEHGLGPIIPPEMRICKRENFCELIKLIEPCPEDIIIVATGRLTTLATLFLLYPNVMDKICSYYIMGGAFLFPGNVTPVSEANFYGDPIAANIVMKYAKNATIYPLNVTQQALITPEMVDIINKEGTGQAK

SEQ ID NO: 2428 - protein, 449 aa, Physcomitrella patens subsp. patens
MTSSRSWPYFDPEYDTMSSIIDPPKVMIDNDSEKNATLVKVSSQNKHGTLLEVVQELMDMDLTISKAYITSDGGWFMDVFHVTDQKGLKIRDEKLIGNIQKALSLQKKKWTAEFQKCPGRSVGTQTISEHTAIELTGTDRPGLLSEVTAVLAEMSCRVNAAEVWTHNRRVACVMYVTDEDTLGPIENVRKLERILEKLNPIMQGCDDEKVARSVVAESFTHVERRLHQLMLADHDSDPSVSQSQISSRKQKNPNITVEIGSEKNYSVVKVQCLDRPKLLFDTVCTLTDLKYVVSHATIYPSGSYAVQEYHIRSMDGRTLDDPAKAKVKRCLEAAIERRSSEGLRLYLCTTDRPGLLTEVTRTFRENGLSVTRAEVSTQGDKAVNTFYVTDVNGLPVDLKKVEAIRKENPFLEVHAVPAASEGARVLDASPFSKFIKSSERLLQGLGWRV

SEQ ID NO: 2429 - protein, 339 aa, Thermotoga sp. RQ2
MKVVTFGEIMLRLSPPDHKRIFQTDSFDVTYGGAEANVAAFLAQMGLDAYFVTKLPNNPLGDAAAGHLRKFGVKTDYIARGGNRIGIYFLEIGASQRPSKVVYDRAHSAISEAKREDFDWEKILDGARWFHFSGITPPLGKELPFILEDALKVAREKGVTVSCDLNYRARLWTKEEAQKVMIPFMEYVDVLIANEEDIEKVLGISVEGLDLKTGKLNRESYAKIAEEVTRKYNFKTVGITLRESISATVNYWSVMVFENGQPHFSNRYEIHIVDRVGAGDSFAGALIYGSLMGFDSQKKAEFAAAASCLKHTIPGDFAVLSIEEIEKLASGATSGRVER

SEQ ID NO: 2430 - protein, 856 aa, Ashbya gossypii ATCC 10895
MLASTLYCFSRASLVAGSKTGRHGLVRAVYKRELFSTAAIKKLNYARTGNNEGVGSLQTRSTVIQLLNSIGSKREVEQYLKYFTSVSEQQFAVIKVGGAIISDNLPELASCLAFLYHVGLYPIVLHGTGPQVNNKLEAQGIEPSYIEGIRVTDPVTMTVVRECFLEQNLKLVTALEQMGVRARPITSGVFTADYLDKEKYQLVGNITSVCKDPIEASIKAGALPILTSFAETTAGQTLNVNADVAASSLARAFEPLKVVYLNEKGGIINGETGEKVSVINLDEEYEDLEWRQSWVKYGTKLKLQEIKELLDYLPRTSSVAIINVQDLQKELFTDSGAGTMIRRGYKLLKGSSMQQFGAERLRTALERDPEIRSGRLSVASYLKSIEETNITTYADEPMEVLAIIDNDGTIPRVDKFLCSQAGWLNNVADNVFKTLKRDFGALAWEVEERDPAISWHFSNSEGSFLRNGKVLFWYGINDLETVVSIVDSFLRRVSPTSARNSMNNAFSAKQSKRYYSIASRRAPPKLQGENTSISRVALIGARGHTGTNLISLIENHPYLELACVSSRQNAGKPLEGYTKAQIVYDNLSPDDAKKLELEGAVDVWVMALPNNVCKPFVDAIESVQRESKIVDLSADYRFVPPAVAAYGLPELNDRNEIASARKIANPGCYATCAQLSLAPLLPYMTAAPVVFGVSGYSGAGTTPSPKNDPAVLHDNLIPYSLTDHIHEREISTRLGTTVAFHPHVAQWFQGITQTISVPVKKGALTQDRVSSLYKEFYRGERLVTIADDVPLVRAIAGSHGVVIGGFKVNRSQDRVVVVGTIDNLLKGAATQCLQNINLALGYSEYEGIPTAPSNAS

SEQ ID NO: 2431 - protein, 130 aa, Bacillus cereus ATCC 10987
MSLTSLKDYTTLHNGVKMPWFGLGVFKVEDGSEVIESVKAAIKNGYRSIDTAAIYQNEEGVGQAIRESGVSREELFITSKVWNSDQGYETTLQAFETTLEKLGLEYLDLYLVHWPVKGKYTESWKALEKL

SEQ ID NO: 2432 - protein, 485 aa, Candida albicans SC5314
MFSRPLEEMSKEQDMTKEKKMDYKTNNFRKTISQHLLSFRYQQLHIMPSSTNEFAKAERELVEEQQLQEKIVNEEFKIWKKTVPLLYDFIHTFALDNPSLVFQWLPTTSVSQSDLELKFLIGTNAINKSENYLKLTSISLPSTLVGATDSIPVPSDGIDTSNFKVVTQWKQTQEINKLKVSPNGSLAVGFSADGVIRSYNLDNFDSVDYKYHKQGGIALDWVDNNGFLSGSNDAQIALWQVDKSSTPLQLFKGHHGAINDISSIKEKHLFGSVSDDSTTQFHDTRVNATDINPVITVENSHIQNCIQFHPDIQTLYATGGKDNVVSLYDIRNYSTPFRKFYGHNDSVRQLQWDWNNPDILVSCGLDKRIIFWDLKNLDEDFTYPDATSNGKDTNSKRKQAVKTDPCLKYVHGGHTRRTNDFDIHPKVKNIFGSVGDDKLLEIWKPKSLPGDEPEQESTEVQEDEEMKDAETKGVKDGEEDTKMKD

SEQ ID NO: 2433 - protein, 344 aa, Physcomitrella patens subsp. patens
MQGMDDAAWERAVEQACHGQAAFQVESLTLDGVVKCAQGKLPKSKVLASLSQLKRLSIANVGLSSLADFPSLAHLEQLVLSDNRIASGLEHLVGAGLKSLRELDLSNNKIQAVEDLKPLAELKLESLDLYECPVTRSAGYRAKVFGMMKSLRFLDKSDANGNERPESDEEEESESEEEDVDDMNGDGDGDGVEGEEEEDEEEEGVEGESKGAAVHEEDDDEGEEDEEGEDNEELEDEEEDEGGSYQEEMAMASNRGAAGPGQVGNEHGSEEEDEEDDNVEVQDIEEESEEEVGEEDDEDAVVDEEDEDDEEGMWLTRWVGSEGGLWRAVREPCTRTQTRTERDA

SEQ ID NO: 2434 - protein, 486 aa, Candida albicans SC5314
MRSYKSSITDENELTKQRLRAKSIANLSSNHTTAGQPSTSSQHREALTDLTSQENKNHPRVKLTQTNTNHHRNSSSSSNKIQIYQQIEQKKTDIHQFKKPRLEKVLLNDDDDETDDEFDDEEDKENRYHDLELNEDDSKHQLISEAFETIDDRGISEGENDTAQEARERLEEETQSHTQDMRSIYGVHVPMQPMWNNAIINELKYVIQKYSRNTLDENDEDTYDTTMVAEYSPEIFNYLHELENKFTPDPNYMDFQDDLKWEMRAVLIDWVVQVHARFNLFSETLYLTVNYIDRFLSKRRVSLSRFQLVGAVALFIAAKYEEINCPTVQEIAYMADNAYSIDEFLKAERFMIDVLEFDLGWPGPMSFLRRISKADDYDYETRTLAKYFLEITIMDSKFVASPPSWLAAGAHYISRILLGRGEWTELHVFYSGYTEKQLQPLADVLLENCRHAEINHKAIFEKYKERRYRKSSLFVQEYFRHIMSQS

SEQ ID NO: 2435 - protein, 752 aa, uncultured haloarchaeon
MAGGTPAIPIMNEVQLEVAKAYPNDSGRGIARLDPDTLLHLKLSPGDIIEIEGADTTAAKVWRADRQDWNTDTVRVDGFTRQNADVSIGERVTIRKAETTKAEKLVLAPPEEASVQFGSDAAGMVKRQILKRPVVERDIVPVMSSTNHPFMRSPGQAIPLIAVNTEPDGVCLVTEDTEVELREEPISGFEKTGGGITYEDIGGLQNEIQRVREMVELPMKHPQIFKKLGIEPPQGVLLHGPPGTGKTLLAKAVANETSASFFSIAGPEIISKYYGESEQQLREIFEDATEESPSIIFIDELDSIAPKREDVTGEVERRVVAQLLTMMDGLETRGQVIVIGATNRVDSVDPALRRPGRFDREIEIGVPDEVGRKEILQIHTRGMPLSDDVSLDYLADETHGFVGADIESLTKEAAMKALRRYLPEIDLDEEDVPPSLIDRMIVKRADFNDALSDVEPSAMREVLVELPKVSWDDVGGLEGPTQKVKESVEWPITSRGRFERMGIDAPKGVLLYGPPGTGKTLIAKAVANETNANFISVRGPQLLSKWVGESEKAIRQTFRKARQVSPTVIFFDELDSLAPSRGGGTGNNVSERVVNQLLTELDGLEENGNVMVVAATNRPDMIDPALIRSGRFDRLVLIGQPGEEGREQILKIHTRNSPLAPDVSLREIAEITDGYVGSDLESIAREAAIEALREDGDAQEIEMRHFRKAMESVRATITDDLMNYYEDMQEEFKGGTQNRLTGGRQDGRIGFQ

SEQ ID NO: 2436 - protein, 447 aa, Acinetobacter sp. ADP1
MKYSKMSDFLDYVKTRDQYQPEFLQAVEEVMISLWPFIEKHPEYADYGLLERLIEPERVIQFRVAWMDDQGHTQVNRAFRVQYNSAIGPYKGGMRFHPSVNLSILKFLGFEQTFKNALTTLPMGGGKGGSDFNPKNKSEAEIMRFCQALMLELHRHLGADTDIPAGDIGVGAREVGYMAGMMKKLSNDTAAVFTGKGVSFGGSLMRPEATGYGTVYFAEEMLKTRGQNFLGKTVSISGSGNVAQYAAEKAMFLGAKVVTLSDSNGTVYLENGFTEVLLAELMELKNKKRGRISEFASKHGFEYFEGQTPWHIPVDIALPCATQNELNGDDAETLIKNGVICVAEGANMPSTLEAVEKFLHAKILYAPGKASNAGGVATSGLEMSQNSIRLNWSHAEVDERLHAIMKDIHANCVKYGTKQDGSINYVDGANIAGFVKVADAMLAQGIY

SEQ ID NO: 2437 - protein, 137 aa, Glycine max
  misc_feature (45)..(45): Xaa can be any naturally occurring amino acid
MATTAALCGTMLNTSFLRRQASVNITSLKANANTVFGVKGGRGGXVTAMASYKVKLITPEGEQEFECPDDVCILDQAEEKGLELPYSCRAGSCSVCAGKVEQSDGNFLDDDQIVAGFVLTRVAYPTSDVVVETHWEE

SEQ ID NO: 2438 - protein, 132 aa, Triticum aestivum
  misc_feature (52)..(52): Xaa can be any naturally occurring amino acid
  misc_feature (89)..(89): Xaa can be any naturally occurring amino acid
PPRREYAPPPPPKAKPEPRLSKLESSDSFSAPLHKVEGRAIHYHIADDKGDXDDDIERRSFTFNGSNLEELTQKLQEETGIDDLIVCTXRSPISGKLTPLLLQLPPNNAAMHIVLVRESSKVAKTFPWPYGS

SEQ ID NO: 2439 - protein, 298 aa, Zea mays
  misc_feature (38)..(38): Xaa can be any naturally occurring amino acid
  misc_feature (202)..(202): Xaa can be any naturally occurring amino acid
MAEHLASIFDTEKDRVNCPFYFKIVAYRHGDHCSRLHXPTISPTLVFANMYQRPDMITPRVDAQGQPIDLEKMQEHFEDFYEDIYEELGKFGEIENLNVCDNLADHMIGNVYVQFREEEQAAAAYNALQGRFYSSRPIIVEYSPVTDFREATYKQFEENSCNRGGYCNFMHVKQIGRDLRRKLYGRSASRRYHGRSRSPKPXPQRRGHRDRDDYRGGGGGGRGRGSRYDRYDDGAGRGGRHDRYDDGAGRGGRHDRYDDGGRRRHGSPPRRARSPVRESSEERRAKIEQWNREREGKQ

SEQ ID NO: 2440 - protein, 513 aa, Mannheimia succiniciproducens MBEL55E
MEIFKILTALADFRKEGIPSCLPVTLAGKSACSYIGKNMSKEIKTQVVVLGAGPAGYSAAFRCADLGLETVLVERYSTLGGVCLNVGCIPSKALLHVAKVIEDAKHVEHHGIVFGEPTIDLDKVREGKNAVVGRLTGGLAGMAKMRKVTVVEGLAEFADSHTLVAKDREGNPTTIKFDNAIIAAGSRPVQLPFIPHEDPRVWDSTDALALREVPKNLLVMGGGIIGLEMGTVYSALGSQIDVVEMFDQVIPAADKDIVKIFTKRIEQKFNLLLETKVTTVEAKEDGIHVSMEAKDGKVETRVYDAVLVAIGRTPNGKLIGAEKAGIEVTDRGFINVDKQMRTNVPHIFAIGDIVGQPMLAHKGVHEGHVAAEVIAGKKHYFDPKVIPSIAYTEPEVAWVGKTEKECKAENLNYEVATFPWAASGRAIASDCADGMTKLIFDKDSHRILGGAIVGTNAGELLGEIGLAIEMGCDAEDIALTIHAHPTLHESVGLAAEVFEGSVTDLPNPKAKKK

SEQ ID NO: 2441 - protein, 635 aa, Mannheimia succiniciproducens MBEL55E
MPTLRRMINMSKQIQIPDIGADEVTVTEVMVKVGDTVTEEQSIINVEGDKASMEVPSPEAGVVKEILVKVGDKVTTGSPMFVLESADSAPASAPQAAAVAPAAAPTTSAVIEIHVPDIGSDEVNVTEIMVKVGDSVAEEQSIINVEGDKASMEVPAPQAGVVKEILIKEGDKVSTGSLIMKFEVAGGAPAAETPATTVQAAPAVSAVQDVNVPDIGGDEVNVTEIMVKAGDSVAEEQSLITVEGDKASMEVPAPFAGVVKEILVKSGDKVSTGSLIMRFEVAGSAPAVQAAAPAQAAPAPVAPAPQAAPAQSLAPVNQDSIATSASYAHATPVVRRLAREFGVNLDKVKGTGRKGRILKEDVQEYVKNALKALESGATASTGAASGAGLGLLPWPKVDFSKFGEVEEIELTRINKISGANLHRNWVMIPHVTHFDRADITDLEAFRKEQNVLAEKQKLGVKITPVVFIMKAAAKALEAYPRFNSSISEDGQRLTLKKYVNIGVAVDTPNGLVVPVFKDVNKKGIIELSRELMEVSKKARDGKLTASDMQGGCFTISSIGGLGTTHFAPIVNAPEVAILGVSKSEMAPVWNGKEFMPRLMLPLSLSFDHRVIDGADGARFISYINGVLSDLRRLVM

SEQ ID NO: 2442 - protein, 174 aa, Zea mays
  misc_feature (122)..(122): Xaa can be any naturally occurring amino acid
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETXYQSTTEGKKMVDVLVEQNIVPGIKVDKGLVPLVGSNNESWCQGLDGLSERAH

SEQ ID NO: 2443 - protein, 548 aa, Photorhabdus luminescens subsp. laumondii TTO1
MKNINPSQTSAWKALEQHFAQIKDIHLRELFEQDPDRFAKFSATFDDQILVDFSKNRITTETLKKLQALAKETDVAGAMRSLFSGEKINCTENRAVLHIALRNRSNTPMMVDGEDVMQQVNAVLAKMKDFSERVIHGEWKGYTGKGITDVVNIGIGGSDLGPYMVTEALKPYKNHLNMHFVSNVDGTHIAETLKALNPETTLFLIASKTFTTQETMTNAHSARDWFLKSAGDEGHIAKHFAALSTNGQEVKQFGIDTKNMFEFWDWVGGRYSLWSAIGLSIALSIGFENFEQLLSGAHAMDQHVANTPFEQNIPVLLALIGIWYNNFFGAETEAILPYDQYMHRFAAYFQQGNMESNGKYIDRNGHPVDYQTGPIIWGEPGTNGQHAFYQLIHQGTKLIPCDFIAPAISHNPLSDHHSKLLSNFFAQTEALAFGKSREQVDAEFATSGKTVVEVEHVAPFKVFEGNRPTNSILLREITPFSLGALIAMYEHKIFVQGAILNIFTFDQWGVELGKQLANRILPELKDDNRVVSHDSSTNGLINRFKAWR

SEQ ID NO: 2444 - protein, 459 aa, Photorhabdus luminescens subsp. laumondii TTO1
MSAVSSQCPEIGGHVVAKFGGTSVANFDAMNNSADIVLANKAVRVVVLSASAGITNLLVALAAGCDADKRADYLKQIHSIQYAIIDRLHESDTIRQEIDRLLENIKTLAKAASLATSAALTDELVSHGELMSTRLFTELLRQRGKDAEWFDIRKVMYTDESFGRAEPNYEQLQSLATEHLLPQLKNSLIVTQGFIGREENGRTTTLGRGGSDYTAALLGEALGLKRVDIWTDVPGIYTTDPRVVPAAQRIDKIAFDEAAEMATFGAKILHPATLFPAIRCGIPVFVGSSKNPQAGGTLVCDTTEAPPQFRAIALRQKQTLLTLHSLKMLHAQGFLAEIFTILSRHNISVDLITTSEVNVALTLDTTGSTSTNGSLLTNALMTELSTLCRVEVEEDLALVAIIGNQLSQTNGLGKKVFSVLEKFNLRMISHGASNHNLCLLVQGKDAEQIVQTLHQRLFE

SEQ ID NO: 2445 - protein, 105 aa, Oryza sativa
QQKKASAAAGFDDGDGDDVRALKQQAAEQARLASAERAYAERVMELARRELEVAEREFARARAIWERARGEVHKVERMKEVAAARRIGAAALEITCHACMQRFHS

SEQ ID NO: 2446 - protein, 209 aa, Haloarcula marismortui ATCC 43049
MAAMASLQYVNPRSVGRLFCRASLRLSMSDLTATLHTTEGEIEVELYDERVPTTVENFVGLAEGADDYDGTEVGPGTGAWEDPESSEKRIDPLYTDIDIHRIIENFMIQMGDPTGTGRGGPGYSFDDEFHDELSHDGPGVLSMANSGPNTNGSQFFITLDAQPHLDGKHAVFGKVIDGMDVVESIGSVDTDRNDAPTEEMLLESVDVHR

SEQ ID NO: 2447 - protein, 471 aa, Ashbya gossypii ATCC 10895
MGNRGSQHVVGIHYAVGPKIGEGSFGIIFEGENMMEGGDAGRRPVAIKFEPRRSDAPQLRDEFRAYRILNGVRGIPRAYYFGQEGVHNILIIDLLGPSLEDLFEWCGRRFSVKTTCMLAKQMIERVRAIHGRDLIYRDIKPDNFLISEFQREVAAGEVVRGCAATAGGDANLIYVVDFGMAKQYRDPKTKQHIPYRERKSLSGTARYMSINTHFGREQSRRDDLESLGHVFFYFLRGSLPWQGLKAPNNKAKYEKIGLTKQKLKPEELISENIPVQFAEYLKYCRSLRFDEEPDYDYLISLMDSVMHDLNIEDNQHYDWMDLNNHTGWNIAVNKRANLHGYGNPHPRNNNHTTSNLHQQQVQGQAQLKQQPSSPSYHMQYQEHSHKYSKLHRSHSQSTPHRNSQSGKNRVELSTGSNEILTNHPSGKQAVAVQSYDAFGKRVTRSGQQNHIEQDSLTDAGFFSRICCCRWC

SEQ ID NO: 2448 - protein, 405 aa, Oryza sativa Japonica Group
MEMEVEVAGDDEAVPEAPERSVVLISAGASHSVALLSGGVVCSWGRGEDGQLGHGDAEDRPVPTVLTAAFDDAPGGVASVVICGADHTTAYSDEELQLYSWGWGDFGRLGHGNSSDVFNPQPIQALQGVRITQIACGDSHCLAVTVAGHVHSWGRNQNGQLGLGNTEDSLLPQKIQAFEGVRVKMIAAGAEHTAAVTEDGDLYGWGWGRYGNLGLGDRDDRLIPEKVSSVNEEAVELIFFFLGDEGFRVGGGIQWALAADGKLYGWGWNKFGQVGVGDNEDHCSPVQVNFPNEQKVVQVACGWRHTLALTEAKNVFSWGRGTSGQLGHGEIVDRNIPKMIDALSSDGSACKQLESSKAVPMSAKVWVSPSERYAIVPDEKAGKGIPAGNGTETHVPQGDVKRMRV

SEQ ID NO: 2449 - protein, 158 aa, Triticum aestivum
  misc_feature (84)..(84): Xaa can be any naturally occurring amino acid
  misc_feature (94)..(94): Xaa can be any naturally occurring amino acid
  misc_feature (104)..(104): Xaa can be any naturally occurring amino acid
  misc_feature (121)..(121): Xaa can be any naturally occurring amino acid
  misc_feature (123)..(123): Xaa can be any naturally occurring amino acid
  misc_feature (127)..(129): Xaa can be any naturally occurring amino acid
MAPAVMASSATTVAPFQGLKSTAGLPVSRRSSGSLGSVSNGGRIRCMQVWPIEGIKKFETLSYLPPLSTEALLKQVDYLIRSKXWVPCLEFSKXVASVFREHNXSPGYYDGRYWTMWNCYXRXNDAXXXNEVRVRRVPDAMSRMVHNCAVSRIMQRFK

SEQ ID NO: 2450 - protein, 368 aa, Vitis vinifera
MASILEPSKRSFFPAMTKIVGTLGPRSRSVGVISGCITAGMCVARFDFSWGDAEFHQETVENLKVAVKSTKKLCAVMLDTVGPELQVLNRSEHPISLQVDSLVVLTPNQDKEATSNLLPLNFGGLSKAVKKGDTIFIGQYLFTGSETTSVWLEVTEVDGEDVVCLIKNSATLAGSLYTLHVSQIRIDLPTLTDKDKEVISTWGVQNKIDFLSLSYTRHAEDVRHAREFLSKLGDLNQTQIFAKIENIEGLNHFDEILQEADGIILSRGNLGIDLPPEKVFLFQKAAVYKCNMAGKPAVITRVVDSMTDNLRPTRAEATDVANAVLDGSDAILLGAETLRGLYPVETISTVNKICAEVSSSLLYVALLP

SEQ ID NO: 2451 - protein, 172 aa, Nostoc sp. PCC 7120
MDLKSLIRDIPDFPKPGILFRDITTLLRDRQGLRYTIDFLAEKCSEANLNIDYVIGMESRGFIFGTPLAYKLGAGFIPVRKKGKLPAAVHSIEYELEYGTDCLEVHRDALHPDSRVLIVDDLIATGGTASATAKLVQQIGCELVGFGFIIELRDLQGRKHLPDVPIISLVEY

SEQ ID NO: 2452 - protein, 307 aa, Picea sitchensis
MAGDGLGPIRYAVIDAFTDKPFQGNPAAVCLLEENKDTEWMQKVANEFNLSETAFLRRSGSASSASQNGGGLDDAEEFDLRWFTPLVEVDLCGHATLASAHFLFSAFVKCNRVLFHTKSGTLTATKVERFNQNESATYLGRKNERFVIELNFPQVSVFDCVSMEIPLLSNTLRGLAVESVKKTACNDFIVELASGELVENLQPEFDEIQRCSARGIIVTGLAPKQSGFDFFSRFFCPKLGVNEDPVCGSAHCALAPYWAKKLGKTELVAYQASKRGGKLVLQVVEDPQSVILQGEAVTVMLGSLATD

SEQ ID NO: 2453 - protein, 286 aa, Ralstonia metallidurans CH34
MHTDPPDSVHPTQPLHDLHNRWPQAESVEDFRHNLAAVHARIAAACHRVGRDPAGVRLLPVSKAKPEASIRLAHAAGCRLLGENKPQEAYRKWEALADLEDLQWSVIGHLQTNKAKLAARFATEFQALDSLRVAEALDRRLQIEGRALDVFVQVNTSGEASKFGLHPDEVPGFLRALPAFSGLRVRGLMTLALLSAESERVRQCFVLLRELRERLRQDAPVGIGLDELSMGMSGDFEIAIEEGATVVRVGQAIFGARSTPDSFYWPEAEAGDSTLSAAHSGRQGER

SEQ ID NO: 2454 - protein, 458 aa, Haloarcula marismortui ATCC 43049
MDTQQAIRETPEPVTPGDRPPRLGRVPFVDNTAAMLRDPLGFYDRAGAHEADMVGYSVAGTTGCFVCHPDLVEQVLVTDADVYEKGQLLQDTLGQFIGEGLFLLEGEEWQQQRTALQPAFYRERIAAYGDTMTEFADRAAAGWSDGQRIDVLPHMQSLTLNILGKTLLDVDIETTADALEPLLDALRTRLDPRSLSAYLPLWVPTATNRAVTNSLAEFQSTLDDVIAARQREDEHAREARDDVLSLLLSLDDETMDRERLGHQLLTFLVAGHDTTALTLTYAWFLLANNPKRQQRLHDELDATLGERQPTPEDLFELPYLDAVLNEVLRLYPPAFTVFRQPTEPVTLGGYELSTDAQLTLPQWLVHRDDRWYDAPDAFRPERWDDDLEASLPDYAYYPFGGGPRHCIGMRFARMEAKLALATIAQQYAVEAVTEPPLSLAMQITLSPTAPVEVRLRER

SEQ ID NO: 2455 - protein, 353 aa, Oryza sativa Japonica Group
MAAATAAAETPPTLLEYMGQAGAADDLVVLVAHVQSACKRIAALVASPGNAELSRGKAGGGLAVAAGRDAPQAARRIVVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYESVHFSAMWSGRLADGTIKTRGHFRTCDCDETCCNIQTSG

SEQ ID NO: 2456 - protein, 338 aa, Oryza sativa Japonica Group
TWGSCGGSPASACRTAAPPSARSSGSVQLLLGYLPTERAFWPHELEKKRSQYSAYKDEFLLNPSEKIRRFEESKLLRKKELNSDKIGLLPRAKVTNEEHPLSFGKSSLWNQYFQESEILEQIDRDVKRTHPEMPFFSAKANQESLRRVLIIFSKLNPTIRYVQGMNEVLAPLFYVFKNDPDTSNSASAEADTFFCFVELLSGFKDNYCKHLDNSQVGIRSTLSKLSQLLKRHDEELWRHMEITTKVYPQYYAFRWITLLLTMEFSFNVCIHIWDAILGDPEGPPDTLLRICCAMLILVRRRLLAGDFTANIQLLQHYPPTNIDHLLHIANRLRGSVAS

SEQ ID NO: 2457 - protein, 327 aa, Oryza sativa Japonica Group
MNNHAAGGSTSNGGSGVDGDGGGGGGAARRNTKMPKYSKFTQQELPACKPILTPKWVVSVFFLVGVIFVPVGVVSLLAAQNVVEIVDRYDDACVPANMTDNKLAYIQNPNISKECTRTLTITEDMNQPIFVYYQLDNFYQNHRRYVKSRNDGQLRDAAKANQTSACEPEKTTADGKPIVPCGLIAWSLFNDTYSFTRGNENLTVDKKDISWKSDREHKFGKNVYPSNFQNGLLKGGGTLDPAIPKNDTITVKLSNNYNTYNFGGKKKLVLSTATWLGGKNDFLGFAYVIVGGVCFFLAFAFTLLYLIKPRKLGDHNYLSWNRHPGGR

SEQ ID NO: 2458 - protein, 91 aa, Zea mays
  misc_feature (19)..(19): Xaa can be any naturally occurring amino acid
  misc_feature (52)..(52): Xaa can be any naturally occurring amino acid
  misc_feature (61)..(61): Xaa can be any naturally occurring amino acid
KIVETIHSAKASQIFDSRXLPRVQVDAYLSHGPLVRAVCPRGASTGIYEAMXFRDGGSHYXGKGVFQAVNTENTDIGPAMIGWDPTAQTEM

SEQ ID NO: 2459 - protein, 461 aa, Brucella melitensis 16M
MTARILVVDDVDSNVKLLEARLLSEYYEVVPAYSGAEAIEICLDGQIDIVLLDVLMPGLDGFEVCRRLKANPRTANIPVIMITCLTSPEDKVRGLEAGAEDFLSKPVNDLELLSRLKSLTRLKMMSDELFQRAGRIADAEVDALLARKMAGKDGNKDEIARILVVDEDELAAARLRHILDENYRVDVASDAETALIRAIETDYDTIIVSASFTYYDPLKLCTQLRTIQRTRLIPIILMVWEDEGALVVRALELGVNDYLMRPLEKIELFARLRTQIKRKCYNDILRQSMERTITQSVTDGLTGLHNRRYIDMHMPLLLTRAIERKQPLSIIMIDLDHFKQVNEQYGHGAGDHVLREFSGRLRRNIRGMDLISRYGGEEFVVVLPDTDRQAAFNVAERVRGIVAEAPFVLDDGKRRASLTVSVGVAALRPAGDSLEALFTRATDALIQAKQSGRNRIVLSAA

SEQ ID NO: 2460 - protein, 574 aa, Legionella pneumophila str. Lens
MKDHYKWLGCLFFLICNIYQVNAKTFPQHPPGYAVASAHPLATHAGLEILAAGGNAFDAAVAVAAALAVVEPYHSGLGGGGFWLLHQEKEHLNLFIDGREVAPLAASKDMYLAPDGQLIPGLSLTGGLSAAIPGQPAALVYIAKNYGRLPLSKTLAPAIKLAEEGFPVDPQFRYFSTLDDRLENLKKYPDTAAIFLKNGQPFEIGEKLVQKDLAKTLRLIAKYGNAGFYSGETASLLVQGVNAAGGIWSLDDLAQYKIKVRPPLISAYHNMLIITAPLPSAGGVALVTMLNILSKFPLSSFPKLKWVHYVVESMRLAYWQRDQFLGDPDFIKVPLDKLISSDNAKQLSRLISPNKAIDSKVLQGSVPTGKHSNTSHISIIDTEGNRVAATMTINYIFGSSVVAKGTGVLLNDEMDDFSTKVGEQNVFGLVGSERNAIEPRKRPLSSMAPTFLEMPGRVAILGTPGGSRIPTMVLLASLLFYDGYGAISMVSAMRFHHQYLPDVLQFEPDTFPSSIQQGLQAMGYHLMPLKQYYGDMQAITWDKESNVLTAASDPRHIGLAAAISNMAYGYGVNY

SEQ ID NO: 2461 - protein, 256 aa, Oceanobacter sp. RED65
MFTTIREDIKCVFDRDPAARNTFEVLTTYPGLHALMHYRFAHWCWNHGLKYPARFVSFMSRWFTGIEIHPGAKIGKGFFIDHGMGVVIGETAEIGDNVTLYHGVTLGGTSWKAGKRHPTLKDGVVIGAGAKVLGPVEIGENARVGSNAVVTKAVPDGATAVGIPGRIVVKKEKASDEQDRRRQAMADKIGFDAYGMTDEMPDPIARSIHNLLDHMHAVDAKIDRMSSALGDLGHKECTGELPKLRNALDDEANTKS

SEQ ID NO: 2462 - protein, 260 aa, Oceanobacter sp. RED65
MQPMVNLALRVLRDAGQELVHAVERFDFERASDQEISKFIADCAIGTEKQIIFKLRKHFANDSFEGRETGRKDAEEPSGTVWHISPIEGQENFRTGFPCFSMVIACQVNGKTEHAIVVNPVTGQEFTATRGRGTEMNGRRMRTGEKTKINQAMLGVKFPGIAQNEQNDRIRQRISKLAQETRMIRAMGDDALSLAHLAAGHLDAVWLSRVDSTALQAGALLAKEAGCLLTDFSGGAHYEADGDVIAANPKLIKSLIKASI

SEQ ID NO: 2463 - protein, 673 aa, Ashbya gossypii ATCC 10895
MAENTQLRRKRTRAFDLNGSRAVGAQNGRMGAAGVEMGDATGTARNGLYIEEEPDPLVNDMLQRQMFLLGSNSGNSGDSGSLVRDADDADSSLAFMGDVGDMVGELALGGTHAGSNYTARRFKKQRTVSLPQLPHAKLFYRLDARGPAASKAVPRRSQNDDELLHISGSSSRTLDGNRMVTLPVIRSESPSSLLPPTQLEQQTALNGSAITKATSLLTGQQKLPKLITRRQRSIRRDNFNTDKEGHYVFHGNDIFANGRFMTEELLGQGTFGKVVKCVDNAEPTKKHVAVKIIRALDRYRQAAKTELRVLQTIRDNDPLGQFQCLLLRDCFDYRNHICLVTDLFGKSIYDFMCNNGNPRFPGSHVQAISRQLIRSVCFLHDLGIIHTDLKPENILICDESFVETPLPDTVLATLSTRRKQVSGGKHKVLTNPEVKLIDFGSAVFCEEYHPPVISTRHYRAPEIVLGLGWSFPCDLWSIGCVLVELVTGESLYPIHENLEHMAMMQRVNGQSFPRKMISKMFYKVEHKLGNLPTDLMTTVVRHFDKTSMALQWPERNYKGEIVTKEKSMKRVMATCDRLDKHISTKLQRDYGEWLIIDWDYTPEQNWSMIESKFYNRTMRIDRETFLFWYWFVDLCRKMFEFDPTKRITAKDAMDHEWFTYGILDEGISSFGQT

SEQ ID NO: 2464 - protein, 420 aa, Bacillus cereus ATCC 10987
MVQKVKERVKIEDILMAHNCMKDIVIKTPLQRDTVLSEKYDCDVYVKREDLQLIRSFKIRGAYNLIQSLPKEQLQNGVVCASAGNHAQGVAFTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIFTAIGGGGLASGVGTYVKGVSPATKVIGVEPMGAASMKEAFLQNDNVALEKIDSFVDGAAVKKVGKLTFETCKDVIDDIVLVPEGKVCTTILELYKKNAIVAEPAGALSIAALDLYKDEIQGKTVVCTLSGGNNDIDRMQEMKERSLIYEGLKHYFIIEFPQRSGALREFLDKGLGPEDDITRFEYIKKHNKENGPALVGVELKHKEDYAQLITRFKENNIQFMELNKNPVLFDLLI

SEQ ID NO: 2465 - protein, 316 aa, Physcomitrella patens subsp. patens
MEFFRDAHSVRLLAHTGKYLWADDDRRSVAQKKGRNSYGVIWRVEFIPERNAIRLKSVYDLYLMASDYAFLLGATGKKVIQSFASKADSSLEWELIAAGTFVKLKTKGDKFLRANGGVPPYRNSVTHDVPVLASNYHVVQWEVEVASSPVPNQRSAQHRHRTTMSELPPQLSSNDDYDSPPSELPSPRTRLQNLKIDQGEIAGRGKASPRTPSAKSPSDVRRIFYSIAEDDGEVLAHDDETFGSFLFKGHSLQELTEQLQLETGIDEDIILCMRNPLTQKLYRMRLQLPPNKAPLSLVIVRTNSECEFSSPHLPSF

SEQ ID NO: 2466 - protein, 191 aa, Zea mays
ARGGNYWKQVIKINDYQKSRFVNRVVASMFNTVAGKKIAVLGFAFKKDTGDTRETPAIDVCKGLLGDKAQISIYDPQVTEDQIQRDLAMNKFDWDHPMHLQPTSPTAIKQVSCVWDAYEATKGAHGVCILTEWDEFKTLDYQKIFDNMQKPAFVFDGRNIVDPEKLREIGFIVYSIGKPLDAWLKDMPAVA

SEQ ID NO: 2467 - protein, 439 aa, Magnaporthe grisea 70-15
MATAAPPTAPAATAPPQAQPRISPSCPEETAAILRAAAAHDAPLLKKLLDEPGKASVQDPETRETPLHAAVRAAAGTAADDTATMDLARKTLTELFWSGAIWNDVDDKDETPGCVALREGLDDLYAMCRDAGVRAEMLFGLMDGYEALSSGDSEMEQEEAVEVVDLDIENGEEAPELVDVDALKAAVVADAPTEKHTVESEAYLASKLTYNAGALVDDAGNGVMMAWETDIMRRSVDALLPELPAGKRILNVGFGMGIIDSMFAETKPSRHHIIEAHPAVIQHAKTAPDSKFGAAWEESGPEPGAFKMHQGRWQDVCRELLEAGEVYDAIYFDTFGEDYSQLRMFFTEFIPGLLDSEGRFGFFNGLGADRRICYDVYINVSEMHLAEAGLDVDWTDVPVDMDRMAEAGKGEWEGVKRRLSPTSVHLFGLMIQTCVQYCH

SEQ ID NO: 2468 - protein, 175 aa, Triticum aestivum
MPPTVMPSSATSVAPFQGFKSTAAFPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPACEESGKA

SEQ ID NO: 2469 - protein, 177 aa, Haloarcula marismortui ATCC 43049
MTNLWEDLETGPNPPEEIYAVVECLKGERNKYEYEKDIPGVVLDRVLHSNVHYPSDYGFIPQSYYDDEDPFDVLVLVEDQTFPGCVIEARPVALMKMDDDGEQDDKVIAVPTEDPRYDHIEDLDDMPQQTLDEIDEFFSTYKNLEEGKEVETLGWEDKEAAKDAIVHAQELYDEEFN

SEQ ID NO: 2470 - protein, 463 aa, Nostoc sp. PCC 7120
MADLTPNSSFSVTLRLQIPNRVGMLASITQAIASSGGNLGQIDLIEQTRQVSLRDLTVDAASTEHAETIVQAVKAIPDIKLVSVYDRTFNLHRGGKISITSRIPLKSVSDLAMAYTPGVGRVCTAIAQDPSQVYNLTIKQNTVAIVTDGSAVLGLGNLGPHAALPVMEGKAMLFKEFAGLDAFPICLATQDTEEIIQAVKNIAPVFGGVNLEDIAAPRCFEIEKRLRDELDIPVFHDDQHGTAIVTLAALFNSLKLVQKSLADIRIVINGAGAAGVAIARLLRKAGAEKIWMCDSKGIISTTRTDLNEEKQEFAVKAQGTLAGAVQGADVFIGVSAPGVLTPEMVKSMAKDAIVFAMANPIPEIQPELISKDVAVIATGRSDYPNQINNVLAFPGVFRGALDCRAQTITTTMYLEAASAIASLVNPSDLSREHIIPSVFDERVVTAVAAAVQRAAREEGIARG

SEQ ID NO: 2471 - protein, 240 aa, Zea mays
RGPRQEEEKWVPVTKLGRLVKENKITKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWSQTKFSMTPFQQYTDLLAKPTKGLVLEAPTETVEA

SEQ ID NO: 2472 - protein, 284 aa, Triticum aestivum
MGNHLSINQRPEYQGDAQRKGRSRASSYTKAKWTVEREMWQSSLLYPPPASAFVTAMSVVSFASLASAGLSELRSQHMAYSKFWHVVSGQQQKKGGTGGVQLSGRDGMLVAYAPALVAAAASFVVPGTVEGLRAELLAVHFLKRVLEVLFIHRYSGNMPLNTALAISSSYLLSAITMIYAQHLAVGLPDPTTDLLSQLRKGGDDDTGYKIPKGGLFEFVTCPHYLFEITGFFGFAMISQTVYALAMAFGTAAYLVGRSFATRRWYESKFEEFPTSIKALVPYIL

SEQ ID NO: 2473 - protein, 323 aa, Gluconobacter oxydans 621H
MTQTAAPAWSTDSLERLDGKTALITGSTGGLGFEVACGLAKQGAAILLSGRNHNKGQAALARLHERVPFVKARFELLDLASLAGIEAFASAMRSRGEPIHLLANNAGVMGPATRLTTKDGFELQFGTNHLGHFALTGRLLPLLAAGNATVMTVASLAALKGEIPFGDLNARHSYNPMVRYRQSKLCNLLFALELNRRALKAPWPIHSRAAHPGWAASDIVANNGSLDQSANKAARFMRGLARRVAGPVFHAMGQTVEEGAWPLLYALASPEARDGGYYGPQGPGERRGVPGIAGLPALAHVPELAERLWTVSEQMTGVKYGLV

SEQ ID NO: 2474 - protein, 353 aa, Botryotinia fuckeliana
MGCGMSTEEKEGKARNEEIENQLKRDKMLQRNEIKMLLLGAGESGKSTILKQMKLIHEGGYSRDERESFKEIIFSNTVQSMRVILEAMESLELPLDDQRAEYHVQTIFMQPQQIEGDNLPPEVGSAIAALWKDAGVQDCFKRSREYQLNDSARCYFDNIERIAQHDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYALACDYILNRFVSLNQHETKQIYTHFTCATDTTQIRFVMAAVNDIIIQENLRLCGLI

SEQ ID NO: 2475 - protein, 403 aa, Oryza sativa Japonica Group
MASLAVPLRASATPAIAGTGSGGGSRAADPVKVSCVRSKVTCGFPSVGASSSLASSVEPVRATATQAPLATHQSSSTEKTKVGINGFGRIGRLVLRIATNRDDIEVVAVNDPFIDAKYMAYMFKYDSTHGPFKGTIKVVDESTLEINGKKISVTSKRDPSDIPWGNFGAEYVVESSGVFTTTEKASAHLKGGARKVVISAPSADAPMFVVGVNEKNYNPSMNVVSNASCTTNCLAPLAKIVHEEFGIAEGLMTTVHATTATQKTVDGPSMKDWRGGRGASQNIIPSSTGAAKAVGKVLPALNGKLTGMAFRVPTPNVSVVDLTCRLEKSASYEDVKAAIKEASEGSLKGILGYTDEDVVSNDFIGDTRSSIFDAKAGIGLSSSFMSSSLGTTTSGATATGSWI

SEQ ID NO: 2476 - protein, 377 aa, Ralstonia metallidurans CH34
MRIFKLPDLGEGLQEAEIVNWHVKPGDTIAADQPLLSVETAKAIVEIPSPFAGQVAKLFAQPGDIVHLGAPLVGFEGAGASDDAGTVVGAVKVGTHVVNEGVTRVGAAGIPGGHGIKATPAVRALARKLSVDLSMVTPSGHDGVITATDVQRVATTLADVGAPDVLRGVRRAMAQNMARAQSEVAAATVMDDADLHAWQATGASVTGQDITIRLVRALVAGVRAEPALNAWYEGRTGRRHLLERIDVGIAADLPEGLFVPVLRNVGKRDAADLRAGLDRMRADVVARTIAPEEMRGNTITLSNFGMIAGRYAAPIVVPPTVAILGAGRVRDEVVASGGVPAVHRVMPLSLTFDHRVVTGGEAARFLRAVIEDLERPE

SEQ ID NO: 2477 - protein, 799 aa, Physcomitrella patens subsp. patens
MDVENPLMGSYQEKPRTFSSLKNKPFWLVQTALRLDRRVYYLLALFTVFFLFYIGSQSSPIILFVFTICIGSLVYAIYLASWVLAKDEGPPEMSEISDAIRDGAEGFFRTQYGSISRMAGVLGFVILGIYMFRKSTPEQEAAGLEKSTLAFITSLSFLLGAVCSGIAGYIGMWVSVRANVRVSSAARRSAREALLVAVRAGGFSALIVVGMTVMGVAVLFASFYVFLSVDTIHNMKMTELPLLLVGYGFGASFVALFAQLGGGIYTKAADVGADLVGKVEQGIPEDDARNPAVIADLVGDNVGDCAARGADLFESIAAEIISAMILGGTMAKRCKLDDPSGFILFPLVVHSFDLVVSAIGIASIKGTRDPSSKSLIEDPMIILQKGYSVTLFLAVLAFGGSTRWLLYTEQAPSAWFHFALCGLVGIVTAYVFVWISQYYTDYKYDPVRQVALSSTTGHGTNIIAAGVSLGLESTAMPVLVISLSIVTAYWLGKTSGLQDNQGIPTGGLFGTAVATMGMLSTAGYVLTMDMFGPIADNAGGIVEMSQQPESVREITDLLDAVGNTTKATTKGFAIGSAALASFLLFSAYMDEVSSFSGVAFTTVDIAIPEVFVGGLLGSMLIYLFSAWACAAVGRTAQEVVSEVRRQFSERPGIMTYQEKPDYARCVSIVAAASLREMIKPGALAVISPIVIGLVFRLVGQATDQPLLGAKAVAGMLMFATVSGILMALFLNTSGGAWDNAKKYIESGAFGGKGSDAHKAAVTGDTVGDPFKDTAGPSLHVLIKMLATITLVMAPLFLDN

SEQ ID NO: 2478 - protein, 143 aa, Zea mays
  misc_feature (4)..(5): Xaa can be any naturally occurring amino acid
  misc_feature (31)..(31): Xaa can be any naturally occurring amino acid
  misc_feature (63)..(63): Xaa can be any naturally occurring amino acid
  misc_feature (66)..(66): Xaa can be any naturally occurring amino acid
  misc_feature (68)..(69): Xaa can be any naturally occurring amino acid
  misc_feature (73)..(73): Xaa can be any naturally occurring amino acid
  misc_feature (83)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(90): Xaa can be any naturally occurring amino acid
  misc_feature (97)..(97): Xaa can be any naturally occurring amino acid
  misc_feature (104)..(105): Xaa can be any naturally occurring amino acid
  misc_feature (109)..(109): Xaa can be any naturally occurring amino acid
  misc_feature (112)..(114): Xaa can be any naturally occurring amino acid
  misc_feature (122)..(122): Xaa can be any naturally occurring amino acid
  misc_feature (124)..(125): Xaa can be any naturally occurring amino acid
  misc_feature (127)..(127): Xaa can be any naturally occurring amino acid
  misc_feature (129)..(129): Xaa can be any naturally occurring amino acid
  misc_feature (139)..(139): Xaa can be any naturally occurring amino acid
TGAXXAHALDRLGDLLRAGALPGVSGVPTSXKTEAHAARVGIPLLPLDAASIALSIDGADEVXPDXNXXKGRXGSLLREKMVXGXPXARXAVIVDEXKLVPRLXXTGAXPVXXXPFGAPHTXGXXRXLXHGLPGFHARXRTTT

SEQ ID NO: 2479 - protein, 327 aa, Solibacter usitatus Ellin6076
MDHGSQRRVARALRAGGPEVIELADEELPPLKSGEALVRVEAVGLNHIETLIRSGNYVVRLPFPYPLGGEGAGVVVAAGPDVSLPVGARVCWAAVLGSCATLIAAPASMLVPIPPGLTFDDAACLAVASLTAGGLARVWPLQGRSAVVWGAAGAVGRMLVAILADRGADVIGIASGNRVDAVRAAGANHVVDRANSDVPSGVHDYTGGRGVAAVFDPIGAPTFETSLQLLAPRGCLINYGELSGPVPEVNLHRLFPGSLFVTKYNGTRWVEGLAEFGLLIAEGLALAVKRPAVISDIAGRFPLDCAIDAYRLLESGATGKVLVQPTL

SEQ ID NO: 2480 - protein, 511 aa, Mycobacterium bovis AF2122/97
MRSVTCSATLVLPVIEPTPADRRPRHLLLGSAGHVSGRLDTGRFVQTHPAKDVSVPIATINPATGETVKTFTAATDDEVDAAIARAHRRFADYRQTSFAQRARWANATADLLEAEADQAAAMMTLEMGKTLAAAKAEALKCAKGFRYYAENAEALLADEPADAAKVGASAAYGRYQPLGVILAVMPWNFPLWQAVRFAAPALMAGNVGLLKHASNVPQCALYLADVIARGGFPDGCFQTLLVSSGAVEAILRDPRVAAATLTGSEPAGQSVGAIAGNEIKPTVLELGGSDPFIVMPSADLDAAVSTAVTGRVQNNGQSCIAAKRFIVHADIYDDFVDKFVARMAALRVGDPTDPDTDVGPLATEQGRNEVAKQVEDAAAAGAVIRCGGKRLDRPGWFYPPTVITDISKDMALYTEEVFGPVASVFRAANIDEAVEIANATTFGLGSNAWTRDETEQRRFIDDIVAGQVFINGMTVSYPELPFGGVKRSGYGRELSAHGIREFCNIKTVWIA

SEQ ID NO: 2481 - protein, 554 aa, Hypocrea jecorina
MAPTNTLPAWSELQAHRDDIAKNFVLKEAFASDADRFNKFSRTFKSDGVSADILFDFSKNFLTNETLDLLVKLADEAGVERKRDAMFRGDKINFTENRAVYHTALRNVGGWEMKVEGQDVMNGPNGVNSVLQHMKEFSEQVRSGEWVGYTGKKLTNIVNVGIGGSDLGPVMVTEALKHYGAPDMTLHFVSNIDGTHMAEALKASDPETTLFLIASKTFTTAETITNANTAKAWFIEKTGGKGDVAKHFVALSTNEEEVTKFGIDKANMFGFESWVGGRYSVWSAIGLSVALYVGYDNFHKFLAGAHAMDKHFRETPLRDNIPVIGGLLGVWYADFFQAQTRLVAPSFDQYLHRFAAYLQQLSMESNGKAITSDGSSAKYTTGSILFGEPCTNAQHSFFQLVHQGTKLIPADFILAAKSHNPIHDNLHQKMLASNYFAQAEALMVGKTDDQLRAEGTPEELIPHKRFLGNRPTTSILVGDVIGPAELGALIAYYEHLTFVEGAVWDINSFDQWGVELGKVLAKKILKELDEPGNGEGHDASTGGLIGAFKSFAKI

SEQ ID NO: 2482 - protein, 301 aa, Polaromonas sp. JS666
MLIVALPGEARLAGRLARLLRCGWSELRLHRFPDGETLVRIDAPVMGRCVVLAGSLNQPDGKTLPLLFAADAARELGASRVGLVAPYLAYMRQDHRFNAGEAVTSRSYARLLSASLDFLVTVDPHLHRWRNLGDIYPIRTQAVAAAPMIARWLRSHVDHPLVIGPDQESGQWVAEVARLTDAPWTVLGKTRLGDRDVQVTLADGGPWPGKTPVLLDDIISTGQTLVAAATALTQAGMAAPLCIGVHALFDSGALQRLQDAGVTRVVTCDTISHTSNAIRLAPLLARAVLAVSHHSTQGKPP

SEQ ID NO: 2483 - protein, 343 aa, Zea mays
MALSSLFITLPIPNVPSPKPRRMLTSRASSDAPAASASFDLRRYWTSLIADVESELDAAMPMQPPESIHYAMRYAVLPGAGKEGAAKRAPPVLCVAACELLGAPRAAALPAAAALEMLHAASLVLVHDDLPCFDAAPTRRGRPSTHAAYGTDMAVLAGDALFPLAYTHVISHTPSPDPVPHAVLLRVLAELARAVGSTGMAAGQFLDLAGASALGEAEVMQVLTKKFGEMAECSAACGAMLGGAGPDEEAELRRYGRTIGVLYELVDDIRSASGNGKMRSNASVLRSLGMDRALGIVEELKAQAKTTADRFAEKYGDRVLPLYSFVDYAVERGFELQDAAATP

SEQ ID NO: 2484 - protein, 213 aa, Zea mays
MPKRTTHTYSSEDALPEGPESDLFVYYCKHCASHVLITDTQLQKMPKRKTDRAHVLDKAKHLSRLNVKEAGKVMLKRGEGKLEKQFRMSCVGCDLFVCYRSEEDLEVAPFIYVIDGALSSVAAETNPHDAPVPPCITQLEGGLVQVAIEVEDRAQRSAITRVNADDVRVTVAALAARGEANSELLEFMGKVIFFNDTLILLWCGIVHFEPCKK

SEQ ID NO: 2485 - protein, 820 aa, Oryza sativa Japonica Group
MVQWWEEWQLRVLVLTSLFLQCFLFFSATFRKHRIPAILRASIWLAYLGSDAVAIYGLAAIFSRHGKNAGDDGGRGESSMLEVLWAPVFLIHLAGAQDSITAYDAAEDNALWARRAVAMSSQAAVAVYVFCRSWSGGKVPARCPVALFVTGFLKMGLMLWALRRASATRIATVGRKAAAVEANWSLERYLQWASKSAIEATRNIQTNDDGDGGGGENRSAARRHRSATSELQLDLIDLEYQNDLMELFIDFPNTYTSRLSYLSLFLKLEPYDAYCRLCDLVDYAFQIFYTSRNAAYPFAIWFVFLRFIFFMLASTAIGGFDGLDSNIDGLDANDVKVTYILLYSEFVVEFSNMISLRYHKWPVCKLEPQIKHTIAQFSLIGCASHSRWPREMDSNLSRRYPLIHTCQTVLSRVAMFLRCNNQHYWYHVEHSSSTEKAVDLIREDLRSGWVEDDLRSAAAYRRFNDRRGQWTLRREQCYGEMGWSVAKLPFDEAVLIWHIATDICLHCTEDIDISSSPAASADEVTAVMEISNYMMYLLAYQPDMLMLGTRQSLFMAAHHEIVHALRHQGRHQQQPSERDLARCLAGGDDDEYSTPATEEQAGAGSRLLERRGGGGRHLAHARRLAGAMMKLDAGKRLRVIGGVWVEMICYSASRCSGSLHLKSLGVSGQEFLTVVWLLLHRMGMEVLADKLHRPELAGDDPDAVGTAFLSTDDATIADTIKTRNLDLEPGHWSVKPTWSQICTRVPESLLQVNWIFGFREEINKLADRLAEEAKSNRPSSTVYVCQSISHLAYPNTGCHANNIRDNFNLTNFVIQHVLCF

SEQ ID NO: 2486 - protein, 131 aa, uncultured haloarchaeon
MMATVEYLNYETLDDNGWEMDDNDLFEKAADSDLDNEDYGSLEVNEGEYILEAAEAQGYDWPFSCRAGACANCAAIVTEGEIDMDMQQILSDEEVSERNVRLTCIGSPAADNIKIVYNAKHLDYLQNRVIG

SEQ ID NO: 2487 - protein, 260 aa, Mesorhizobium sp. BNC1
MRLANKIAFITGAAEGIGACAAGLFSREGAKVILSDIDEDRGRKVADQVTSAGGDAVFVRCDVTSEASVREAAAAVQERYGALHILYNNVGGSTPRDDRVTDVDLEEFWSAMKLNVLSVVLPARHLIPLIAASGGGSVINTASYMALLGTAGRDCYTASKGAVVSLTRSMAVEFGPDNIRVNVIGPGAVDTERLRRFQSARPDHPTFDPRNRHRRPEVASHIMGLVQPEDVANMALFLASDESVRITGSLHMVDSGASCW

SEQ ID NO: 2488 - protein, 347 aa, uncultured haloarchaeon
MQTLQEPYGVVGQIIPWNFPLLMAAWKLGPALAAGNATVLKPAEQTPLSILKLMEEAGDAIPDGAVNVVTGFGTDAGEPLSRHDGIRKLAFTGSTKVGRSVMKAAADTITDVTLELGGKSPLVVFPDADLDRAVETTITAIFFNTGECCCAGSRLFVHEDIKGEFMNKLAEAADDLEVGDPLLESTDLGPKVTADQVERTMGYIQEARDAGATVVAGGDAPDDEALAEGCFVTPTLISEIDHDNRAVQEEIFGPVQEIFTWNDYDEMIELANDVDYGLAGGVLTEDLTKAHKCAKDIEAGTIWVNTYNDFPSGQPFGGYKQSGIGREIGQEAVDHYTQTKTINIALD

SEQ ID NO: 2489 - protein, 156 aa, Candidatus Kuenenia stuttgartiensis
MEKTLIILKPDAIQRRLLGKIISRFEEKGLQITGMKMMMIPGSLARAHYVSHKGKDFFEPLVSYTTSSPVVVIVVKGKNAIEIARKMMGVTFGSKAEPGTIRGDYAVSNRFNLIHGSDSPSSAEKEIAAFFTKEEIVDYQPIDLSWVYDISEGGMV

SEQ ID NO: 2490 - protein, 448 aa, Bacillus clausii KSM-K16
MERSESIPLNFQEVEPPLSTQEATDEATRCLYCYDAPCITACPTGIDIPSFIQKITTNNLTGSARTIMEANPIGASCARVCPTEELCEGACVLNQTSKPIMIGKLQRYATDWAIQNEKPLFTAGKRNGQKVAVVGGGPAGLSAARELALLGYAVTVYEAETEAGGLDTYGIVSFRLPKRISLWEVEQVKSLGVSIQTNTRIGVDLSLAELQQSFDAVVLAVGMANVPPLGIPGEELHGVYDAIDLVKATKSTTLPQQFQGKRGVVIGAGNTAIDGATCAVRLGAENVKVLYRRTEAEMTAYQFEYEFAKQDGVEFRWLVSPIAVLGDEKGRVTALKCAEMALTEADESGRRTPIPTGATFVIKTDFIIKAIGQARHRWLEDVGIATHNGVISIDHHYETSVKGVFACGDAIFGQGQGEAMVVAAAEQGKQVAYAIDKKRRSQRAETSA

SEQ ID NO: 2491 - protein, 255 aa, Ralstonia metallidurans CH34
MTAIHHAAAQGFSAQADTYARGRPEYPAELSGWLRDTLGVAPGKSVVDLGAGTGKFTRLLAQTGATVIAVEPVDAMRAQLSSKLPDVQALAGSAESIPLPDGSVDAVVCAQAFHWFANTAAVQEIRRVLKPGGKLGLVWNVRDESVGWVARLTEIMTPFEGDAPRFYKGDWKKVFPADGMGPLGLTRFAYTHSGAPEQVIVDRVMSVSFIASLPQDQQDAVRARLREVIATDPALQGHDVVSFPYSTEAYCCERL

SEQ ID NO: 2492 - protein, 85 aa, Physcomitrella patens subsp. patens
IVHSKLEHEFEVTYPGNANPLKLLARKKRLQDELPLLREECDKLLAAKQDLIDAARTTLVKNRTLLCQLQARAGLPVSCDADDPI

SEQ ID NO: 2493 - protein, 740 aa, Candidatus Pelagibacter ubique HTCC1002
MEIKKVVVIGSGTMGSGIAAHLCNANIPVTLLDLKTEISEQARDKIYKSRPPLLLDKSKIKNIKVGNILDNFDEVKEADWVVEAVVERIDIKHDIYKKIFKERKKGAIVSSNTSSIPIKILSQHLSEEEKKDFCITHFFNPVRYMGLLEIVKNENNDLDKINSLKAFCETELGKGAIICNDTPGFLGNRIGVFAMQVAMTEAFKMKLSIEEADAIFGRPMGIPKTGVFGLYDLIGIDLMADVLKSFIKELSENDPFQVVAKEIPLVKKLIETGYTGRKGKGGFYRVNKTGEVKVMEAINLETGEYSASKKINIKSDKIDLKELISREDKYGEYAWSVISKIIKYASSLVPSITKDFNDIDEAMRLGFNWTKGPFEMLEEIRVETFFGKIDDVKGNAFLENLSKNRNQDFYGSRQKYTDIETFGKAKKKALSVDGNSSAQIYRFNDYNIVEFTTKANALDYDSMDALKKATDKPLIIINESMQFSAGVNLSYTMDFANKNDFKSIEKFIRYFQETCKHLKYSNHPVISAPSGLTLGGGFEVMVQSNFVASHTNIVVGLVETIVGLIPAGGGCKEMLARWLDTDEAKKDPHYAPLKVFDIIGYGKTATSPIEAEPLKYLRPEDKKIMNRNSLLEVSKKILDDNKEFKTPTETEFKLPGKEILIEMNKIIENLYNEKIIRDHGVTVAKELAHVLSGGDTTIDKTLSEDDLFKLELDAFMRLIETKETQDRIKHTLATGKPLIN

SEQ ID NO: 2494 - protein, 728 aa, Photorhabdus luminescens subsp. laumondii TTO1
MLYQSETIQVSWLKDGIAELVFNAPAAINKLDTKTVASLDKAIASLEQQTGLKGVLLRSEKTAFIVGADITEFLSLFDSPVEKLQEWLNFSNSIFNRIEDLPVPTISAINGYALGGGCECVLSTDFRVASPDIRIGLPETKLGIMPGFGGSVRLPRLIGTDNALDIIAAGKDIGAEEALKNGLIDAVVPKEKLVDSAVSMLEQAIAGNLDWKAARQPKLEPLKLNETERGMSFSVAKGMVMKVAGPHYPAPITAVKSIEKAATFGRDEALKQETASFIPLAQTNVARALVGIFLNDQYVKGLAKKHLKEVTIPEYAAVLGAGIMGGGIAYQSARKGIPVMMKDISQQSLELGMNEAAKLLNKQFERGRLDAIKMARTLSSIQPTLNYAGIEQAQIVVEAVVENPKIKAAVLSETETLVNEDCVLASNTSTIPISELAKSLKRPENFCGMHFFNPVHRMPLVEVIRGEKTSEKTISTVVAYASKMGKTPIVVNDCPGFFVNRVLLPYLLGFGLLLRDGGDFRQIDKIMEKEFGWPMGPAYLIDVIGLDTAHHSQSVMAQGFPDRMHRDYKDAIHVLYDNQRYGQKNGLGFYKYTQDKKGKPKKEQDEQTDQLLATICQQKSNFSGEEIIARTMIPMINEVVRCLEEGVIASPAEADMALVYGLGFPPFHGGVFRYLETMGTAAYVKMAENYAHLGALYQVPPGLKAKAERNESYYSTAATIAVSTGKTA

SEQ ID NO: 2495 - protein, 416 aa, Glycine max
  misc_feature (363)..(363): Xaa can be any naturally occurring amino acid
MATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPKAPLEKVCLLGCGVSTGLGAVWNTAKVESGSIVAIFGLGTVGLAVAEGAKTAGASRVIGIDIDSKKFDVAKNFGVTEFINPNEHDKPIQQVIIDRTDGGVDYSFECIGNVSVMRAALECCHKGWGTSVIVGVAASGQEISTRPFQLVSGRVWKGTAFGGFKSRSQVPWLVDKYLKKVKFFLRVFCFCALIRIVGKHAXLQGYIVSLSALLDLQEIKVDEYITHTLTLSEINKAFDLLHEGGCLRCVLSTQE

SEQ ID NO: 2496 - protein, 131 aa, Glycine max
MAMALVSLSTILTPPSSSSSSFSSPKPSSSSIVRFRPLTPLPRFRRHLVRMAPDEEKMTRRSPLDFPIEWERPKPGRRPDIFPQFSPMKTPLPPPLPADPPEEDEEEEEKKEEEEEPEKEEPDKPDKPEKQ

SEQ ID NO: 2497 - protein, 478 aa, Candidatus Pelagibacter ubique HTCC1002
MLDKKKFYINGEWVSPKKPNDFKVTDPSTEEECAVISLGGVEDVNDAVSAATKAFETWAFSTKEERLKYLEALYAVYKKRWADMAKAITLEMGAPIDFSTQLQAGTGASHIKSYIKVLKEYTFEAKLGEHALNNNILHEPKGVCALITPWNWPMNQTCLKVIPAIAAGCTMVLKPSEIAPLSSMILAEMIDEIKLPKGVFNLVNGDGAVTGNALTSHPDVNMVSFTGSTRAGALISQNAANDFKRVSLELGGKGANIIFKDADAEAVERGALRCFRNSGQSCNAPTRMLVEKSIYDETVERVKNFANSMKVDIATKEGDHIGPVVSKAQFDKIQALIQVGIDEGAKLVAGGTGKPDGLDKGYFVKPTAFADVNNQMQIARTEIFGPVLSIIPFETEEEAIAIANDTPYGLLNFIQTQDQEKANRVARKLRSGMVDINGAGLAPDAPFGGYKHSGIGREAGKLGLEEYLEVKVVSGWND

SEQ ID NO: 2498 - protein, 177 aa, Legionella pneumophila str. Lens
MNYSIRKFEDKYPELGERVYIDPQSTVIGNVTLGDDVSVWPMAVIRGDVNYIQIGHSCSIQDGAVLHVTHDGPYTPGGRPLILGQGITVGHKALLHACTINDYCLIGMGSIILDSAHIQKHVMIAAGSIVPPGKILKSGYLYLGSPVQAVRKLTAKEIEQIEYSAGHYIRLKDRYLT

SEQ ID NO: 2499 - protein, 452 aa, Legionella pneumophila str. Lens
MKTKHFDLIVLGGGSGGIASAVRAAQYGAKVAVIEQNHLGGTCVNLGCVPKKIMYNASSIAETLHKSPDYGFFLENNAKLDWKRLVNKRNAYIERLRENYAQRFSQHKITLIQGKGIFHDQSSITIDHTIYQAEHIIIATGGEPALPAINGIKHAIDSDGFFSLTKLPAKVAVIGSGYIGVELAGILNSLGSETHLLMRGTRPLSRFDHMIGDTLMEIMQKQGICIHQNHKAQAIHLHSDGRKSILCQSGSIIGNIDVIISAVGRKPRTGNLNLDKINVITDDKGLILVDAFQNTSVKGVYAIGDVTNAPALTPVAIAAGRRLADRIFGNQPDACLNYDNICSVVFSHPPSGSVGLTEYEAIEKYGKNKIKIYQTRFIPMYDALSIDKTPTAMKLVTLGKKEKIIGLHVVGYSADEMLQGFGVAIKMGACKKDFDNTIAIHPTSAEEFVTMV

SEQ ID NO: 2500 - protein, 290 aa, Triticum aestivum
LAWSRPRLYGYPIEIQSLFFMALRCALLMLKHDAEGKDFVERIATRLHALSYHMRSYFWLDFQQLNDIYRYKTEEYSHTAVNKFNVIPDSIPDWLFDFMPCEGGFFVGNVSPARMDFRWFALGNMIAIVSSLATPEQSMAIMDLIEERWEELIGEMPLKICYPAIENHEWRIVTGCDPKNTRWSYHNGGSWPVLLWLLTAASIKTGRPQIARRAIDLAERRLLKDGWPEYYDGKLGKYVGKQARKFQTWSIAGYLVAKMLLEDPSHLGMIALEEDKAMKPVLRRSASWTN

SEQ ID NO: 2501 - protein, 487 aa, Oceanobacter sp. RED65
MRMPDVTEPFELVLFGAKGDLAHRKLIPALYNLHVDGRLSEQGNIWAITRPNTEQSAYIEQVKDWVRKLGAEFDEKTWKAFSQRIKLVGVDLYKAAGYSKLAKKLNASGNPVVYYCAVHSRLYPVICEQLFAHNLITEHSAIVLEKPIGNDYESGMVINRRVAEFFEESQIYRIDHYLGKETVQNLLALRFANSIFEHQWNQRYIDHIQITISETVGVEQRAGFYEGTGALRDMLQNHLLQLLCMTAMEPPASMEAESVREEKVKVLKALKPIVGADISECVVRGQYGEGISEGEMVPKYKDEPGVDTHSTTETFVALKAQIDNWRWSGVPFYLRTGKRLAKRACEIVVQFKEVPHSIFEMQHKKTMANKLVFHLQPDEGVSLQLCEKRVGNHMQVRPMVLSLNQSDQDKNRVPEAYERLLADAINRNPTLFLREDELMTAWQWVDPILNHWQTSDQRPDTYTAGSWGPAASTLLLAKDGRLWEENS

SEQ ID NO: 2502 - protein, 278 aa, Oceanobacter sp. RED65
MISKCLFPVAGYGSRFLPATKAMPKEMLPIVNKPLVQYGVEEAVEAGLNDMGFVTGRGKRAIVDHFDMSYELEKEIAGSGKEAMLEPVTNLIEQNDFAFTRQVHMKGLGHAILSGKNLMGDNPFAVILADDLCIPEPGDIGVLAQMVEIYKQFRCSVVAIQEVPMDEVHKYGVIDGQDMGNGIFRVSDMVEKPAKEDAPTNLAIIGRYILTPDIFDKIADTQPGKNGEVQITDAIMKQAQQGCVIAYKFRGKRFDCGSIDGFVEATNYVYDNIYKQGL

SEQ ID NO: 2503 - protein, 58 aa, Oryza sativa Japonica Group
MFFSRFDPWPVFFRREWKRCWPFLTGFAVTGAIITKMTAGLTEEDLKNSKFVQAHKKH

SEQ ID NO: 2504 - protein, 541 aa, Aspergillus oryzae
MAAPVLPLQQVKLPALPSTRLTPEQQYWKTFKNPLLIPSPANGPVNLITQPSAPSSASAFPSLTQPPDVFTVTTGARVQIYSIRTRKLLRTVTRFDDTVRGTDVRPDGRVFVAGDDTGALQVFDVNSRAILKSWREHKQPVWVSKFSPSDPTSLFTASDDRTVRLWDLPSENSVKTFVGHTDYVRSGAFMPGSLASSGLLVSGSYDRTVRLWDPRVESRSAMTFKMAAPIESVLPMPTGTTVLAAADNKIAVLDIVAGKPLHMIQSHQKTVTALALASNGERLLSGALDGHMKVFETTGWNMVSGSKYPSPILSLRAITSGPAQEDKHIAVGMQSGLLSIKTRLSGQQKIKEKERRKEMQALLEGKLEEHDRKVAKQKKLRGSGWEKRFRGRDFIGEGVDIIIEGQDRKRKKEQPWEHDLRKARYSAALDQVLASGDKTAQLTLLTALRHRSALRASLQNRDEVTLQPVLQWVNKSIGEPRLVKLSVEVAMNVLDIYSGNLGQSATIDKMVDRLHRRVRDEVEMAHQACQTKGMLDMLKAA

SEQ ID NO: 2505 - protein, 463 aa, Acinetobacter sp. ADP1
MLDSAAPLKRAMSTRHLVMLSLGGAIGTGLFLGSGEVITQTGPIGAVIAYMLGGLIAYMVMLCLGELAVHMPVSGSFGAYAKKYIGPGTGYMISWVYWLTWTATLGTEFTAAALLMQEWFPHTSMWIWTIIFALTIFGLNLSSTHIFAESEFWLSLVKVLTVISFIILGLLAIFGIIHFEGHASAPLFSNLTSHGWFPQGLMPIFATMLIVNFAFSGTELIGVAAGETKDPSINVPKAINAAIWRLLIFFVGTIVVISALLPYDQTGLGGHNVSNSPFVTVFQYIGIPYADHIIRFVIITALLSAANSGLYAASRMMWSLSNQRQLPSVFSKLTASGTPIIALVVTMFGAIPGLLSEQFAPETIFKNLLGVAAFTMVIVWMSICLSQFNFRRHWYKQGYHAKDLKFAAPLFPILPILGFLFCLITGLSMAKDPEMLPGFIGCLIFVACCYLSHYIFYREKSKL

SEQ ID NO: 2506 - protein, 450 aa, Bacillus clausii KSM-K16
MNTGMEPTLAKKDGQYVWHAMQRPGAAPLIADSGEGSWFTDTNGNRYMDGVSGLWCLNLGHGQTEIIEAATEQMNKLAYFPLSLGHQPAIALAEKLAALLGGGFRTFFANGGSDANETAFKIARQYHKQTGSPEKQKIISRYRGYHGNSLGALAATAQANRKIKYDAALPGFLHIPPPYAYRSSFGSAAEDDQQAADFLEQTILWEGPETIAAFIMEPIISGGGVIYPQSNDYYKRVRDICDRYQVLLILDEVVSGFGRTGKLFGFMHGDDDFKPDIITLAKGLTSGYLPLGATCVAENVYQAFDGKGETSHFRHISTYGGHPASCAVALKAIDIIEREQIVNRVETLGHTVLGKLKQLEQLSIVGEVRGIGFLYGIELVQDKQTKEPADDDTMKAVVTACQKQGLIIGKNSDTIPGGGNVLIIAPPLTSSEEDLAFLVDTVSSVLRTFA

SEQ ID NO: 2507 - protein, 357 aa, Euglena gracilis
MDYYTVAHIDEPCSQPWYKSRVAAFFGGCLLATCMSLRFKGTVQENYAVGTKPAVHSLPLAALGTWGRSQVPQNPPQNGFNNFGRRSSALQMTVGGWAPSAKMPRKFIVGGNWKCNGDRASIKALIQALNAGESTIGSGVDVVVAPPMLYGDYARGLLRSDFGVAFQNCWVGGNGAFTGEVSADMIKDAGFDWVILGHSERRSLPEIKETDETVATKTAYALEAGLKVMLCIGETLDARQSGKTDEVNARQLAAVAEKVSDWSNIVIAYEPAWAIGTGVVATPEQAQETHTQIRKWLAENISPQVAQQMRIMYGGSANAANADSLARQPDIDGFLVGGASLRPEFLRIVESWKRKVE

SEQ ID NO: 2508 - protein, 443 aa, Ashbya gossypii ATCC 10895
MTSGIYFCDSKGKLLLSRRYKDDIPANAIEQFPHLLIEKEQESSVLPPCFSFNGVQYLFIQHNDLYVLTLTKSMSINVAQVFSYLHKLIEVLEEYMKVVEEESIKDNFVIIYELLDEMMDHGIPQITDTKMLRQYITQKSFKLIRSAKKKKNVVRPPATLTNSVSWRPEGIVYKKNEAFLDVVESINMLLTQQGQVLRSEILGKVKVKSRLSGMPDLKLGLNDKGIFAQGDDDDDEEGASGGTKKKSNIELEDLKFHQCVRLTKFENEKIITFIPPDGDFELMSYRLSTPIKPLIWCDVKLQVHSRSRIEIHCRAKAQIKKKSTANNVEILIPVPEDADSPKFRYSHGTIKWVPSQNAILWKIKSFPGGKDYSMAAEMGLPSVSDNSDHKLKRPVQIKFQIPYFTTSGIQVRYLKINEPKMQYNSYPWVRYITQSGDDYTIRM

SEQ ID NO: 2509 - protein, 226 aa, Arabidopsis thaliana
MGNTSDDDKILSYEDVVLRRSDLDILNGPIFLNDRVIEFYLSFLSTVHSSTTISLIPPSIAFWISNCPDTEYLKDFMKPLNLRDKDLLILPVNDNSNVEVAEGGLHWSLLVYYKEANTFVHHDSYMGVNRWSAKQLFKAVSPFVSNGDASYKECTDTPQQKNGYDCGVFLLATARVICEWFSSGGMKNRDELWFANVKETVPDLVNHLREEILALIKKLMSESVSK

SEQ ID NO: 2510 - protein, 132 aa, Helicobacter pylori
SNIKYELDKESGALMVDRVLYGAQNYPANYGFVPNTLGSDGDPVDALVLSDVAFQAGSVVKARLIGVLNMEDESGMDEKLLALPIDKIDPTHSYVKDIGDLSKHTLDKIKHFFETYKDLEPNKWVKVKGFEN

SEQ ID NO: 2511 - protein, 453 aa, Blastopirellula marina DSM 3645
MNLTHQQLRDWDRSAHWHSFTQMAEYEPLIIERGEGCMLYDIDGNAYLDGVSSLWCNTFGHRHPKIDQAIRDQLDKVAHVTNLGCSSVPAVELTKRIVDLTPGELNHVFYACDGSSAVEVALKMAFQYWRQRDDPRPKKTSYIAFHEAYHGDTLGAVSVGGVEMFHDMFRPLLFSVHRLPSPDRDHLPAGVTSETACRYYLDQLEAVLKEHHETIAALVIEPLVQGAAGMLMQPEGYLRGLRELTTKYDVLLIFDEIAVGMGRTGTMFACQQEAVTPDFLCLGKGLTGGYLPLSVTVATTEVWNAFLGAYAERKTFFHGHTFSGNPLLCAAALATLDIFAEEKILDQLPAKIAHLEMRLAELIDHPHVASVRQCGLIAGVELVADKESGQAYPWTERRGWRACRHATQNGVWLRPLGNVIVIMPPLSITLAEIDRICDAAKAGIGHAVAPCGE

SEQ ID NO: 2512 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLVLPIDKIDPTHSYVKDIDDLSKHTLDKIKHFFETYKDLEPNKWVKVNGFEN

SEQ ID NO: 2513 - protein, 460 aa, Escherichia coli O157:H7 EDL933
MATGKIVQVIGAVVDVEFPQDAVPRVYDALEVQNGNERLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 2514 - protein, 561 aa, Ustilago maydis 521
MVASSSSATASLLDQLFALTPLADSSAWIKTITVLVLLPLLAVVLNVASQLLLATPKNHPPVVFHFVPVIGSAIYYGIDPYKFFFECREKYGDVFTFVLLGRKITVALGPKGSNLVFNAKHQQVTAEDAYTHLTTPVFGKEVVYDVPNAVFMEQKKFVKVGLSIENFRVYVPQIVDEVREYIKSDARFSALKTRKTITVDIFQAMSELIILTASRTLQGKEVRQGLDKSFAQLYHDLDSGFTPINFVIPNLPLPSNFKRDRAQKKMSQFYQDIVAKRRAAGASTSADDASGENDMIAALIEQKYKNGRALSGVEIAHMMIALLMAGQHTSSATSSWAFLRLASRPEIIEELYEEQLNVYSDGHGGLRELDYETQKTSVPLLDAVVKETLRLHPPLHSIMRYVKSDLAVPPTLSSPTSTKSEPDAHYVIPKGHYIMAAPGVSQVDPQIWKSSDQFDPHRWLDATTAAAMQDSGEDKQDFGFGMISTGANSPYLPFGAGRHRCIGEQFAYLQIGVILATFVRIFKWHLDSKFPDPDYQSMVVLPSKNGCAIVLTPRAESLHLD

SEQ ID NO: 2515 - protein, 128 aa, Streptomyces antibioticus
MALTQDELLAEFEGMTLIQLSEFVKAFEEKFDVTAAAAAPVVVAGGAAGGAAAEAEEEKDEFDVILTGAGDKKIQVIKVVRELTSLGLKEAKDLVDGTPKPVLEKVNKEAADKAAEALKGAGASVEVK

SEQ ID NO: 2516 - protein, 251 aa, Photorhabdus luminescens subsp. laumondii TTO1
MVDQTKQTTHFGFRTVAKDEKAGMVAEVFHSVAAKYDLMNDLMSFGIHRIWKRVAIDASGVRRGQRILDLAGGTGDLTAKFSRIVGEKGEVVLADINESMLKVGREKLRDVGIVGNVSYVQANAEALPFPDNYFNCITISFGLRNVTEKEKALRSMFRVLKPGGRLLVLEFSKPLFAPLSKAYDAYSFHVLPKIGQVFVQDAGSYRYLAESIRMHPDQDTLKTMMEEAGFEQVTYTNMTGGIVALHRGFKF

SEQ ID NO: 2517 - protein, 445 aa, Salmonella enterica subsp. arizonae serovar 62:z4,z23:--
MNMSSVKKIGLFACTGVVAGNMMGSGIALLPANLASIGGIAIWGWVISIIGAMSLAYVYARLATKNPQQGGPIAYAGEISPAFGFQTGVLYYHANWIGNLAIGITAVSYLSTFFPALNNPIPAGIACIAIVWLFTFINMLGGAWVSRLTTIGLFLVLIPVVLTAVAGWHWFDIATYHANWNTSTTTDSHAIVKSILLCLWAFVGVESAAVSTGMVKNPKRTVPLATMLGTALAGIIYIAATQVIAGMFPASVMASSGAPFAISTSTILGGWAAPLVSAFTAFACLTSLGSWMMLVGQAGVRAANDGNFPKIYGEIDKNGIPKKGLLLAAVKMTALMILITIMNSSGGKASDLFGELTGIAVLLTMLPYFYSCVDLIRFEGFNIRNSVSLICSVLGCAFCFIALMGASSFELSGTFIVSLIILMFYGRKMHQRQNNDSENNTVEAL

SEQ ID NO: 2518 - protein, 263 aa, Zea mays
  misc_feature (183)..(183): Xaa can be any naturally occurring amino acid
  misc_feature (247)..(247): Xaa can be any naturally occurring amino acid
LKMESDVEESMRKRPRKYPFSADSSSRKQFEQYSGRTFASMGEVNFMQDDDNRLEITRTKFGSLLKRHGDLTERLARDSDKIIFERLQKEFEAARASQTEEICLDGEEWNDGLLATIRERVHMEADRKAMQGDADILACPLEKITYKIGNKVICCLEGARIGVQYETSFAGEPCEFYHCVLEXKSFLEKMTVLEHTVPFFLPIREIENDLHSSNAMKLLDPVGDLLQAFCRLPMVELLRELYGNQIXELYLSLPHPNGRIGLK

SEQ ID NO: 2519 - protein, 146 aa, Oryza sativa Japonica Group
MQDPRGMPRDEFATPKTHKRKVVSRPLPPSQIKAEPELLRREVPLTSGKTKKAPKITFKNEPRHSAPQSDWGTPDSVPEFGPADEYRALRKKYLLLEDENGELDKQLSQAEEEASVLEDEKFALLDQLVVLEGLVDPSQMQPPRRL

SEQ ID NO: 2520 - protein, 508 aa, Oryza sativa Japonica Group
MASPAPAPPAASSSAAGSAPPPRIGLAGLATMGQNLALNIAEKGFPISVYNRTAAKVDATVSRAEAEGALPVLGHRDPRGFVLSLSRPRTVVLLVQAGRAVDATIDALVPYLDAGDAIVDGGNEWYQNTERRIEEAAARGILYLGMGVSGGEEGARNGPSLMPGGHIDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKDERVAAAGVLEAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 2521 - protein, 244 aa, Erwinia carotovora subsp. atroseptica SCRI1043
MKGKFSIALMLSACFSASASDSVHWGYEGSGDPAHWGKLSPDFSLCETGKNQSPVNIQQALNAQHDPLQLAFQSGTQQIINNGHTVQVNVSSGNTLLLDNETFALQQFHFHAPSENEIDGKQFPLEGHFVYKNADGALTVIALMFQEGAANPQLATAWQQIPAHVDQAEDVRTPIAIQALLPTSLNYYRFSGSLTTPPCSEGIRWLVLDHPVTASAEQINQFSSVMHHANNRPIQPLNGRIIIH

SEQ ID NO: 2522 - protein, 181 aa, Coffea arabica
MASSMISSAAVATTTRASPAQASMVAPFNGLKAASSFPISKKSVDITSLATNGGRVQCMQVWPPRGLKKYETLSYLPDLTDEQLLKEIDYLIRSGWVPCLEFELEKGFVYREYHRSPGYYDGRYWTMWKLPMYGCTDATQVLNEVGECLKEYPNCWVRIIGFDNVRQVQCISFIAAKPKGF

SEQ ID NO: 2523 - protein, 452 aa, Mycoplasma hyopneumoniae 232
MSKITKVFAREILDSRGNPTIQVDVYTLAGGFGSAIVPSGASTGSREALELRDTNTKYADNWYGQKGVMTAVDNVNNIIAPEIIGLCCKNQRLIDQKMIELDGTPNKEKLGANAILGVSLAVAKAAANELRMPLFRYLGGTNPTLMPVPMLNVINGGEHASNTLDFQEFMIMPLGFRTFKEALQAANKVFHNLAKLLKKSGFETQVGDEGGFAPNFNSHEQALDFLVDAIKESGFNPGFKGENAVAIAIDAAASEFYNGQKYVFKKLKAASLSKNQADLDEKFEFSSEELLNYYGQLLAKYPIISIEDGFAESDWQGFIAFNQKYGNNHQIVGDDLTVTNVEILKKAINLKAINSILIKLNQIGTLSETLDAIHLAQKSGMTAVISHRSGESEDTTIADLAVAVSSGQIKTGSLSRTDRIAKYNRLLVIEEYLNSYAKADYIGREVFYNLKK

SEQ ID NO: 2524 - protein, 371 aa, Vitis vinifera
MAALSSFFKRKSSIPFTSLAIRRWFSTQPILDSPSFSQRIRDLPKDLPGTNIKKEVSQLIGKTPLVFLNKVTEGCGAYVAVKQEMMQPTASIKDRPALAMITDAEBKQLITPGKTVLIEPTSGNMGISMAFMAAMKGYKMVLTMPSYTSLERRVTMRAFGADLILTDPTKGMGGTVKKAYELLESTPDAFMLQQFSNPANTQVHFETTGPEIWEDTRGQVDIFIMGIGSGGTVSGVGRYLKSQNPNVKIYGLEPTESNVLNGGKPGPHHITGNGVGFKPDILDMDVMEEVLMVSSEDAVNMARQLALKEGLMVGISSGANTVAALRLARRPENKGKLIVTIHPSFGERYLSSVLFQELRKEAENMQPVSVD

SEQ ID NO: 2525 - protein, 112 aa, Zea mays
MADVTRNGFGGRNPPGLLQNAAKNKHAFVQLFLMTGVLLVSLRTLGQKHLLHDLAADNADLRRQRDGLSHRMRDLQDALRTEAGADSSGALASHLRRIFTAHPAPAAAAEDQ

SEQ ID NO: 2526 - protein, 703 aa, Vibrio sp. Ex25
MSEQKAFSLKVDEQNIAWLAIDVANEKMNTLQAAFADEMKEIFAQLKDASGIKGMIIHSLKPDNFVAGADVRMLEACTTASEAEALARQGQELFQQLSDLPYPVVAAIHGPCLGGGLELALACDYRVCTDSDKTRLGLPEVQLGLLPGSGGTQRLPRLIGLLPSLDLILTGKQLRAKKAKKLGVVDACVPDTILLDVAKQFIDKGKNKGTKKLSTKEKVMSGSGLGRKFVFEQAAKKTNQKTRGNYPATVAILDVIQHGLEKGFAQGQELEAKRFGELVMSSESKALRSIFFATTEMKKENGTDAKPAPAHKVGVLGGGLMGAGISHVSVAKAKVPVRIKDVSNDGVLNALNYNYKLFEKQRKRRILSKADLQAKMLQLSGGVDFTSFNHIDVVIEAVFEDLDLKQKMVADIEANAKPETIFATNTSSLPIHKIAEKAERPENVVGLHYFSPVEKMPLVEVIPHETTSDETISTVVALAKKQGKTPIVVKDKAGFYVNRILAPYMNEAAHILLANEPIEKIDTALLDFGFPVGPITLLDEVGVDIGAKIMPILVNELGERFKGPDVFDILLNDGRKGRKSGKGFYTYKGKKKEVDKSIYKLLKLDPESKLSDNDIALRCVLPMLNEAVRCLDDGIIRSPRDGDIGAIFGIGFPPFLGGPFRYMDQFGIKELVEKMNEFASKYGDRYAPCDGLLTRAGEGTTFY

SEQ ID NO: 2527 - protein, 647 aa, Candida albicans SC5314
MSELTELHPHHHVQIKESILVGKALLNFTTFFVTLGILVMGFEQSVYAPIITNKYFKQYYHNPSPTEIGFMIAILEIGALFSSIIAGKIGDLVGRKRATRYGAVFFYIGGFIQCISPNMFILCIGRLLGGFGIGFLTTIVPMFQSEISPAEARGFYACVEFTGNILGYAIGIWLDYAFSYLENDYSWKAPLIVQFLLGVVLWLGTFIVVETPRWLLNHDHDLEGMIVIADLYADGDVEDDHAMSEYRNIKESVLIDRIEGGERSYEYLFKRYAKRLSVACFGLMFAQLNGINLISYYAPMIFEEAGWVGRQAVFMTGINGIIYVISTIPPWYLVDSWGRKPLLMSGALIMGIPFCIAGYSLSLNNEYTSTIVVTSIIISNFGFGFSWGGIGWLLPAEVLPLSVRSKGAALATATNWFSNFVVGLASPILLDQIKWKTYFIPAISCFISFFAVWYLFPETKGLSLEEMGSVFDDKSSIFSHHASGSVGGSSSSIFNYGATNDLNRRTSMTNDSTPSIAGALPGAVPGAIDSIHQSAASMARNPTSNNNQQLDGIITGAAPPPMPINTNNNNIIKPVKSDNAADTLSLDSGFGGSQSDIVQEIEPPSLEEILKYKIQKQIEPNAFIATFHWLFSKKGQPNDEESRLLQQ

SEQ ID NO: 2528 - protein, 390 aa, Gibberella zeae PH-1
MADQNKKNDDFVAKMPEVANENNIGDGEKENDSLVGRGPGTDALPAQPGGFMATVENSGPFSILAYCLSSISMTVVNKYVVSGSSWNLTFFYLAVQSIVCIAAITACKQLGMIKSLAPLEMDRIKKWYPISLVLVGMIYTSTKALQYLSVPVYTIFKNLTIIAIAYGEVLWFGGSVTSTALASFSLMVLSSVVAAWADIKSAISGDYSATTGDADALATLNAGYFWMAMNVICSASYVLGMRKVIHKMNFKDWDTMYYNNLLTIPVLVFFSLVTEDWSSANLAKNFPEDSRNRMMIGIIYSGLAAIFISYCSAWCIRVTSSTTYSMVGALNKLPIAVSGLIFFAAPVTFGSVSAIFIGFVSGIVYAWAKVKENEAKKNALPTAENRDSSK

SEQ ID NO: 2529 - protein, 312 aa, Ashbya gossypii ATCC 10895
MIHRLIEVITSHLHLVSSSHEHTNKVQREIEMAEEIVVEPESLREIEHIVLVLSGKGGVGKSSVTTQLGMALACRGLKVGILDIDLTGPSLPRMVGMEGKSVLQGPRGWIPVDVPTGMEQGCLRVMSLGFLLDDRGDSVVWRGPKKTAMIKQFISDVYWGALDYLLIDTPPGTSDEHISIAEELRGARPDGAIIVSTPQKVAVADVKKEINFCRKVNFKLLGVVENMSGFVCPHCSECTNIFARGGGESLALESGVPFLGTVPIDPAFVEMIESQSSREEPLISLYKTSGLYPIFARIVQHVLDQGIPSRCQ

SEQ ID NO: 2530 - protein, 964 aa, Gibberella zeae PH-1
MSAFKSFPAVRGEGGLSRRRDSSALSTLPETEPPVRRQSLAARSDSQVKGAGTSLDLPSSRLSTTQPSLSGSQNAKETKDKRPSFKSISPSPPPNAGLDPLSTQIYLRTNSNTAEPTIAQRLRSQGRSESDNIQRQSSEISNSAGTPQDSSKDRRKGVSFLSRLGMRGSWRKDDDMLDSDSELGELRTDGAYARALTSVMGAGGGYIPLHKEPPRYIRVKAHNKKDRDYNHLFLAQELTASEHKPQNTHGRAVATAVGSKILRGGDAIWAAEFSLDGRYLAVAGKDQVVRVFAVISTPEERKEHEEEEAQHGTHGEKLSAPVFRTKPVREFREHTGEVLALSWSKNNFLLSSSMDKTVKLWHMSRNDCLCTFVHKDLVTSIAFHPTDDRFFLAGSLDAQLRLWSIPDKNVAFQAPVGEFITAVAFSPDGNIAICGVLSGLCTFYTTEGLKLKYQIHVRSSRGKNAKGSKITGIRTMTIPDGPEAGQVKVLVTSNDSRVRIYNLNDKVIQVKYKGLENQSSQINARFSDDANYIICGSEDRKAYIWKVGSQDDIKDKQPYESFDAHPEVVTTALMAPMKSRQLLSASGDPIYDLCNPPPVTLRSLEESTPSQSAPSEEENGDSLHSNRRPEETPAYVERSRHLDGNIIITTDRTGKIKVFRQDCAHKKRQQGLWESGSRLSNRLSGVGRSGSVMTRTSASSRVQSRRGSLTIPGPNPIQLQHASDRINSWRQDIDGEPLSLNHNSVRSVRSERSMSPNKQAQSPVTSAANLAAESRKQPYASSPITRPTPTSPAGSGLSHHTTVRASHDRDRSNSITSPPTPSFSLISASDSDGLNDREGSFWNLSRWRSTRQSNRHSSVLSSPNGSPNLSNNRPGSDFLSVKDRSSLRMSLGMNDSKPSREEIVNRRRSAGPRLTSRLSVQGDRKSVVEEEVDVPEQITPTKKRVDSGVGRISDESATSVHPKY

SEQ ID NO: 2531 - protein, 241 aa, Anabaena variabilis ATCC 29413
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNPDVPIQYGGSVKPNNIDEIMAQPEIDGVLVGGASLEAASFARIVNYQ

SEQ ID NO: 2532 - protein, 460 aa, Acinetobacter sp. ADP1
MSQHSTLQRGLNTRHIRFLALGSAIGTGLFYGSATAIKMAGPSVLLAYMVAGIAIYIVMRALGEMAVHNPVSGSFSHYASQYIGLLAGFTTGWTYVFEMIIVALADVTAFGIYMGFWYPDVPRWIWILSLIMFLGAINLIHVKVFGELEFWLSMVKVTAIVAMILGGLGLMFYGFHTDHASFTPGIQNLWIHDGFMPNGIAGLVACLSVVVFAFGGIEIIGITAGESQDPKTTLPKAINAVPVRILLFYVLTIFVLMSIFPWNQIGSQGSPFVQIFENLGIGSAATVLNIVVITAAISAINSDVFGAGRMLYGMSNRGQAPQIFQKLSKNGVPWMTIVVMAGVLLVGVVLNYLIPENVFIIIASIATFATVWVWLMILVSQVAMRRKLSKAEIKALDFPVVGWPYAPAFAIVFMLFILAMMGYFPDSRPAIYVGAIWLILLWIAYMVWVKPNTIKTDMEL

SEQ ID NO: 2533 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLLALPIDKIDPTHSYVKDIGDLSKHTLDKIKHFFETYKDLEPNKWVKVKGFEN

SEQ ID NO: 2534 - protein, 437 aa, Plesiomonas shigelloides
MFYVHFIMDKKMKFDTLNAKIGIIGLGYVGLPLAVEFGKKVTTIGFDINKSRIDELRNGHDSTLECSNLELLEATKLTYACSLDALKECNVFIVTVPTPIDKHKQPDLTPLIKASETLGKIIKKGDVIIYESTVYPGATEEDCIPVVEKVSGLKFNIDFFAGYSPERINPGDKEHRVTNILKVTSGSTPDVAEYVDQLYKLIITVGTHKASSIKVAEAAKVIENTQRDVNIALINELSIIFNKLGIDTLEVLEAAGTKWNFLPFRPGLVGGHCIGVDPYYLTHKAQSVGYHPEMILAGRRLNDSMGQYVVSQLVKKMLKQRIQVEGANVLVMGLTFKENCPDLRNTKVIDIISELKEYNINIDIIDPWCSTDEAQHEYGLTLCEDPKVNHYDAIIIAVAHNEFREMGESAIRALGKDEHVLFDLKYVLDKKSIDMRL

SEQ ID NO: 2535 - protein, 544 aa, Mycobacterium smegmatis str. MC2 155
MLANLARLLPHKNDYTDVPRTWRQDVLAGITVGVVALPLALAFGISSGVGAAAGLITAVVAGLVAAVFGGSHVQVSGPTGAMAVVLAPIVAEHGLGSIALVTVLAGLLVLAAGITGLGRAVTFIPWPVIEGFTLGIAAIIFLQQVPAALAQQAPSGERTLLAAFTVVRNADWGEAAKTLAVVGVVAVLMIVLPRVHSGIPASLTAVIVATVLIVALDIPVATIGELPSHLPAPVLPHVDVNTLRTMFSAALAIAALAAIESLLSARVAATMSPTGPYDPNRELVGQGLASVASGAFGGMPATGAIARTAVNVRSGAATRLSAIVHSLVLLAVVYLATGPVSAIPLSALAGVLMVTSFRMISATTIRKIVRSTRSDALIFVLTAVITVCFDLIEAVEIGILVAAFFALRSVARRSSVVREELPGPRRPGDDQIALLRLDGAMFFGAAERISNAITDAEHPHVSVVIIRMSQLGMLDATGAHTLAEITTELESRGITVIIKGVRPEHMDLLANVGVFESLRHENHLLDSLDDAVAHARTHVARQPH

SEQ ID NO: 2536 - protein, 549 aa, Photorhabdus luminescens subsp. laumondii TTO1
MEIFFTILILILVVSVSGVLTKVIPFRIPLPLMQIAMGALLAWPHFGLHVTFNPELFLVLLIPPLLFVDGWKMPTREFFQYGREIFILMLVLVLVTVVGIGYLIYWLMPGIPLIAAFALAAVLSPTDAVALSSIVGKRRMPKRMMNVMEGEALMNDASGLVALKFAVAIAMGTMAFSVTGMTIEFFKVAIGGLLSGIAVTWLYSKSLRLMNRWSGGDPATQIVFMLLLPFASYLIAEHIGVSGILASVAAGMTISKSGVIRNAPLAMRLRADSVWSMLAFVFNGLVFIMLGLQLPGIWQTSVIQAEIDPTVETWMLFAAVAVIYGALLLLRFCWLWLMKNISKVFMRKNPLNFATYTTRELWLASFAGVRGAITLAGALSVPLFLADGTPFPARYQLIFIAAGVILFSLLIGVLSLPFLLRGMQTSDKEADISEVRMARAAMAEVAIVSMNKMEERLSASPEEQLDAEVITEVASRVIGYLRRRTVGQDEIEHNLLVEDLERRFRLTALRAERGELYHLRATRKISNETLQTLLHDLDLLEALLVQKEH

SEQ ID NO: 2537 - protein, 380 aa, Candidatus Pelagibacter ubique HTCC1002
MKSIMQKDLWSITSFLENKNYKFNKENILTQLPEKFIDEAIKAISSWDNYAPTPLVKLNKLNDELKFKNIYYKDEDKRFDLKSFKALGGAFAVYKIASEKENITVSTATAGNHGRSVAWGAQRLGLKCKIFISEFVSESRAEAMRKLDAEVIRVKGNYDNSLKECIKQSKENNWEIVQDVSWEGYKEVPKLIMAGYTIMIKEILDEVKSNSISHVFLQAGVGGMAAAMIAGFAKLSQNIPKFIIVEPENADCVFQSIKNNKPTSVDIKKETVMGGMSCGDVSSIAWEILKNSSNYCLTISDEAISTTVALLAEKRLSDLKIIAGECAVPGIIALISSFNNKEYLDKLELNEQSNVLLFGCEGLTDSAMYQKLLSDGLQKI

SEQ ID NO: 2538 - protein, 441 aa, Candidatus Pelagibacter ubique HTCC1002
MPINLSKIAKAKKIKYFLISFVDFFGVLRSKLVPAQAIADMQKNGAGFAGFATWLDMSPADGDMFALPDPKSLIQLPWNKEIGWLASDLYMYGKPVKASPRVMLKEQINKLHKKDLVMKSGVECEYFLISEDGSKIADARDTQSKPCYDQSALMRRYDLIKEICDSMITMGWNPYQNDHEDANGQFEMNWDYTDCLTTADRHVFFKYMVKSLAEKHGLRATFMPKPFSNLTGNGCHAHISLWNGKINKFLDNGDKLGLSKLAYNFLGGIMKLTQPLTAFFNPTINSYRRINAPPTKSGATWSPSSISYTGNNRTHMIRIPDKGRFELRLMDGAVNPYLLQAGVIAAGLHGINNKIDPGEPLSCNMYTDHKNYPHLKKLPDIIEDALDQLENSKEIKEAFGGDTIKSYLKLKRSEINDFNQEEKFDKKSSVTHWEKNSTLDC

SEQ ID NO: 2539 - protein, 132 aa, Helicobacter pylori
SNIKYELDKESGALMVDRVLYGAQNYPANYGFVPNTLGSDGDPVDALVLSDVAFQAGSVVKARLVGILNMEDESGMDEKLLALPIDKIDPTHSYVKDINDLSKHTLDKIKHFFETYKDLEPNKWVKVKGFEN

SEQ ID NO: 2540 - protein, 238 aa, Brucella melitensis 16M
MINAIRVHRTGGPDVLHYEQVEIGEPGPGEARVRHEAVGLNFIDVYFRTGLYKAAKMPFTPGNEGAGIVVAVGAGVENVRVGERVAYAATPGSYADERILPADRLVKVPDTIDLKTAASMMLKGMTAQYLLRRTFRVEPGQTILFHAAAGGVGLIAGQWAKHLGATVIGTAGSEEKIALARKHGYDHVINYRSENFVERVRELTNGEGVDVVYDSVGRDTYMGSLDVLKPLGMFACFG

SEQ ID NO: 2541 - protein, 264 aa, Salmonella enterica subsp. arizonae serovar 62:z4,z23:--
MLTIAVRAARKAGNVIAKNYETPDAVEASQKGSNDFVTNVDKAAEAVIIDTIRKSYPQHTIITEESGEHVGTDQDVQWVIDPLDGTTNFIKRLPHFAVSIAVRIKGRTEVAVVYDPMRNELFTATRGQGAQLNGYRLRGSTARDLDGTILATGFPFKAKQYATTYINIIGKLFTECADFRRTGSAALDLAYVAAGRVDGFFEIGLRPWDFAAGELLVREAGGIVSDFTGGHNYLMTGNIVAGNPRVVKAMLANMRDELSDALKR

SEQ ID NO: 2542 - protein, 85 aa, Arabidopsis thaliana
GGCPELKKLVQVFKENGPLGARLTGTEGAGCPVPLVKEFPVPQFIPAVKGKSSQKKVKKGVVKKKNMGLSLFASKPSRGGAIFNL

SEQ ID NO: 2543 - protein, 96 aa, Oryza sativa
  misc_feature (43)..(43): Xaa can be any naturally occurring amino acid
  misc_feature (50)..(50): Xaa can be any naturally occurring amino acid
MVKEHGWYPYEFQSGTTVAVAGDDYVVVASDTRLTENYAILSXYTLPCGXMHNNSLLLSTGFLGDVLTLKKTLDGRIKTYEYTHNKPISTPALAQM

SEQ ID NO: 2544 - protein, 414 aa, Legionella pneumophila str. Lens
MSTNPSLMTSFDVNKIRKDFPVLHQKINEYDLVYFDNAATTQKPKAVIDAIAQFYERDNSNVHRGVHALSVRATEMYEAARAKVKRFINARSPRECIFVRGTTEAINLVAQSLVAPRILPDEEILITHMEHHSNIVPWQMVCKKMGCKLQVAPISLNGEVILEEFERKLNENTKMVAINYASNSLGTINPVKTMIKMAHEVGAKVLLDGAQATAHLIVDVQDLDCDFYAFSGHKMYGPTGIGVLWGKEELLNSMTPYQGGGEMINSVSFEATEYAAIPHKFEAGTPNIAGAIGLAAAIDYIWSLDLDAIAEYETQLLNYATKAIEAVKGYNIIGTAANKVPIISFVHGKIHAHDIGTILDSEGIAIRSGHHCTMPLMDFYDVAATSRISMSFYNTFKEIDYCMEALQRVKEVFA

SEQ ID NO: 2545 - protein, 671 aa, Candida albicans SC5314
MGFLTNFTNFKTIVASIKKYMRFIGPGLMVSVAYMDPGNYSTAVAAGSAYKYNLLFSILLSNCLAIFLQILAAKLGAVTGLDLAANCKAHFGYKTNLILYALTEIAIIATDLAEVVGTAIALNILFHLPLFVGVIVTVIDVLIVLMAYRPRGPLLFIRIFESFVSVLVAATVVCFGIELYQVSHDSSIHFSVAEVMKGFLPNEDVVDMSDREGGNGLFLSLAILGATVMPHSLYLGSGLVQARLKDYDIKNGFHKPWGKHSIEEPIQEDITVHEEDDNLTPIATPLIQHQEQPGFEKDDESTFDGDDEEDDHYRPSIHAIKDTMSYTIVELVISLFTVALFVNAAILIVAGATLRSGDSKFARDDDNGHESDSDSDDDYQNADLFTIYHLLSKHLSPTAGFVFALALLCSGQSAGVVCTLAGQMVSEGFLSWSLPPVTRRLITRALAIAPCLLVVSFSGREGLAKILNASQVVLSILLPVVSAPLIWFTCNKHTMRVPIFVRDGDEEIDMEYDGEQSTSVATSRFKSSEPAIRLQNLRNSHPCANWEDDDDEQLQQLHLQNEENRLLIGENTTNLVYSSPPTSNLMSRSNSVSATNGVPDSSSSSSSTTIAAQLPLEVYEDLNQDIFRIKGYKDFSNSLATSFVAVLVWVFVASLNLYLIGSMLLGYDVPL

SEQ ID NO: 2546 - protein, 260 aa, Pseudomonas aeruginosa UCBPP-PA14
MIKSAEEIQRMSVAGALTAKVLEALDEVVRPGISTAEIDRFCERYIVDTLAAIPGSKGQYGYPFTVNTSVNEVVCHGWPSAQQILRDGDIVNVDVTVIKDGYFGDSSKMYRVGAIDRQAQKLLDVTRECLYRAIRVVRPDATLGDIGHAIQSHAEANGYSVVREYCGHGIGRKMHEAPQVLHFGRAGAGARLKAGMTFTIEPMINQGGHAVKLHKDGWTVTTRDRRLSAQYEHTVLVTERGCRVLTLREEEREALADLAG

SEQ ID NO: 2547 - protein, 517 aa, Candida albicans SC5314
MKNFNALSRLSILSKQLSFNNTNSSIARGDIGLIGLAVMGQNLILNMADHGYTVVAYNRTTAKVDRFLENEAKGKSILGAHSIKELVDQLKRPRRIMLLVKAGAPVDEFINQLLPYLEEGDIIIDGGNSHFPDSNRRYEELAKKGILFVGSGVSGGEEGARTGPSLMPGGNEKAWPHIKDIFQDVAAKSDGEPCCDWVGDAGAGHYVKMVHNGIEYGDMQLICEAYDLMKRVGKFEDKEIGDVFATWNKGVLDSFLIEITRDILYYNDPTDGKPLVEKILDTAGQKGTGKWTAVNALDLGIPVTLIGEAVFSRCLSAMKAERVEASKALKGPQVTGESPITDKKQFIDDLEQALYASKIISYTQGFMLMNQAAKDYGWKLNNAGIALMWRGGCIIRSVFLAEITAAYRKKPDLENLLLYPFFNDAITKAQSGWRASVGKAIQYGIPTPAFSTALAFYDGLRSERLPANLLQAQRDYFGAHTFKVLPGQENELLKKDEWIHINWTGRGGDVSSTTYDA

SEQ ID NO: 2548 - protein, 369 aa, Candida albicans SC5314
MINKLKIDFGKFKIDLKLLGDLFVLAGAGLSVYYILNTILNDYLDNTVKNKENEKKGSGILKKIQAANPHLKNLSFNQYEKALLNSLVTPEEIAVTFDDIGGLSDIIDELREAVILPLTEPELFAAHSSLIQSPKGVLFYGPPGCGKTMLAKAIAKESGAFFLSIRMSSIMDKWYGESNKITDAIFSLANKLQPCIIFIDEIDSFLRDRSSNDHEVSAMLKAEFMTLWDGLKSNGQIMVLGATNRKNDIDEAFLRRMPKTFAIGKPNASQRTAILNKILKDAKLDENDFDLEYIVANTRGFSGSDLRELCREAAILPVREYIKENYNYKSGKLSRDENDDLPVRPLRTSDFTKNSGTVNGDILPSVALD

SEQ ID NO: 2549 - protein, 483 aa, Bacillus clausii KSM-K16
MVQTYLNYIDGEWKPSISGNVFYGRNPANYEEILGAYQASTAEDARLAIKSAAAAFPNWKNKSAIERADVLYQLMPLLAAEKEKLAAIITKEVGKTMAAARKEVDASIQALKHFSGAANRLAGETVPAGNPETFAYTIKEPLGPVGVITPFNFPLGIGIYKIAPALIAGNTVVYKPHNDTVQIAARLVELFIEAGTPKGVLNLVTGDGDKVGQELGENRTLKAISFTGSSDVGLRLGRSVTNRGGKMQAEMGGKNATVILEDADLDKAVSGIVISGLLNNGQSCTGTSRVIVPKNIAKTVTSKLVEKATAIRVGDGFNENVENGPVANEAQLQKYLHYVDIAVKEGAKLECGGKRLFGEGKDKGYFVAPTVLSGVTPEMTIAQEEVFAPVVAIMEVDSFDEAIAVANQTDFGLSSAIYTTNLQKAHEFVRRVETGVTHINIPSNHYENQLPFGGKKNSSIGPREQGSTALDFWVDTKAVYLKP

SEQ ID NO: 2550 - protein, 132 aa, Helicobacter pylori
SNIKYELDKESGTLMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 2551 - protein, 959 aa, Vibrio vulnificus CMCP6
MSTAFEVDTNTIATIFSSQVPVVEGIYDLTPDQVLLDQAEHESEVRSYPRRLPIAIKQAYGCLVEDTRGQIFLDCLAGAGTLALGYNHPEINQALKEQLDSGLPYQTLDIATTAKTNFIKSVKAFLPEELGNNCVIQFCGPSGADAVEAAIKLAKQTTGRNTMFAFRGAYHGMTNGTMGMMGNLNTKARRTGLMSDVHFMPFPYSLRCPFGLGGDEGAKASIRYIERLLNDDEAGIMKPAAIIVEPVQGEGGVIPAPAFWLRELRRICDEHGMLLIFDEIQCGVGKSGYNFAFEEAGIVPDVLCLSKAIGGGLPMSLLVINKKHDTWRPGEHTGTFRGNQLAMVSGAKALEIITRDNLVEHANVAGQYLRHGLEKIQQRVDCIAEVRGKGLMLGVEIRKPGSELNKFGEPVSDGQLTLAIQRAALERGLMVEKGGRDGSVIRFLPPLIISFEQIDFALRILEEAILAAGGNLKAVEENAEWKKHFIHTGVNGSKEFASVMNHTTAALKNAFEEVDAPYSGMDPKALESAIYAVDLDNKNAPLKEIIDETTELVVKNSIFTQHPDCIAHLHTPPLMPAVAAEAMIAALNQSMDSWDQSSSATYVEQKVINWLCDKYELGAKADGIFTSGGTQSNQMGLMLARDWIADKLSGHSIQKLGLPDYADKLRIICSKKSHFTVQKSASWMGLGEKAVLTIDAHANGTMDVTKLEAAVEQAKAEGLIPFAVVGTAGTTDHGAIDDLNTIADVAEKHDLWMHVDGAYGGALILSSQKARLKGVERAQSVSVDFHKLFYQTISCGAVLVNDKQNFKFLLHHADYLNREHDELPNLVDKSIATTKRFDALKVFMTMQNVGPKALGAMYDHILGQTLEVADLVRNTEGFELLAEPSLSTVLFRSTLGSDLDELNKTLRLEALTRGVAVLGETIVDGKTALKFTILNPCLKMSDFESLLSKINTLAAELAQ

SEQ ID NO: 2552 - protein, 309 aa, Escherichia coli O157:H7 EDL933
MQNAGSLVVLGSINADHILNLQSFPTPGETVTGNHYQVAFGGKGANQAVAAGRSGANIAFIACTGDDSIGESVRQQLATDNIDITPVSVIKGESTGVALIFVNGEGENVIGIHAGANAALSPALVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 2553 - protein, 350 aa, Mycoplasma hyopneumoniae 232
MKPGRQTGLNVIMKKEFDFILIGRITIDFNPMDYYNNLENSSLFKKYIGGSAANIAIGLSRLKNKVGFFGSVSDDQFGNFVLNVFEKEKIDISHIKKTKDHKLGLTFTEMLSEEKSTILMYRDNVADLQIDVSDIDLDYILRTKILVISGTSLAKSPSREAVLKALFLAKNNGIKVVFDIDYRPYSWKNLDEVSLYYQIVAQNSDLIIGSYEEIQLTSRFCLENPENLIDDDYAKYWLKFVDLIIIKNGKKGSKLYQKDKKLVAKVVPVKMLKGYGGGDAYASLFLDHYLKNESDLENGLALATSAASIMVQSHSSFDLPDYQKILEFKDNALKSDPDLVQKKEWNAFKK

SEQ ID NO: 2554 - protein, 374 aa, Rhodococcus ruber
MKTKAAVLRGVGQDWRIEEIELGDPVPGEVQVRLVASGMCHSDHHLRTGGSPIPFPVIGGHEGSGIVTKVGPGVTSLVEGDHVVTAFIPACGTCGPCSRGLQNLCDEGAGLLTGRSISDGTYRASAKGEPLVPMCLLGTFSPYITVNEASLVKIEKDIPLEAAALLGCGVATGWGSATAIGGTKVGDTVVVVGVGGVGINAVQGAAAAGARHVIAVDPVEFKRHMALALGATHVYASLEEAMEPVRDLTWGLMADVTVLTVGDIEGDIIQPALTITAKAGQVVVTAMGDATKNEVTLNLFELTLLQKRVQGAIFGGVGPRTQIPALLHHYRSGALKLEELATTVYRLEDVNQGYDDMLAGKNLRGIIRYTDADF

SEQ ID NO: 2555 - protein, 489 aa, Mycoplasma hyopneumoniae 232
MNFKRNYIQSFYANEFHSEENPKTLDIFSPYDGSVLAKLEITSTSTLDKIVAQAKIAQEKWASLTFKKRSEVIYKYRELVIRYKQELAHLIHIDNGKTLKEAVAEVEKVVELTEFACSIPQLVSGETQMVSRGIIAREERRPVGVFGIIAPFNFPLMVPNWSIPNAIALGNAVILKGSELCGLSASFMADLWKQAGLPSGIFNLVNGQSEIANAMINHPQIDGITFVGSTEIAKLVHKNASNLNKRVLALGGAKNHIFVLKDAPIETASSEVLAAALGMAGQRCMAASVALVVGQNEEFIQALIEKARKFKLDFDLPPLVSKASVDKLVTYLNWAKEQGAKILVNGITDFLIPENKKEGFWFGPTIIDWSEIPEKMGSQEVFGPILEIIRTKNLSEAIKIQQKSPYGNAASVYTQSGRAAEEIIAKVKPGMLGVNIGVPVPREPFSFGGTRSSKFGYGDITGKSSINFWTNLIKVTTKWNPEDKQDWMS

SEQ ID NO: 2556 - protein, 474 aa, Rhodococcus ruber
MTAGHFTELYINGSWVASTSKTVIEVLNPATEEVIGTVPDGTAADVDAAVAAARAAFDGWASTPVDKRAQYLRAIAAGIADRSDELARTISAEMGAPLSFAQAMQVPLPINSFSHAAAVAESFPFERTEGSSVIVREPIGVVGAITPWNYPLHQIAAKVAYALAAGNTIVVKPSEVAPLNAWMLAEIIDAAGVPAGVFNLVSGTGPVVGEALASHHEVDMISFTGSTNAGKRVSELAAQTVKRVALELGGKSANIVLDDADIDELMPNAVQWAMINSGQTCSALTRLLVPRAILTEAETAAKTIAEAYTVGAPDDPDTTLGPLVSATQLKRVRGYIDRGVQEGATLITGGSEPVEGLAVGYYVKPTIFSEVTPDMTIHREEIFGPVLSIAPYDTEEDAVRIANDSEYGLRGGVWSRDVDRARAVAARMRTGQVMINGGEFNPNAPFGGYKQSGTGREFGTHGLEEFLEIKSLQF

SEQ ID NO: 2557 - protein, 389 aa, Mycoplasma genitalium G37
MAAGKRDYYEVLGISKNASSQDIKRAFRKLAMQYHPDRHKAENETTQKQNEEKFKEVNEAYEVLSDEEKRKLYDQFGHEGLNASGFHEAGFNPFDIFNSVFGEGFSFGMDGDSPFDFIFNRSKKRQQQIVVPYNLDIALVIEINFFEMTNGCNKTIKYERKVSCHSCNGFGAEGGESGLDLCKDCNGNGFVIKNQRSIFGTIQSQVLCSTCNGQGKQIKVKCKTCRSNKYTVTNQIKEINIPAGMYSGEALVDESGGNEFKGHYGKLIIQVNVLASKIFKRSDNNVIANVLVDPMVAIVGGVIELPTLEGIKEFNIRPGTKSGEQIVIPNGGIKFSKSFKRKAGDLIIIISYARPCEYTNLELKKLREFIKPNQEVKQYLNTLKNEYKT

SEQ ID NO: 2558 - protein, 486 aa, Cornus sericea
NPTTSGPGISTLEKKNLGRIAQIIGPVLDVAFPPGKMPNIYNALVVKGRDTAGQPINVTCEVQQLLGNNRVRAVAMSATEGLTRGMEVVDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMN

SEQ ID NO: 2559 - protein, 364 aa, Zygoascus ofunaensis
MMKALCYLGSKTIKWQTVAKPTLKSPTDVIGKLSALTLCGSDLHIIAGHVKESTDIAESQPGRGLILGHEGIIKVEEVGDAVKNFKRGDVCIVSCITSCGECYYCKRDLQSHCNRTEGTSGWILGHEIDGTQAEYVRIPYADQSLYKAPENVPIESLLMLSDILPTAYEVGVVSGNVKKGDTVAIVGLGPVGLSALLSAKALDPAKIIAIDMDDSRLEVARRLGAHETINPGKQDAAKLVHELTASEGKSSGVDVAIECVGVPATFEMCEDLLCPGGHLSNVGVHGSSVELKLQELWIKNISISTGLVSAYSTETLLQKVIDKKLDPTPLATHHFKLSEIEKAYDVFSHAADNQAIKMVITCDE

SEQ ID NO: 2560 - protein, 555 aa, Ipomoea trifida
MAETDDRRGDDQSETSDYTSEDEGTEDYRRGGYHAVRIGDTFKHGRYIVQSKLGWGHFSTVWLAWDTQKSKYVALKVQKSAQHYTEAAMDEITILKQIAEGDSDDQKCVVKLLDNFKHSGPNGQHVCMVFEYLGDNLLTLIKYSDYRGIPLHKVKEICVHILVGLDYLHRQLSIIHTDLKPENILLLSMIDPAKDPRRSGAPLVLPSSKTKIVSETGSSKDAKSSNGDLTKNQKKKIRRKAKRAAQRCAGKEASEEIEPDNEVCTPEDSNHDEKPDGDSVDDQTESKVQEDVSNKPSEAIDGHQEIQRHKRGSRSTRKKLLAEVDLKCKLVDFGNACWTYKQFTSDIQTRQYRCPEVLLGSKYSTPADLWSLACICFELATGDVLFDPHSGDNYDRDELLIIPSPYFTGSLGLNDGAPGDDATQGGRYSREFFNRYGDLRHIRRLRFWPLNKVLMEKYEFSEQDASEMADFLVPILDFVPEKRPTAAQCLTHPWIMGGPRNLVPSAINNSPPHGPENGKCIEKDERETMEARVGNIAIDGTPKSGKASQSTVNTT

SEQ ID NO: 2561 - protein, 291 aa, Triticum aestivum
  misc_feature (68)..(68): Xaa can be any naturally occurring amino acid
  misc_feature (208)..(208): Xaa can be any naturally occurring amino acid
MAKDEVMETGGGGDFAAKDYTDPPPAPLIDAAELASWSLYRAVIAEFIATLLFLYITVATVIGYKHQXDPAVNTAADAACGGVGVLGIAWAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVXLAPLPIGFAVFMVHLATIPITGTGINPARSLGAAVIYNKDKAWDDQWIFWVGPMIGAAIAAFYHQYILRAGAIKALGSFRSNA

SEQ ID NO: 2562 - protein, 303 aa, Mycobacterium sp. KMS
MSRPEVPIPYTAVVPAAGLGTRFLPATKTVPKELLPVVDTPGIELVAAEAAEAGAERLVIITSEGKDGVVAHFVEDLVLEGTLEARGKKTMLEKVRRAPALIKVESVVQAEPLGLGHAVSCVEPTLSDDEDAIAVLLPDDLVLPTGVLETMSKVRAKRGGSVLCAIEVPPEKISAYGVFDVEEVPDATNPNVLRVKGMVEKPKAEDAPSPYAAAGRYVLDRAIFDALRRVKRGAGNEIQLTDAIALLIEEGHPVHVVVHRGTRHDLGNPGGYLKAAVDFALERDDYGPELRQWLVERLGLTEN

SEQ ID NO: 2563 - protein, 174 aa, Prochlorococcus marinus subsp. pastoris str. CCMP1986
MKHTLSVLVEDESGALSRISGLFARRGFNIDSLAVGPAETKGISRLTMVVEGDNETLQQMTKQLNKLFNVLGVVDFTNLAAVERELMLLKVSSKEDTRSNILDIVQIFRAKVVDVSDIALTLEVVGDPGKLVALEKLLEPYGILEIARTGKVALKRSSGVNTEMLKINKYSLEI

SEQ ID NO: 2564 - protein, 174 aa, Vibrio vulnificus CMCP6
MRLFLIPVFVVAFYLPYSWAPFAAAMVFWVAGFTDWLDGMLARKLGQTSRFGAFIDPVADKVLVATALILITEHYHSIWVTIPAVTMIAREIIISALREWMAEIGKRASVAVSWVGKVKTMTQMFALWVLIWRYDDWMVWLGFGALYIATFLTYWSMVQYLMAAKDDLLNEEHH

SEQ ID NO: 2565 - protein, 383 aa, Glycine max
SARDFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQQPESVREITDVLDAVGNTTKATTKGFAIGSAALASFLLFSAYMDEVSAFAHEPFKQVDIAIPEVFVGGLLGSMLIFVFSAWACAAVGRTAQEVVNEVRRQFIERPGIMDYKEKPDYGRCVAIVASASLREMIKPGALAIISPIVVGILFRILGYYTGQPLLGAKVVAALLMFATVSGILMALFLNTAGGAWDNAKKYIETGALGGKGSEAHKAAITGDTVGDPFKDTAGPSIHVLIKMLATITLVMAPVFL

SEQ ID NO: 2566 - protein, 714 aa, Escherichia coli CFT073
MEMASAFTLNVRLDNIAVITIDVPGEKMNTLKAEFASQVRAIIKQLRENKDLRGVVFISAKPDNFIAGADINMIANCKTAQEAEALARQGQQLMAEIHALPVPVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKQDRPSSRPLPVRERILAGPLGRALLFKMVGKKTEQKTQGNYPATKRILDVIETGLAQGTSSGYDAEARAFGELAMTPQSQALRNIFFASTEVKKDPGSDAPPAPLNSVGILGGGLMGGGIAYVTACKAGLPVRIKDINPQGINHALKYSWDQLEGKVRRRHLKASERDKQLALISGTTDYRGFAHRDLIIEAVFENLELKQQMVAEVEQNCAAHTIFASNTSSLPIADIAAHAARPEQVIGLHFFSPVEKMPLVEIIPHAGTSAQTIATTVKLAKKQGKTPIVVRDKAGFYVNRILAPYINEAIRMLTEGERVEHIDAALVKFGFPVGPIQLLDEVGIDTGTKIIPVLEAAYGERFSAPANVVSSILNDDRKGRKNGRGFYLYGQKGRKSKKQVDPAIYPLIGAQGQGRLSAPQVAERCVMLMLNEAVRCLDEQVIRSVRDGDIGAVFGIGFPPFLGGPFRYIDSLGAGEVVAIMQRLATQYGSRFTPCERLVEMSKRGESFWKTTATDLQ

SEQ ID NO: 2567 - protein, 578 aa, Thiobacillus denitrificans ATCC 25259
MELINQLVLAGAVLLLVAVLASALSYRIGMPLLLVFLAVGMLAGEDGPGGIVFNHSGFAYMAGSVALAVILLDGGLNTRAESFRGSLRPAATLATAGVVITCVVTGFFAAWVLDFSYLQGMLVGAVVGSTDAAAVFALLRAKGLTLKERLAATLEIESGSNDPMAALLTLAFIALITAGRSTPGWETLALLIQQLGLGLIAGLGGGALLVWLTNRLRLERGMYPMMILAGGLLSYSLTTVLGGSGFLAIYLCGVVVSNRNPREASNILQVHDGLAWLAQIGMFLMLGLLASPHELVDNAAAGLAIALVLMLVARPVAVGLCLLPFRFSGREQIFIAWVGLRGAVPIVLALFPLLAGIPEASLILDVAFFVVLISLTVQGWTIPLFARLLQLEVPPAPEPNERHDLEASAESGHAFLGFKLPPNSTLIGQPANALWLPGAARPVAIARGNETLTPEIAGRLLPGDTLYLLAPSADCDTLSELLVAPVAPPHLERRHFYGVFVLHGDASMAAVAGQYDLPLPAGAAELTLAQFLTRTLRRHPGPGDRVRLGKLEFVVRTVVKGRITRVGLRIPTQLDRKR

SEQ ID NO: 2568 - protein, 241 aa, Neorickettsia sennetsu str. Miyayama
METCVQRFVVANWKMNGSQQLCDVFVNRFSAFAFNPEVEIVIAPPAVYLGQMRAAVMSSDLPLALGAQDCASGDNTPSTGDISSRMFKEVGARYVLVGHSERRTLHCESSKVVGMKANAGLRSRLIPIICVGQNNRPINRESLTKQCRDSIPMNSHDFIVAYEPVYAIGTGIVPSNEEIEEAVCLIKDAVGDAVPVLYGGSVSPVNCSEIFAVKNLGGVLVGGASLDPDSFIKICEVANRF

SEQ ID NO: 2569 - protein, 117 aa, Zea mays
  misc_feature (14)..(14): Xaa can be any naturally occurring amino acid
EEKWGPESRARLTXKDNKITNIEEIYLHWVPCKEHHTVQTLLPGLKDEVMNITPGQNHTPAWQSTQFMGFVSVRDCYCHVGLRVKCSKEASIIITSAIMLAKLYCSPMRRRYWGNTI

SEQ ID NO: 2570 - protein, 436 aa, Acinetobacter sp. ADP1
MSFVAYIYSPVTKGSTCTMGYQKIVVPVDGDRIKVNADLSLNVPNHPIIPFIEGDGIGVDITPAMKAVVDAAIVKAYGGKRSIEWMEVYCGEKANTIYGSYMPEETFEALREFVISIKGPLTTPVGGGIRSLNVALRQELDLYVCVRPVRWFEGVPSPVQHPELTDMVIFRENSEDIYAGIEWKADSPEAKKVIQFLQEEMGVQKIRFPEHCGIGIKPVSKEGTQRLVRKAIQFAIDNDKPSVTLVHKGNIMKYTEGAFKEWGYELAIERFGGELIDGGPWVQIKNPKTGKDIVIKDVIADAFLQQILMRPADYSVIATLNLNGDYISDALAAEVGGIGIAPGANIGGAIAVYEATHGTAPKYAGQDKVNPGSIILSAEMMLRDMGWTEAADLIIKGISGAIEAKTVTYDFERLMPGATLLTCSEFGQAIIKHMDD

SEQ ID NO: 2571 - protein, 277 aa, Bacillus cereus G9241
MNLTSLKDYTTLHNGVKMPWFGLGVFKVEDGSEVIESVKAAIKNGYRSIDTAAIYQNEEGVGQAIRESGISREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIATKYNKSTAQIILRWDLQNEVVTIPKSIKEHRIIENANIFDFELSADDMKAIQALNEDRRVGPDPDNFNF

SEQ ID NO: 2572 - protein, 432 aa, Saccharomyces cerevisiae
MTVNDKKRLAIIGGGPGGLAAARVFSQSLPNFEIEIFVKDYDIGGVWHYPEQKSDGRVMYDHLETNISKKLMQFSGFPFEENVPLYPSRRNIWEYLKAYYKTFIANKDAISIHFSTEVTYLKKKNSQWEITSKDELRTTKSDFDFVIVASGHYSVPKLPTNIAGLDLWFDNKGAFHSKDFKNCEFAREKVVIVVGNGSSGQDIANQLTTVAKKVYNSIKEPASNQLKAKLIETVQTIDSADWKNRSVTLSDGRVLQNIDYIIFATGYYYSFPFIEPSVRLEVLGEGVTGDKHSSVNLHNLWEHMIYVKDPTLSFILTPQLVIPFPLSELQAAIMVEVFCKSLPITTTFDSNACGTHNFPKGKDLEYYAELQELLNSIPRRVGHFEPVVWDDRLIDLRNSSYTDKEERNVLLAEHAQALKKKKAPYFLPAPHT

SEQ ID NO: 2573 - protein, 267 aa, Bacillus cereus G9241
MLTKHRILFIGAGRMAEAIFSGLLKTSKEYIEEIIVSNRSNVEKLKQLRARYNVSTATDWKQHVTSVDTIVLAMPPSAHEELLAELSPLLSNQLVVTVAAGIGPSYLEERLPIGTPVAWIMPNTAAEIGKSISLYTMGRSVNEMHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVEATNKKARGK

SEQ ID NO: 2574 - protein, 116 aa, Glycine max
MALRAAVLRHVRVPLQAAPKLQPWRAMSSHGDDHLSKEEVVERVLAVVKDFPKVDPSRVSPDVHFQKDLGLDSLDNVEIVMALEEEFKLEIPDKEADKIDSCHLAIEYISNHPMAG

SEQ ID NO: 2575 - protein, 341 aa, Bradyrhizobium japonicum USDA 110
MPTMKAAIVRQFGKPLVIEDVPVPQPGPGEVLVKVKACGVCHTDLHAASGDWPVKPVPPFIPGHEVAGIVAALGSGVKNLKVGDAVGVAWLHDACMSCEYCETGWETLCEHQHNTGYSVNGGFAEYVIASAAFAAKLPATIDFAGIAPILCAGVTTYKGLKETEAKPGEWVVISGVGGLGHVAIQYAKAMGLKVAAVDIADDKLELARETGADLAVNALAADAVDKVLAVTGGGAHGVLVTAVSTAAFAQALKMVRRKGTVSLVGLPPGEFPTPIFDVVLKRITVRGSIVGTRRDLDEAIAFAADGKVKAEVTKVPLAEINDVFDRMKAGKIEGRMVLDFG

SEQ ID NO: 2576 - protein, 515 aa, Escherichia coli O157:H7 EDL933
  misc_feature (187)..(187): Xaa can be any naturally occurring amino acid
MADSQPLSGAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKALIVMPTATADIKVDAVRGFGGEVLLHGANFDEAKAKAIELSQQQGFTWVPPFDHPMVIAGQGTLALELLQQDAHLDRVFVPXGGGGLAAGVAVLIKQLMPQIKVIAVEAEDSACLKAALDAGHPVDLPRVGLFAEGVAVKRIGDETFRLCQEYLDDIITVDSDAICAAMKDLFEDVRAVAEPSGALALAGMKKYIAQHNIRWRTGVAHILSGANVNFHGLRYVSERCELGEQREALLAVTIPEEKGSFLKFCQLLGGRSVTEFNYRFADAKNACIFVGVRLSRGLEERKEILQMLNDGGYSVVDLSDDEMAKLHVRYMVGGRPSHPLQERLYSFEFPESPGALLRFLNTLGTHWNISLFHYRSHGTDYGRVLAAFELGDHEPDFETRLNELGYDCHDETNNPAFRFFLAG

SEQ ID NO: 2577 - protein, 654 aa, Moritella sp. PE36
MFIDIILLLSLAVALVALFQRIHLPPILAYLATGVIAGPFGFQLIVEQADIELFAELGVVFLMFSLGLEFSLPRLLSMRHLVLGLGGGQVISVGVLFTVLGVFASLYWSQAFVVASALLMSSTAIVIKQLAESKLLNTRMSKLSISVLLFQDIAVVPFLIMIPLLAQQSGNVTLIAEQMGWALVKGLFAVFLILAVGRWILPAVFKEIALTRSDELFVMSTLLVALIAGLITHWLGLSMALGAFLAGMMLGEGPYRHQLEADIRPFRDVLMGLFFITIGMLLNLPSLLADWPRLIIVLVVMMLTKIVLVFILAKLLGESSSNALSTGLVLAQMGEFGFVLLALAGKLALLPLPLISTLVGVGIISMAMTPWLIDCHQEVVRRLLFQSKPRSKSGLSPPLPGQYIDHVIVCGYGRGGQTIARFLKIEGIPYTVIDRDPVRVQEALNGGEKIEFGDASRREIQMMLGVEKAKSIIITFKDTEKAIELLKIVKPLTEAKVLVRTTDDSNIQKLHDAGATDVVPESLEGSLMMVSHVLAISGVPIKRILKRLQYERQGHYNHLHGFYFGGESTMSFEESEVLERLHAIRLEFGAYAIGKTVAEVKLKEVSYRAIRRQGVELTQVHQDFIFEVGDVVLLCGPSRYVKRAEHCLLGGWAD

SEQ ID NO: 2578 - protein, 367 aa, Mycoplasma genitalium G37
MLSAGIVGLPNVGKSTLFSAITNLQVEIANYPFATIEPNTGIVNVSDERLDKLASLINPEKIVYTTFRFVDIAGLVKGASQGQGLGNQFLANIREVDLICHVVRCFQDKKIVHVNNTIDPVFDFEIIVNELIQADFELITNRIGKLKRKAESGDKIAKEEFVLLEIVLNGLKQGQMPIQTLSESELKTIKSLNLLTAKPILIVANVSENDLLNLDNNEALKKLNAFLDQKKIPKAITVCSLIEKELSGLKLEQRQYFLDELGLKNYSGLNRVIQAAYQTLNLWSFFTFGKKEVRAWTFKKGWNAPQCAGQIHSDFEKGFIKVEVISWDQLFAMKSLQEAKKQGLIRLEGKNYLIKDGDVCNFKFNVT

SEQ ID NO: 2579 - protein, 484 aa, Erwinia carotovora subsp. atroseptica SCRI1043
MSGNHLQDHELFKTGYFVAGKWQQGAATFEVVNPATGESIARVAKAGKKETQAAIDAAHAAFPAWKRKTAKERSEILYRWYELILENKRYLAELMTAEQGKPVQEAEGEVVYAANFIQWFAEQGKRVNGEIIPPAKPGSKIYATREPVGVVVAITPWNFPLAMLTRKLGPALAAGCTGVIKPANNTPLSAFALLALAQQAGVPDGVLNGVAGDTQAISDTVMASDKVRKISFTGSTAVGKTLVRNAADTMKKVSMELGGNAPYIVFDDADIQAAVKGAIANRFRNAGQVCVSANRFYIQDGVYDEFVSLLAEEVKKLKVGNGMDDGVVLGPLIDEAAVEKVEKHVNDAVEKGGKALVGGKRHKLGHSFFEPTVIVDANEAMLLAQEETFGPVAPCFRFKTEEEVIQRANNTPFGLAAYFYSQNLQRVFRVAEALESGMIGINECAVSTELAPFGGVKESGLGREGSVLGLDEFLEVKTWHVGGL

SEQ ID NO: 2580 - protein, 1156 aa, Gibberella zeae PH-1
MSTTKGASPIESIRECETARYDELLRATCRPIGQVTSADLSVCPDPILTSLAQLATYRTATERSLISLFDKNEQYIIAEATPTTSLIPNLATGQDGDEFWLSGTHIARKDGVCDYTLRVIEDTLHETGSDELPAVIVQDLVTDPRFSSSPYCQPGTIARFYAAVPIRSPRGVNIGVFCVINSKPGFDWTEKDTNILRTLSQTIMDHLENNYVKKVLKRKMQMSIGLRNFSNRRLLSSQTNSESATAKDSISINPGSAKQKQTENELQESQPTPYELRPAIRTFNSDSPEINHKSSVVTNPFLQAAIVIAESLQIDACMFFSGDSRELHAANSSATKTEDKNSLETSPHSPIICSGDKMKHHVAVQSLLPCQVLGSSSADSTNLSRDSALSQMFLAQLFKRYPEGCVFDFRSNQNVNFNRPPTSEDHARPDTKQDSQGFKHSRANSDDGLDELIHEKTHVLNAFPNAQTVAFTPIWDPQKGTWAIGGFMCSTKPHFEFDKDSELPFLRAIGTLAASEAFRLETSAADKAKSDILGSISHELRSPLHGITLGLELLNDSGLGVAQQNIAHMIETCCRTLCETTEHLLDFSKVNQTAQQQNPLNSVQNQSNPNGTGAGGLARPVSLDLLVEDVMESVSAGHDYQCLSMAEVFVNSKPRKHSDIRAIRQLDSMQAAEELNPTGSSNDLDQLQKRDVSVFLLYDPACSWYFHTVAGAIRRIVMNIFGNSLKYTSQGIITVSLTQSEPSIAGSQERTVTLVIEDSGRGISEEFLKNGIFKPFSQEDELSTGTGLGLSFVQKLTSQLGGRISIVSQHNVGTKVTVSLPLTLSPIQELPAEQPAEGQNTCRGLRARVVNNVKSLGHASPIVSAEDAVLETLCCDHIGMKLCTESDADRLAPDVIIVTNPTIYDLCRPAKPWRGLPVIVLCSNALVAHKYESACKLAGQTQLHDFISQPLTPLKLEKAISRVIGLWAELQDAPRMSVPMPLHSPYTPDTSATTSLPSPSETASLGKPATPATINSPFGTLTVADNYFQVPRFLLVEDNPINLKILTCFMNKLKQPYETATNGEEAVASYKANPGFFSCVLMDISMPVMDGLEATRQIRAFERYSNLSPALVLVITGLGSQSTRDEATRSGVDSYITKPAKLKELKEVLKSHGFTI

SEQ ID NO: 2581 - protein, 443 aa, Candidatus Pelagibacter ubique HTCC1002
MTKVAIIGAGPCGLSALRSFEQAEKNGEKIPEIVCFDKQEDWGGLWNYSWRTGSDQYGDPVPNSMYRYLWSNGPKECLEFADYSFDEHFGKPIPSFPPREVLYNYILGRVKKGNLKSKIKFNTTVTNVSYDNENFEVTYRDKKNDKISKDIFDYVIVSTGHFSVPFIPEYPGMKAFPGRIMHSHDFRDAEEFRGKNVVVLGSSYSAEDVALQCHKYGAKSVTIGYRHNPMGFKWPEGMKEVFHLDRLEGNKAIFKDGHVQETDAVILCTGYLHHFPFMSEDLKLKTGNRLYPPMLYKGVVWQNNHKLMYLGMQDQFHTFNMFDCQAWFARDVIMGKIKTPNDSEIEKDINKWVSMEEKLENADQMIDFQTEYTKELHELSDYPKIDFELIRKTFKEWEHHKVENIMTYRNKSFASPVTGSVGPIHHTPWEEAMDDSLKTFLNK

SEQ ID NO: 2582 - protein, 1244 aa, Ipomoea trifida
MQSNSLPFPLIPLTLFNGGELSEGGFELSRYLFLGSLLFSSPGGTAGGMDLSKVGEKIFSSVRSARSLGLLPASPSDRPEVPARAAAAAAVARVLAGLPPHQRHNLSSSSEELSSEELSSIYGSKPSKVLDDLEEEFYEEDFDPVRHVLEHIPTDENELAYFEEKAASRLAQLDRIAERLSRHVMQHHEVMVKGMNLVRELERDLKVANVICMNGRRHLTSSRNEISRDLIVHRNSKKKQALLDMLPILTELRHALDMQVALETLVEEGNFSKAFQVLSEYLQIMDSLSQLSAVQEMSHGVEVWLGKTLQKLDALLLGVCQDFKEESYTTVVDAYALIGDVSGLAEKIQSFFMQEVLSDTHSVLKTLVQKDFENSNVQGARLTYSDLCIQMPESKFRQCLLATLAVLFKLMCSYHAILSFQPVDKILCEVFCDINVSACQTLAMDKKQGEVFALAGDIQHVGTIAQTPVVSSTGEMPATCVSLTDNIAAFHPSNIDNGEEVRDGGETASSSGSPWFQLRKDAATFVSQTLHRGRRNLWQLTTSRVAVLLSSPVVCSTSIHQFLTMYEDLNTFILAGEAFCGSEAVEFRQKVKFVCESYFASFHRQNIYALKLVLEKENWLILPPEVTQVVSFAGLIGDGAALIASTSNSLDTRLGHAHKSNDLAQTNSKRSGFSNWLKNENPFLVKLNCSSNEYTDSYFPGSPSSREVGSSNGSYFKKDSTQENHAENHMNGSPSLSEDENEDLHADFIDEDSQLPSRISKPSRSRHRSTLSNDEEMTAQTGSSLTLLRLMDKYARLMQKLEFVNVELFKGISQLFGIFFHFVFESFVNQSTLPGGKVLTDMLPHKLKTALSRITQDCDQWMKPQSSPFNSSSPTSSNTPFTHMDVTPTSPPSLLAGASFSLKERCAGADTISLVARLLHRSKAHLQSMLLKKNSATVEDFYVHLVDVVPDLVEHIHRTTARLFLHINGYVDRIANAKWELKDLGLEHNGYKIFCRWKEALATRSGNMTTFTNCPTSVTIVATADCRIVMFSSYLRFSLLMIFSNMSCVNEKSSARQAEAPSANSSPRISMGAKVRSTAELVMQGVKISAFMKKEKMAVELTRVYVDLLLGEFKHYKTRLVTGGIQKEVQDLLLEYGLDNVAETLVEGLSRVKRCTDEGRALMSLDLQVLINGLKHFVSVDVRPKLQIVETFIKAYYLPETEFVHWSRAHPEYSKSQVVGLVNLVATMKGWKRKTRLEVLEKIE

SEQ ID NO: 2583 - protein, 181 aa, Ipomoea trifida
MAPPSSAATARRPRRFKLLTCIAIFLLGVIVVVGLTILIAWLVIRPRRLVYAVENATIQNYTLTSNNRLTATFNFTLEAFNPNTHAAVYYDAIEAQLFYDDQLIADHGAEPFFQPRQNVTHLDLSLPAKDVAVSANVARDFKVERTNGNVELELRVYSKVRLKVGVWKSGHRKLKVFRTLL

SEQ ID NO: 2584 - protein, 486 aa, Fouquieria columnaris
NPTTSGPGASVLEKKNLGRIVQIIGPVLDVAFPPGKMPNIYNALVVKGRDTVGQPINVTCEVQQLLGNNRVRAVAMSATDGLTRGMEVSDTGAPLSVPVGGATLGRIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMN

SEQ ID NO: 2585 - protein, 494 aa, Fouquieria fasciculata
NPTTSGPGASVLEKKNLGRIVQIIGPVLDVAFPPGKMPNIYNALVVKGRDTVGQPINVTCEVQQLLGNNRVRAVAMSATDGLTRGMEVSDTGAPLSVPVGGATLGRIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLK

SEQ ID NO: 2586 - protein, 476 aa, Cordia macrostachya
GSGISTLEKKNLGRIVQIIGPVLDVAFPPGKMPNIYNALVVKGRDIVGQPINVTCEVQQLLGNNRVRAVAMSATDGLTRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKAGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLIVARARKIERFLSQPFFVAEVFTGSPGKYVGLAETIRGFQSILSGELDGLPEQAFYLVGNIDEAT

SEQ ID NO: 2587 - protein, 575 aa, Ipomoea trifida
MEITSMTQAMQLHARILKSGAYDSNHGQDFHKLFTFSALSPSGDLNYARHILRTLHTPNSFYYNTMIRAYSDSTDPTRAFTLFLYMQNPDDASVAVPRPDHFTYPFVLKACSKSGHARFGKQIHGLVFKSGVGSDRYINNALIHLYSVSGEPNLAYKVFDKMPDRDVVSWTSIIDGFVDNDRPIEAIRLFTHMIENGIEPNEVTVASVLRACADTGALNTGERIHSFVKEKNFSSNANVSTALIDMYAKCGCIDGALEVFDETLEKDVYVWTAIIAGLASHGLCMKAIEFFENMKKSDVKMDERAITAVLSAYRNAGLVSEGLLFFRRLKKHKIKPTIQHYGCVVDMLTRAGRLKDAEEFIRKMPIEPDAVLWRTLIWGCKILGDVERSERLVRELELLNMDSRDTGSYVLLENVYAATGKWEEKAKTRELMYQRGLMKPPACSRIEIDGVVHEFTAGDSRHDEATAVYEKLEDVEERLRGEGYNPIVSEVLLEIDDDEKASQLLHHSEKLAVSFGLVKSSPGSVIRIVKNLRSCEDCHSFMKLISKVYQRDIIVRDRIRFHHFSGGNCSCGDRW

SEQ ID NO: 2588 - protein, 674 aa, Candida albicans SC5314
MNFLYNNSDYSSTSHTMKSPSAYNQFPKLQASNSTAGNNNTATTATAAAAAASASASASVTPQLISPTTLTTPQNKYKRGGLDNTLPKIETTRKNRPDDGNSITPSNSINSGTTKLTLPPRRVWVKKPQTNNPTTVLCYVNDIIDDLKVAVVNKYPNTIGRYEDAADLLVKIDLNNIRVPVSPSVNRVSQRTPFDNCIILEPDQNVWQILDNYFPNGMAMHDALIIETPTFKPDHQMLTPITANMNNNSNTFIPFQERQSSIGNNNNNNSNVNNNNKAQAVKHPQPMQPNNTRVGLHKSYAMNRSSFSTNNNPVPSIIKDRSVSPSNLGVSRNSPVSHKRSYSNPVSSPNSVATQANNPSAVLLLPRNFSLANNNSNQASQSSGGTPAKKVLSEDGSKSVNDKTEEVVSSKLKPNDNNKSYQAKQQEQQTAEQSENGFSETSASPEAVHNSKAAPLPLTKSSTTATTTSSNSISNNNNTSSKGKPSQSKLKAANDPTPTDIVLPSISVLVVEDNAINQAILGAFLRKRKIHYQIAKNGQEAIDKWKKGGFHLVLMDIQLPVKSGIEATKEIRHLEKLNRIGVFHENEIGKNVIINEEDRLTSNTFRSPVIIVALTASSNSSVDKTNALTAGCNDYLTKPVNLVWLQNKITEWGCMQALIDFDGWKDKNRRLNKA

SEQ ID NO: 2589 - protein, 530 aa, Oryza sativa Japonica Group
VHQSHRNTSHIRELSLAMDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGEVRAMVRRMYRAAAASPAGAARIQLKRRLFEVSLSVLMETIAHTKATRPETDPDTDMSVEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 2590 - protein, 295 aa, Neisseria meningitidis
MPCMNHQSNSGEGVLVAKTYLLTALIMSMTISGCQVIHANQGKVNTHSAVITGADAHTPEHATGLIEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSL

SEQ ID NO: 2591 - protein, 337 aa, Neisseria meningitidis
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGF

SEQ ID NO: 2592 - protein, 338 aa, Bacillus clausii KSM-K16
MSILVTGGAGYIGSHTCVELLTEGYDVIIVDNFSNSGPDTVNRIEEITSKKVKTYDINLLDSSRLETVFAENNIEAVIHFAGLKAVGESVEKPLHYYETNIGSTIQLCKTMEKYGVYKLVFSSSATVYGLPEQVPIEENAPLKAVNPYGNTKIIIEDMLRDLATSNNNWRISLLRYFNPIGAHKSGLIGEEPSGIPNNLMPYITQVAAGVREQLSVFGDDYPTKDGTCIRDYIHVVDLALGHLQALKKIETYTGVQAYNLGTGTGYSVLEVVDAFEKATGITIPKKIGPRRPGDAPVSYADPTKARTELQWEAKRTLIEMCEDSWRWQVHRKAQLESK

SEQ ID NO: 2593 - protein, 351 aa, Physcomitrella patens subsp. patens
MSRSTATCAEYSWESLHLAQTATAARVVEGHWILEVALGGSAMGTGYTIAEIVVYPVKGCRGVSVPSAAISFTGFLFDREWMVVKAENGRAITMSRAPKLALVQPSLPTIAMRGESVPASATLEINAPGMKALNVPLRKCPSTGKARQGERGHIVDVGMPTLKGVYEGQGVDEGPEAAAWFTQYLDIPARLVRFDPSIAVTLFLHQIMCDFCKGFVMNVMRHAISSIRVISSLLLVDHLLYSPVLVPTINQDKPDLENVEPNKTMFTFRSGPHVGLEFEKVKKVYFGSYFVCDSTISTASNSKPHVIDVGDNLNVITTKHDDVSVNHASPKSGSLESNMDLCGPRPVELMY

SEQ ID NO: 2594 - protein, 276 aa, Acinetobacter sp. ADP1
MKMYQVDAFTQHLFKGNPAAVIIVQDWLDNALMQSIALENNLSETAFVKVRDHENYEIRWFSPTNEVAFCGHATLASAFVLFKDFTSAKTIQFHVKNLGVFIVTQAQDGKILMNFPVRRAQRLDEYPTILDEALHKPIKAVYLNPQAYIVEYESVQDVLDEQPDLVKLKSLGQLRTAVTASDAMLDVAITATNLGSYDCVSRYFAPAIGINEDPVTGSIHTAIVPLWAEKLNKTELIAYQASSRGGELYCRMLDNERIEISGYAVLYMQSEVYLNI

SEQ ID NO: 2595 - protein, 1058 aa, Yarrowia lipolytica CLIB122
MTFKYLVLEYIEGGELFDYLIKKGRLEEYEAASYFLQIINGVDYCHRFNICHRDLKPENLLLDKNRNIKIADFGMAALETDRMLETSCGSPHYASPEIVAGKTYHGAPSDIWSCGIILFALLTGHLPFDDDNIRRLLLKVQTGKFNMPSELSPYAKDLIWRMLRTDPTTRITMDEIFQHPFVRKYSGGVTPTHIHAPSYEHVARPVASVQDIDIEILKNLQILWHGEDAEIIMQKLLSPDANPEKTFYCLLMKYRHDHAAAVAATAPPTLQQQQSQEMQPAMHKSHSHSSRKQHKRKTSHNSHRLGSRGSLVSVSSAHKRGVSFTHVKKRSQQSIRSMRGSASNSVVASPRKQTASAPVSAGTAPIPFNVNVPYTEAPATAPAAPTTAAATSTATRAPAQPLAPTQAVQSPPRQSQPVHQQPPTSRRAPISSAPSWLTRSPPASKDADFEAFLDSAFNKPVKTKKSYGSLLGSPVDARRHVTDPANTSIASRTAAGATAANTSKRAVTMAYNDEFEFERPMSLFDPREVGGDTGRAQQPSVSRAQTISHTHTHSRERVANAHSDTPNYLPMIFEEGDRFADAIEEEFHLNISDNTLSAPSTNHTTPMLGGDRKSSEWENLFDFTERGDQVVVGEDSLLDISFHRDNANEATPVAPAATHVGRESTELYKDLQFPEIPVVDRDETAVESMPRTQSKMKISGQMQTDNFMKRPSSINLNGHLSQSNLSRQTTSASQRRPLVSRDMNTHAASPREAAKPVRQLQAAAELHERRPVEVLQKQQPQQQQQHHHQQQQQTQHQLQPAPVFREKPVVSAPRRPAPAPPVQSVADTMVLPMHQQQQNNSQFTIPAPVQTQPPQSKSSRTKSFIRRFGFAPKREAPVAPTSKVTMIQSSDYGAAPGVNANAHMNAQKDPAAPAAHAAAHAAHTSGTAPATGDPWNVTQSWFMKMFSRPNVAPRQPPQTLYSTLTSQQLEDEIVALLASWRKYGISNLSVSHSSIKCQISSRNALKIKSAKLHIDIGPLKHTNSFAHFFHDRGSQGSFTQLYDQIKAHLVSQGLLINN

SEQ ID NO: 2596 - protein, 367 aa, Lentinula edodes
MDDRTTAFIVGSSYQPLDIIGEGAYGVVCSAVHIQSQRKVAIKRITPFDHSMFCLRTLREIKLLRHFQHENIIGILDILKPNLGPDGSLDGMTEVYLVQELMETDLHRVIKTQELSDDHCQYFIYQTLRALKALHSADVLHRDLKPSNLLLNANCDLKLCDFGLARSASPLPDHPVDASTFMTEYVATRWYRAPEVMLTFKQYTKAIDKWSLGCVLAEMLSGKPLFPGRDYHHQLSLILDVLGTPTLDDFYAISSSRSREYIRALPFRKKKVFGKPVHEGGVKGFEGKNPLAIDLMEKCLSFNPKRRIDVEGALAHPYLAPYHDPSDEPGAERIDSEFWSFDTFNNGKGLSKEELKVLIYEEVMRGA

SEQ ID NO: 2597 - protein, 200 aa, Triticum aestivum
APREAGLGSPHIIPFNGERGSKKGFSFRKPHACTFEPSKGPQPGKGRSFSFPNPEKVPPGEPTKQYLKAISELHPTGGFHTSRKGPGKKDKDKKPGIIVVQGPKPGKATDMARMRQILSKLKHTPPPHMKPPPPPAVAPAGKDGAPAAAGKDGAKAAATPAAKDAPANGTVPEKENAPPAAAAAPAAAAPAPPAEPIAAA

SEQ ID NO: 2598 - protein, 507 aa, Saccharomyces cerevisiae YJM789
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMGECGQRGGYMEIIGFSQEIRDALFKLMSISICSVVTGQAVVDLMVKPPQPGDESYEQDHDERLKIFHEMRTRANLLYETFKELEGIECQKPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 2599 - protein, 145 aa, Oryza sativa Indica Group
MASSGDSSGKQRSDEEWRAVLSPEQFRILRLKGTEYWFLVENIQALETGEYNKFYGDGVYNCAGCGTPLYKSTTKFDSGCGWPAFFEGLPGAINRTPDPDGRRVEITCAACGGHLGHVFKGEGFKTPTDERHCVNSVSIKFTPAS

SEQ ID NO: 2600 - protein, 604 aa, Francisella tularensis subsp. tularensis SCHU S4
MERREKRIRKLRNKSGKVFAIETNLTGRQLLNNRVLNKDVAFSQEERVAFDLIGYLPEKVESLEEQAIRVRRQLDLKPNSLEKYVFLNRLHDLNTTLFYHFVRENLEEIMPIIYTPTVGEAVQKYSSSFRKQSGLFISISHKKHIARILERYEYNSIDLVLVTDGEAVLGIGDQGIGGMNISIGKIMVYVAASGIDPARVLPVQLDMGTNNDALLNAPGYLGVRLPRVSGETYDEFIEEFVTQVKARFPNVFLHWEDLGRDNATRILEKYKDKLCTFNDDIEGTGIVATANCIAGVKTASTIRINAGEITVEEALSGICDIKVVIFGAGSAGCGIARQLADVIADRAGVSIEKARSSIYLVDRYGLVCDRLRAKRITPEQKLFVKTREEIDKWKVEDFNYITLEETVKNTKCDILIGTSGQPGSFTKEIIKTMAKNNNYPIIMPLSNPTSLCEALPEDIIKWTNGKALIAAGSPFPDVTYNGRDYRISQGNNAFIFPGLGLGSVAVHARVLTKGMIRAASYRLSELSPMVINEDITQPLLARITDLVDVTKEITKAVAKQAILEGVHGVDIDLEDLTETELDEEIERLINLSSWTPTYAPYMPI

SEQ ID NO: 2601 - protein, 499 aa, Arabidopsis thaliana
MSLSLYDSAHSLDGKSGWDTPVFSMKDSMDRNPMVTEAWEALCQSQVYFRGKPVGTIAAYDHASEEVLNYDQVFVRDFVPSALAFLMNGEPEIVKNFLLKTLHIQGQDKMIDKFKLGDGAMPASFKVLHNPIKKTDTIIADFGESAIGRVAPVDSGFWWIILLRAYTKSTGDHSLAERPECQKGMRLILSLCLSEGFDTFPTLLCADGCSMVDRRMGIYGYPIEIQALFFMALRSALSMLKHDSEGKEFMEKIVKRLHALSFHMRSYFWLDFQQLNDIYRYKTEEYSHTAVNKFNVIPDSIPDWIFDFMPLRGGYFVGNVSPARMDFRWFALGNCIAILSSLATPEQSMAIMDLIEARWEELVGEMPLKICYPAMESHEWGIVTGCDPKNTRWSYHNGGSWPVLLWLLTAASIKTGRPQIARRAIELAEARLLKDGWPEYYDGKSGRFIGKQARKSQTWSIAGYLVAKMMMDDPTHVGMISMEEEKHMKPPLRRSSSWT

SEQ ID NO: 2602 - protein, 394 aa, Oryza sativa Japonica Group
MSGSAATLGMRCGSYGSLASAGGGRKGGGRGWGWRGGGEKERLQLLHRALRLVGRRRAGVLLLLAAASAAVFCSIFAVVKDDNASMIIANNYEVANTIQNSVYPSMTRPLMTSSDQFSASSVNKTELPNRLRLSFANFTHHPCEGFSVAPPLVDPKRTGPRPCDVCYVPVDQAFALMPPQPSPSPVLKNLSYVFEDNITANFSNQGSVFGGHPSLEQRNKSFDISESMTVHCGFVRGKKPGQGSGFDINDDDLLEMEKCRELVVASAIFGNYDMIQHPRNASEFSKANACFYMFVDEETEAYVKNSSSLYRNNKVGLWRLVVVRNLPYEDPRRTGKIPKLLLHRLFPNVRFSVWIDAKLKLVVDPYLLLERYDLCEDLGLLYAISLRRETCHVL

SEQ ID NO: 2603 - protein, 634 aa, Ipomoea trifida
MHLIANSTIQHTPSNPHMQATLLSFEVSSRAPIGIFYTSQLDHLKVKGKNSRVKCFKDLGTITSSSKLCAVRDFYGLEKPNLLRCYCQPAERGNERIFEDEQGRSVHSIAPNGQTSDAAQQFKNDNGTVPSSKTVNNALPKSSTNSIEEEAWNLLRASMVYYCGNPIGTIAANDPSDSSILNYDQVFIRDFIPSGIAFLLKGEYDIVRNFLLHTLQLQSWEKTMDCYSPGQGLMPASFKVRTVPLDNDENATEDVLDPDFGEAAIGRVAPVDSGLWWIILLRAYGKCSGDLSLLERIDVQTGMKMILKLCLADGFDMFPTLLVTDGSCMIDRRMGIHGHPLEIQALFYSALLCAREMLAPEEASIDLITALNNRLLALSFHIREYYWIDVKKLNEIYRYKTEEYSYEAINKFNIYPDQIPPWLVEWMPSKGGYLIGNLQPAHMDFRFFSLGNLWSIVSSLATTDQSHAILDLIETKWEDLVANMPLKICYPALEGQEWRIITGGDPKNTPWSYHNAGSWPTLLWQLAVACVKMKRPEIAENAIKVAERRIAGDKWPEYYDTKRGGFIGKQARLFQTWSIAGYLVAKLLVANPEAAKMLITIEDTELLSAFSSILSSNPRRKRSRKGAVKQSYIV

SEQ ID NO: 2604 - protein, 169 aa, Bartonella henselae
AAESLSLPLYRYIGGTQAHILPTPMMNIINGGVHADNPIDFQEFMIIPVGASTLKEAIRYGAEIFHTLKKRLKDAGYNTNVGDEGGFAPQFKSAEQAIDFIMESIIACGYKPGEQIALGLDCAATEFYKNGSYFYEGEGKYRDVGEQVDYLAQLIKTYPIITIEDGMAE

SEQ ID NO: 2605 - protein, 420 aa, Escherichia coli O157:H7 EDL933
MSFATISVIGLGYIGLPTAAAFASRQKQVIGVDINQHAVDTINRGEIHIVEPDLASVVKTAVEGGFLRASTTPVEADAWLIAVPTPFKGDHEPDMTYVESAARSIAPVLKKGALVILESTSPVGSTEKMAEWLAEMRPDLTFPQQVGEQADVNIAYCPERVLPGQVMVELIKNDRVIGGMTPVCSARASELYKIFLEGECVVTNSRTAEMCKLTENSFRDVNIAFANELSLICADQGINVWELIRLANRHPRVNILQPGPGVGGHCIAVDPWFIVAQNPQQARLIRTAREVNDHKPFWVIDQVKAAVADCLAATDKRASELKIACFGLAFKPNIDDLRESPAMEIAELIAQWHSGETLVVEPNIHQLPKKLTGLCTLAQLDEALATADVLVMLVDHSQFKVINGDNVHQQYVVDAKGVWR

SEQ ID NO: 2606 - protein, 474 aa, Brucella melitensis 16M
MKIAVIGTGYVGLVSGTCFAAWGHEVVCGDKNARKIAVLERGILPIYEPGLDELVERNCAEGRLRFTCNLAEAVRGAEMVFIAVGTPPRAGHGDADLSFVYMAARELAPLIDENAVVVVKSTVPVGTGDIVQKLIGSVRRAGTFSVASNPEFLREGVAIRDFLYPDRVVIGVEDERARKALLDLYGTPLKEQKTPIVVTQRRTSELIKYAANAFLATKITFINELADLCEHVGSDVSQLALGIGLDKRIGESFLNAGPGYGGSCFPKDTLALLRTAQDHGVALRIVEETVTANEARKRRMALKVLDALGGDVEGLTIAVMGLTFKPDTDDMRDAPSVPLIETLQRFGARIRAYDPIGAENARNILSDVELCDDPYECVRAADAMVVITEWDSIRRLDLSRVRQAMRQPVLIDLRNAYEPNVAENLGFRVSAVGRAATARHETSIKDALSLLASRSRRADSAEELVPEGGGSNDL

SEQ ID NO: 2607 - protein, 286 aa, Ipomoea trifida
FYVAEVLLALEYLHMLGVVYRDLKPENILVREDGHIMLSDFDLSLRCAVNPKLLKSSSPVGQPPKKMSSPCSDSSCIEPFCLHPSWQVSCFTPRFLSAAAKTRKLKADIAAQVTPLPQLVVEPTSARSNSFVGTHEYLAPEIIKGEGHGSAVDWWTFGIFMYELLYGRTPFKGTTNEDTLGNVVSQCLKFPETPMISSHARDLIRRLLQKEPENRLGSSKGATEIKNHSFFEGLNWALIRCATPPEMPRIFDLGNLISDTNSQKKQGGKCQKEGTSGEENIEFEMF

SEQ ID NO: 2608 - protein, 708 aa, Idiomarina loihiensis L2TR
MSQDKAFTMEVRDDGVAVITIDVPGESMNTLKDSFAEEVGSLMNRLESDDSVKGVVFISGKPGSFIAGADINMIDGCENAVDAESLARKGQAMFDRIEQLNVPVVAAINGACLGGGLELAMACHVRVCTDNSKTALGLPEVKLGLLPGSGGTQRLPELVGVQQGLTMILTGKELRAKQALKAGLVTEVVPQSILLDVAVEHALKRKPKSTKPPLKGISKVLEATKFGRDIIFKKASEQAQKKAQGNYPAIDKIIQTVREGVERGREAGLDKEARSFGELAMTPESYQLRQIFFATTEMKKETGADGVKPDSVKRVGVLGGGLMGGGIAYVTAAKAGIPARIKDIAEDGIRHALHYSYERLDKKVKRRHMRRAELEKTMLMLSGSLDYSGFERTDVVIEAVFEDLNLKQKMVADVEEHADESTIFATNTSSLPITQIAAKAKRPEQVIGLHYFSPVDKMPLAEIITHPGTSDKTIATTVSLAKKQGKTPIVVKDGAGFYVNRILAPYMNEAARLLLAGEPIEHIDKTLVKFGFPVGPITLLDEVGIDVAAKVAPVLVKELGDRFEAPEAFEKLIDDDRKGKKNQKGFYQYGKSVKGKPVDTSVYSLLDIDPNESKSADEIIDICLLPMLNEAAYCLQEEIIRSPRDGDIGAIFGIGFPPFLGGPFRYMDSQGLETIVNKLEKLAAERGERYTPAPLLKQMLENGWNFYQ

SEQ ID NO: 2609 - protein, 381 aa, Mycoplasma hyopneumoniae 232
MTNFKNNFPFLNKVTYLDSAAMMQKPLSVIKKISDFYLNSAINIHSQNSKIGYENSDKIGKIREKIARFINAESEEIIFNSGTTEAINLFANMIKKFLKKGDQILLSPLNHSSNLIIWIKIAAKIGAEIIYSKKIIDKISPKTKIIAFSQTNNSILVNLNLVEIWKKAVKYDAFVFNDATQAINYQKVSLKLCHGLAFSSNKFYGPTGLGVLAIKKELLNKLEPVKFGGGTVAEISSKNIVYYNGYRKFEAGTLNLAAIWGLGAAVDFINAIGIKKIAKKLQVLSIYLYEKLEKIEKIEIFSKKGNHIIIFNIKEFNASDVVSYLGNNNIYVRSGTFCVPFLEKILKKRSFIRVSLAFYNDFNDIDRLISVLEKKEFLNFV

SEQ ID NO: 2610 - protein, 723 aa, Oryza sativa
MANSIAIFRRSTTYGPLQKAALTTICCMLAVAAGPNPQECLPFSCGDLGNISYPFRLQGDSRQCVSTPRPWYNLSCSRGKATIHINTRKYYVISINYTRENFLVVDATMQLDDDTNGTSCPLPRSDHLPYMIYWSDLSSIDSYGFKDLVTASDTWACFVNCSRAITNDSRYRPFTCLSGNNSFPYVYVYIYDDYGCCPVKRLQPSCRYLGMIPFDYVYQPGSYDDDIMSNVLQSASYRDIVGFIRKGFRVNFPLYNNDQRAPTIVERCLNNSMSYFKDQISGASIPHLTRALFWTEIHFVQCVSTNHDYTIKLFSVVITIVSAIDVTKLLFVLCRFVLAPLVVLTFLAHKYWKTRIAIDAVEKFLRMQEMLGPKRYAYTDAWAITSHFRDKLGQGGYGSVYKGVLLPGDIHVAIKMLDGKSDCNGEDFISEVATIGRIHHINVVRLVGFCSEEMRRALVYEYMPRGSLNRYIFSSERSFSWDKLNEIALGIARGINYLHQGCEMQILHFDIKPDNILLDDNFIPKVADFGLAKLYPREKSFVSDRALRGTFGYMAPEMACRSFGVISSKSDVYSFGMLLLEMAGGRKNADPNANSNSSRAYYPAWVYDQLIVDQQVDEISSAIDMHEKERKLWLVVFWCIQMKSYDRPTMSEVIEMLEGDVDALQVPPRPFFCDGDSTPPPPVPVMDSICLYSSELTAISEEEDVDGITQLDSSCLLGYERSI

SEQ ID NO: 2611 - protein, 303 aa, Oryza sativa
MKVAVDQGSSGSVEAKRRREAKGRRRSGGGGGGGGGGGGGGRAVVRRTRRRVLLRTPEPAPLLKRLFAACRDVFRGPGTVPAPDDVALIRGILDKIGPGGVNLSAEHNFFKATDAAALADPLAITRTTIYTCTNFSIVIFFLPPTAVIPLHNHPGMTVFSKLLLGSLHIKSYDWAEPAVFAAGSGDRLRLAEVVRDGGFSAPSDTLVLYPAAGGNMHQFTAATPCALLDVLGPPYSEDRDCTYYQDFPYSHCPSDDIAELRRHGGGMDDEQISRMRQLGWLKETAMPKDLEMYEMPYRGPPIL

SEQ ID NO: 2612 - protein, 88 aa, Vigna radiata
MKLSFAAMLLLCLLLSFSFFQLSSAASGFCSSKCANRCSKAGRKDRCLKLCGICCSKCKCVPSGTYGNKHECPCYRDLKNSKGKGKCP

SEQ ID NO: 2613 - protein, 432 aa, Myxococcus xanthus DK 1622
MRIAIIGTGYVGLVAGTCFADSGNDVTCVDIDERKIRMLQAGEVPIYEPGLEELIKKNVREKRLFFTRDLTEAVTNAQVVFIAVGTPEGESGDADLQYVLAAAEQIGKAMKQYTVVVDKSTVPVGTADKVREAIRKVTDIEFDVVSNPEFLKEGAALDDFLKPDRVVIGVDSERARKVMADLYSPFVRTENPVLFMDTRSAELTKYAANAMLATRISFMNDIAALCEKVGADVDFVRKGLGSDKRIGYPFLFPGVGYGGSCFPKDVKALVATARDYGLELDLLRAVERTNERQKKLLVTKAAKHYGSLEGRKFGVWGLAFKPKTDDMREAPSIEVIEGLIGKGAQVIAHDPVSPHTAKRVFGDRIRYASVPYEALEGVDGLFVVTEWNEFRHPDFERMKTLMKSPVVFDGRNVYDPARMRELGFTYYGIGRR

SEQ ID NO: 2614 - protein, 361 aa, Glycine max
MMKFQACSNPISNLFYACCVLLLPPTMALGDCTCDTKEATKSDSIEVLHYKIGSIASVLVAGALGVSLPLLSKRIPTLNPKNDIFFMVKAFAAGVILATGFVHILPEAYESLTSPCLKENPWGKFPFTGFVAMLSSIGTLMVDSFATGFYHRQHFNPSKQVPADDEEMGDEHAGHMHVHTHATHGHAHGSAVSPEGSITSEVIRQRIISQVLEIGIVVHSVIIGISLGTAGSIDTIKPLLVALSFHQFFEGMGLGGCISQAKFESKSTVIMATFFSLTTPIGIAIGMGVSSVYKENSPTALTVEGIFNSASAGILIYMALVDLLAADFMSPKLQKNLKLQLGANISLLLGAGCMSLLAKWA

SEQ ID NO: 2615 - protein, 745 aa, Myxococcus xanthus DK 1622
MAAERLQKYLARAGVASRRHAEELITAGRVAVNNKTVTELGSRVEPGTDLVTVDGTLVTPPDESSYFLLYKPVGVVTTLSDPQGRPTVANYVEETGKRLFPVGRLDYDAEGALLFTDDGALAHKLTHPSFQVPRTYLAKVKGAPDTATLDKLRGGVRLEDGMATPVSVSVFEAAERNTWLKIVVAEGRPHLIKRLCAAVGHPVVRLFRPSYAGVGVEGLRPGELRPLKTSEVELLNAVSDGKAAPPTGELRLPPRRHGRAAPGFDSDDEAELSMDDDAPVAAKPARKAPARAAKTATVGGSSLARFGRPKGASAEGKPARRSFGGDEGAPRGRSFGGDKAGAPRGRSFGGDEGAPRGRSFGGDKAGAPRGRSFGGDEGRPARRSFGSDEGKPARRSFGSDEGRPARRSFGGDEGKPARRSFGSDEGRPARRSFGGDKAGSPRGRSFGSDEGRPARRSFGGDEGKPARRSFGGDEGRPARRSFGGDEGRPARRSFGGDDGAPRGRSFGGDKAGAPRSRGAGRSFGGDEGGPARRSFGGDAGSGPRSRDTGARGAGRAFGGAGGARRSFGGDEGGAPKSRGAGRPERREWSAGGDAAPRTRAPRAGGEGRPERKSWGAGAGASRAPRGEGRPYSPRSGGAGAGRPERREWKPRAEGADAPRGRGGPRREGSEGGRPARSTWTPTDESGNPRERVVRAGARKGPPAEKSGGFQDWGKKKERASAPSWSNERPRGGAGRPPPRGPRRPR

SEQ ID NO: 2616 - protein, 203 aa, Nocardia farcinica
MTKNQAGVMTSATAGLNLSDSVYERLLRERIIFLGTQVDDDIANKLCAQILLLSAEDPTRDISLYINSPGGSVTAGMAIYDTMQFAECDIRTVGMGLAASMGQFLLTAGTKGKRYALPHARIMMHQPSAGIGGSAADIAIMAEQFAHTKRELNELQALHTGKSVEQVTADADRDRWFTAQEALEYGFIDHVISHANQANGIGG

SEQ ID NO: 2617 - protein, 282 aa, Myxococcus xanthus DK 1622
MEQRPFGSTRVSVPVLGQGTWQMEEDDRAGAIRALRAGLDLGMTHVDTAELYGYGKVEESIVSEAIAGRRGDVFLVSKVMPSNASYAGTLAACERSLKRLRTDHLDCYLLHWPGSHPLEETVRAFEKLVVDGKIRAWGVSNFGVEDLEEALALAGPGRIACNQVLYHLEERAIEHAVLPWCEAHGVAVVGYSPFGNGRFPRPDSRGGKVLGGIARAHGVTPYQVALRFLVRGPSLFAIPKASREAHARDNAAAASLTLTADELAHLDAAFPLGPEPASLPVI

SEQ ID NO: 2618 - protein, 465 aa, Burkholderia xenovorans LB400
MPIQSLIEADRKHLIHPVINYRVHEARGVTVLESASGAFLRDAAGNELLDAFSGLWCVNVGYGQQSIVEAATAQMQKLPYATGYFHFGSEPAIELAQKLVEVSPASLQHVYFTLGGSDAVDSALRFITHYFNATGRPSKKHVIALQRGYHGSSSTGAGITALPAFHRNFDLPLPNQHHLPSPYAYRSHFPDDAALIAASVAALEAKVAELGANNVAAFFCEPIQGSGGVIVPPAGWLKAMRESCRKLGILFVADEVITGFGRTGPLFACQGENVEPDLMTVAKGLTAGYAPMGAVLMSDEIYQGIADGDAEAVVGHGHTYSAHPVSAAIGLEVLRLYHEGGLLANGVARAPRFARGLDALLAHPLVGDSRHRGLLGALELVADKDSKAGFDPALKLSDRIAAAAYENRLIFRAFGDNILGFAPALSYTEGEFDLMFERLEKTLDDVLAQADVRAALKLRTHAAAC

SEQ ID NO: 2619 - protein, 391 aa, Xylella fastidiosa 9a5c
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 2620 - protein, 93 aa, Oryza sativa Japonica Group
MKLNTTTTLALLLLLLLASSSLQVSMAGSDFCDGKCKVRCSKASRHDDCLKYCGVCCASCNCVPSGTAGNKDECPCYRDMTTGHGARKRPKCP

SEQ ID NO: 2621 - protein, 259 aa, Pseudomonas aeruginosa UCBPP-PA14
MELTIFQVDAFADSPFQGNPAAVCPLDAWLDDERLQAIAEENNLSETAFVVGRDGDYRLRWFTPQVEVDLCGHATLATAWVLIHKLDDASPVLRFATRSGELSVRREGDSLAMDFPAKRPEPCATPDGLLEALGIVEAEVLKTDDYLVVVDDEKTIAALAPDFARLKGLPCRGVAVTARSQRFDFVSRWFGPNVGVNEDPVTGSAHTSLAPYWAQRLGKTRLSAEQGGARKGRLECDVRGERVVISGKAALYMSGTLHL

SEQ ID NO: 2622 - protein, 581 aa, Thiobacillus denitrificans ATCC 25259
MTDLFGESASPAMALARKWRPRAFADLRGQEHVVQALSNALTQGRLHHAYLLTGTRGVGKTTLARILAKCLNCESGVSATPCGTCSACTQIDAGRFVDLLELDAASNTGVDNMREVLDNAQYAPTVGRYKVYIIDEVHMLSKPAFNSMLKTLEEPPAHVKFILATTDPQKIPVTVLSRCLQFNLKPMTPALVAGHLGDVLAQERVDAEPAALNLLARAAAGSMRDALSLTDQAIAYGGGRIEAAAVEAMLGTVRRDYLFDLLDALAAGDGDALMTQARLLAERGIAFDATLQDLGNLLTQLALVLHAPGAVEDGADAERTRAAAEKLDAETVQLYYQIALNGRRDLPYAPDEFSGFCMTLLRMLAFAPATDPTPRSPGGGRAPVASADSTPAAAPLAAPAPARVPAAAPAPLQQPEAARQVASAEPLAAEDADSPRAAAAPPDAPFVAAEPAPAAQWDWLAVVAGLRLGGMAKMLADHCELVAQTGDSVTLRVGEAHKHLLDRAYQDRLTGALREKYGPALQITFEVGSAADQTPQQVRTRIKEARQAEAIAAIEADPFVRELVEQFGGQVEASTIQPLAP

SEQ ID NO: 2623 - protein, 883 aa, Arabidopsis thaliana
MSYMPTSCLVLFFLLFLFHPLPWALSKEDLGWCEALFQCGNNTAGFPFWGGNRAKPCGHPLLELRCLNNITSLNISNHEYNVFHIDQTSNTLRLARTDLLGSFCSAEFNTPTFPREIFKLFPTYKSLTVLYNCDPKLSYRSSYTCPDLGLFSMSQSLDYQNSCQDSFKVNVPTSFVPEEKEMNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSSLFVCYCKDGPQDNQCDINLDDIIGNRIVAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 2624 - protein, 512 aa, Aspergillus oryzae
MFRTLLPRAAPRAALRTARPQSVPSNFVAAPTLSFFSKRGYASESGEHDLVIIGGGVAGYVAAIKAGQEGLKTVCIEKRGRLGGTCLNVGCIPSKSLLNNSHLYHQILHDTKKRGIEVGDVKLNLEQMMKAKDTSVEGLTKGIEFLLKKNGVDYVKGTGALVDPNTVKVNLLEGGEQTLRGKNILIATGSEATPFPGLNIDEKRIITSTGALSLQEVPKKMVVIGGGIIGLEMASVWSRLGAEVTVVEFLNQIGGPGMDAEIAKQAQKILSKQGIKFKTGTKVTKGDDSGASVSISVESAKGGKEETLDADVVLVAIGRRPYTEGLGLENVGIEKDERGRLVIDQEYRTKVPHIRVVGDCTFGPMLAHKAEEEAVAAVEYITKGYGHVNYGVIPSVMYTHPEVAWVGQNEAEVKAAGIKYRVGTFPFSANSRAKTNLDTEGQVKFIADAETDRVLGVHIIGPNAGEMVGEATLAVEYGASCEDIARTCHAHPTLSEAFKEAAMATYSKAIHF

SEQ ID NO: 2625 - protein, 774 aa, Yarrowia lipolytica CLIB122
MAPKSSSTSKKKSSSTKDDGEVKEKPVKIPDLFIVRPQGETQAAVTHNKNIYKVGLHPKILEALGLNNNEFVSVYREGDRGVGGTVCAIPEAVEDPDLVDINVVTVSAGLKDAGALLFGDRVKVERYKTKMDMASLVSVRINTPNSPEQAVIDATTTDLKKLAMVSPGLSMEVKIESGEYVNVTVTDVGDTDLGSLSLEQSELKNHVSYWSPLFLLEDTQVVVSTRNCWELPKTTTYKSIGGLDQHIVELKSTIELPLHHPSLFSRFGISPPRGVLLHGPPGTGKTMLLRAVAQESNAHVLTINGPSIVSKYLGETESSLRAIFEEARKYQPAIVFIDEIDALVPRRDGDESGQAESRVVATLLTLMDGMSQSASAKIVVVGSTNRPNAIDPALRRAGRFDREVEIGIPNAEARLSILSIQMADMPHNMSEEDIQYISSITHGYVGADLSALCREGVMNAINRGLEEHGSALNAVNSGLEVTMPDLERALLDVRPSAMREIFLEKPSTTWSDIGGQSGVKEKLKQMVEWPLTKADTMKNLGITPPRGVLLYGPPGCSKTLIAKALANESGLNFLSVKGPELFNKYVGESERAVREIFRKARAAAPSIIFFDEIDALSTARGHSEAGAGGERVLTSLLTEMDGIESLNGVMVLAATNRPDVIDSALMRPGRLSRLLYVGPPDEHARQQILKIRTKNMCLGSEVDLEEIAKTTEGMTGAEIVALCEEAGLYAMSQDEDAKEVTKKDFDHVLKGARRGVTEEMLKYFVDWAEGNSPA

SEQ ID NO: 2626 - protein, 498 aa, Agrostis stolonifera
MSTNPTSSRPGVSTIDEKNTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAITLEEENKSKK

SEQ ID NO: 2627 - protein, 330 aa, Moritella sp. PE36
MINIAINGFGRIGRSFLRALEESDHQINVVAINDLGSIEQLAHLLKYDSTYGRFGKSIEISDNALIIGDKKIAVYQERNPENLPWAELMVDLVLESTGIFNDGNKANAHIKAGAKKVLISAPATNVDFTIVQGVNNREYDANNHHIVSNASCTTNCLAPIAKVINDNFGIECGFMTTIHAYTQDQNLQDAPHNDMRRARSAAQNMVPTSTGAAKSIGIVIPELNGKLDGGSVRVPVITGSMVDLTVVLKEEVTVEKVNQVMEEAAIAMAGVLSYTSDELVSSDIIRDPASAIFDSKLTKVKGGKLLQVVSWYDNEWGFSNRLVDTIKQMA

SEQ ID NO: 2628 - protein, 316 aa, Vibrio vulnificus CMCP6
MGKLIEGVWHDVWYDTKQTKGKFVREDAGFRDWIENKPQAPFQPESGRYHLYVSLACPWAHRTLIFRKLKGLEEHIDVTVVCPDMLSDGWKMGLPEPLFGHTKLHQIYTQAKPDYTGRVTVPVLWDKKTNTIVSNESSEIIRMFNSAFNQLTGNQDDYYPDSLREVIEEWNAFIYPNINNGVYRCGFATTQEAYEEAYNALFSALDRVEHHLATHRYLAGSQMTEADWRLFTTLIRFDAVYVGHFKCNQKRIADYPHLNGYMKELYQIEGIAETTDFYHIKRHYYFSHIGINPTQVVPLGPNLDLDSDHGREGIGR

SEQ ID NO: 2629 - protein, 93 aa, Brassica napus
KNPDSYDPDRFSPGREEDKAAGAFSYISFGGGRHGCLGEPFAYLQIKAIWSHLLRNFELELVSPFPEMDWNAMVVGIKGNVMVRYKRRQLVLD

SEQ ID NO: 2630 - protein, 755 aa, Arabidopsis thaliana
MTSIIGAALPYKSPEKAIASSSYSAENDSSPVDAVIFAGTSLVLGTACRYLFNGTRVPYTVVLLVIGIFLGSLEYGTKHNLGKLGHGIRIWNGINPDLLLAVFLPVLLFESSFSMDVHQIKRCMGQMVLLAGPGVLISTFCLGALIKLTFPYNWDWKTSLLLGGLLGATDPVAVVALLKELGASKKMTTLIDGESLMNDGVSVVVFQLFFKMVMGHNSDWGSIIKFLVQNSFGAVGIGLAFGIASVFWLKFIFNDTVAQITVTLSASYFAYYTAQEWAGVSGILTVMILGMFFAAFARTAFKGDSHQSLHHFWEMAAYIANTLVFMLSGVIIAESVLSGQTISYKVLYPLLCRSGYGLDWKESIILTWSGLRAIKWKFISQFRYGNKAVLQFLFLTGGIVFLTLVVNGSTTQLLLHLLRMDTLTATKKRILEYTKFEMMKTALKAFENLGDDEELGSADWPTVIRHISSLKDLEGRQVNPHDGYEAGSLDPTNIMDIRIRFLNGISQCVVNSSHCQTSVVPKVAIDSRLLPVSGVQAAYWEMLDDGRITQCTANVLMQSVDEALDLVSTSSLSDWRGLEPRVHFPNYYKFLQSKIIPHKLVTHLIVERLESACYISSAFLRAHRIARQQLHIFLGNSNIASTVINESEVEGEEAKQFLEDVRDSFPQVLSVLKTRQVTHYVLNHLNGYIKNLEKVGLLEGKEVSHLHDVVQSDLKKLLRHPPSLKLPNVDDLITSNPLLKDRSSFRSLAIGETDA

SEQ ID NO: 2631 - protein, 474 aa, Clostridium perfringens str. 13
MQKTKMIFTIGPSSDSEEILREFIRIGMNAARLNFSHGDHASHKEKIELIKRLRKEEKSATAILLDIKGPKIRTYNFKNGEAELKNGDEFTFSCGDEILGDNTKCSISYKELYEDIKPGGSILVDDGLLEFKVKEVRGTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFEIAETGDNIMVAAGFPTSITGGTNMLKIEKI

SEQ ID NO: 2632 - protein, 456 aa, Acinetobacter sp. ADP1
MSVNSVNPATNSTNEYYLTRQSQMESNVRSYPRKLPLAIARAQGCWVTDVEGTQYLDCLAGAGTLALGHNHPAVIQSIQDTLASGLPLHTLDLTTPLKDAFTEALLSFLPGGKEEYCLQFCGPSGADATEAAIKLAKTYTGRSSVISFSGGYHGMTHGSLAMTGNLSAKNSVNNLMPGVQFMPYPHEYRCPLGLGGEAGVDALTYYFENFIEDVESGVTKPAAVILEAIQGEGGVVTAPVKWLQKIREVTERHNIVLILDEVQAGFGRSGKMFAFEHADIEPDVVVMSKAVGGGLPLAVLGIKRKFDAWQPAGHTGTFRGNQLAMGTGLVVLDTIKNENLAQNAQERGEFLQAELKKLANEFPCIGNVRGRGLMIGVEIVDERQSADRIGSLPADAQLAAAIQTACFNNKLLLEKGGRNGSVIRLLCPLIITQDECVQVIERFKKSVAEALKAVRG

SEQ ID NO: 2633 - protein, 394 aa, Moritella sp. PE36
MLNLKTNSKLDPISQVVNRVKVDRRGGTLDLSIGYYESEGEHHTGFSVLDDTKSSLPSIGINFSILGLEQYRDAVKTLITNENNSSHTLSTVQTIGASGGLWLAFLILKREGGAKRVWFSNPTWGNHLDIAKNTGLEIIRYQYDLTDVGNLNFNAVKQSLGDLEKNDILVVQGCCHNPCGIDFTMFQWNEIAKIAQRKSAYIVVDFAYFGLSKSFKEDKKILIPLLNNLNNLFVINSFSKNLGLYCERLGALSFFSRSKDEVQSFDGYAKSIIRSTYSMPPQLLAGQVAHVISNVEIFDKWIDEVAIVRDTLYMRKEILINTLETSGLAHLVSNTKSNGMFLNLLLSSEEIEQLVVQFGIYILGNGRLSLAGLQKKDINKLVEAISQVKTKRVF

SEQ ID NO: 2634 - protein, 357 aa, Magnaporthe grisea 70-15
MAEFVRAQIFGTTFEITSRYSDLQPVGMGAFGLVCSARDQLTNQNVAIKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALAHEYLTPYHDPTDEPIAEEKFDWSFNDADLPVDTWKIMMYSEILDYHNAEAGMQQMDDQFTGQ

SEQ ID NO: 2635 - protein, 489 aa, Ehretia cymosa
GSGVSTLEKKNLGRIVQIIGPVLDVAFPPGKMPNIYNALVVKGRDTVGQPINVTCEVQQLLGNNRVRAVAMSATDGLTRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKAGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLK

SEQ ID NO: 2636 - protein, 461 aa, Escherichia coli O157:H7 EDL933
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 2637 - protein, 206 aa, Idiomarina loihiensis L2TR
MSSDIQDPMAQLVPMVVEQTSKGERSYDIYSRLLKERVIFCCGQVEDHMANLIVAQLLFLESDNPDKDIYLYINSPGGVVTAGMAIYDTMRFIKPDVSTVCMGQAASMGAFLLAGGAQGKRYCLPNSRVMIHQPLGGFQGQASDFEIHAKQILDLKERLNRMLAENTGQDYEKVARDTDRDHFLSAEESIDYGLVDGILRQRGEES

SEQ ID NO: 2638 - protein, 448 aa, Brucella melitensis 16M
MNIRPEAGDVAGMNITIEETLDQAGTGSFQRGLLGIFGLVWAADAMQVLAVGFTGAAIAKTFGLTVPQALQTGTLFFLGMLVGAALFGRLADKYGRRRILLITVACDALFGLLSAFAPDFGSLLALRFLTGLAVGGTLPVDYAMMAEFLPAKNRGRWLVMLEGFWAVGTVVIAIAAWATSVAGVEDAWRYIFIVTAAPALIGIWLRFRVPESPMHLLKSGRVEEAKAVINLVLSRNGKPELPPGAKLLAPRLVTNERLLSPNLRQRTLTSLAIWFLVSVSYYGIFTWIPAKLASDGFGFVRGYGFLVVVALAQLPGYALAAYGVEAWGRRKTLIGFLFVSAAACALFTVATSSSVVGASILIMSFALLGTWGALYAFTPELYPTALRASGMGAAGAMARLGGLLAPSAMAVVINQSFYTAVAMFAGLLALAGIIAFFINVETRQQALN

SEQ ID NO: 2639 - protein, 360 aa, Burkholderia xenovorans LB400
MSKKYRIAVIPGDGIGVEVMPEAIRVLEAVKARFGIELEYQHIEWASCEYYAKHGKMMPDDWKAQLLSADAILFGAVGWPDTVPDHISLWGSLLKFRREFDQYINLRPARLFAGVPSPLAGRKAGDIDFWIVRENTEGEYSSVGGVMFEGTEREFVLQESVFTRHGSERVLKFAFDLAQRRARKKITVATKSNGIAISMPWWDKVAAGIAAQYPDVTWDKQHIDILCARFVLNPDRFDVVVATNLFGDILSDLGPACTGTIGLAPSGNLNPDRKFPSLFEPVHGSAPDIAGKNIANPIAMIWSAAMMLDFLGNHAGKEREAHDAILAAIEATLIEGPHTGDLGGKANTTEVGQAIAKKLA

SEQ ID NO: 2640 - protein, 492 aa, Bruinsmia styracoides
TTSGPGASVLEKKKPGLIVQIIGPVLDVAFPPGKMPNIYNALVVKCQDTGGQPINVTCEVQQLLGNNRVRAVAMSATDGLTRGMEVINTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNAQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEKHYETAQRVKQTLQRYKELQDIIAILGLDELSEEDRLTVARARKIERFLSQPFFVAEVFTGSPGKYVGLAETIRGFQLILSGELDDLPEQAFYLVGNIDEATAKAMNLEMESNLK

SEQ ID NO: 2641 - protein, 490 aa, Burkholderia xenovorans LB400
MTRTFELGELIRSDNFIDGAWTPAQDNLRFAVTNPASGEIIAEVADSSPADARAATDAAARALPAWRARLPKERAAVLHRWHALIMANLDALGALISLEQGKPLAEGKGEVAYGASYVAWFAEEATRIYGDLIPQQQRGKRMTAVKEPVGVVAAITPWNFPLAMIARKIAPALAAGCTVVAKPAEDTPLTASALVLLAHEAGVPPGVLNLITASRDHAVAAVAEWLHDARVRKITFTGSTPVGKYLARESAETLKKLSLELGGNAPFIVFDDADLEAAVAGLMAAKFRNGGQTCVCPNRVYVQAGVYERFGALLAERVGALKVAPATDPAAQIGPMINSRALDKIARHVDDAVAHGARVLTGGKRLAELGPHYYAPTVLADATAAMQLNSEETFGPIVPLFRFEDEAEAVNAANDTPFGLAAYFYSEGVKRIDRVARALEAGIVGINEGAVASEAAPFGGVKESGYGREGSKYGLDDYLSIKYLCQGNLE

SEQ ID NO: 2642 - protein, 447 aa, Clostridium acetobutylicum ATCC 824
MKDIERDDLKYIWHPCTQMKDYEKMPPIVIDKGEGCYLYDVNGNSYLDCISSWWTNIFGHSNKRINKAIEKQLNEIEHVIFAHFSNKPAVEFSKSLIQIAPEGLDKIFFSDNGSSAVEIALKMSFQYYQQTGKVKKTKFAALTNAYHGETIGALSVGDLDLYSKIYKPLLIDTLRIQGPDCYRCKYNKERHSCEAECFEEMEKSLKKHNSELCAIIIEPMIQGAAGMKMYSPKYLKKLRYACDYYDISVIFDEIAVGFGRTGKMFACENADISPDIMCLSKGISAGYMPMSVVLTTSKIYNAFYDDYVNLKAFIHSHTYAGNALACAAAIESLKIFKEESIIEKNIGKSKLIEKLTKNRARNNKFIGDIRSLGMVTAIELVKDKDTKESFDWKSRVGYEIYKIALKKGLLLRPIGDVLYFMPPYSIGEKDIEFMVEKCFESIEQYLE

SEQ ID NO: 2643 - protein, 365 aa, Dechloromonas aromatica RCB
MSALRFHELTIKRVSPEAAGSVAITFNIPDAEREAFSFQPGQFLTLRAKVDGQDVRRSYSISSPRSRLAKAGELEIGIRPVEGGVFSNWAAQTLKAGAKLDVMPPDGRFVVKKQRAIHRVGFAAGSGITPILSIAATTLEEQPEAKFTLVYGNRRMSSVMFNESLQDLKDRYPDRLTLIHILSRQAQEVDLLQGRIDGAKVQAVIDALLPVKSMDEVFICGPEAMIEATEKALIEAGVPESRVYTERFTSGPAQAAKIQADTDAAPTRVAAAKDIALTVVLDGKEHELQIGPDEHVLDAAMNAGLDLPFSCKAGVCCTCRAKVLCGEVVMDKNYTLEGDEMAQGFVLSCQARATTKRLVVSFDER

SEQ ID NO: 2644 - protein, 475 aa, Galax urceolata
NPTTSGTGASVLEKKNPGRIVQIIGPVLDVTFPPGKMPNIYNALVVKGRDTGGQPINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPWILGEEHYQTAQRVKQTLQRYKELQDIIAILGLDELSEEDRLTVARARKIERFLSQPFFVAEVFTGSPGKYVALEETIRGFQLILSGELDGLPEQAFYLVG

SEQ ID NO: 2645 - protein, 203 aa, Dechloromonas aromatica RCB
MSKLRVYSIDGIVPVVDPTAYVHPSAVLIGDVIVGTDCYVGPCASLRGDFGRLILEAGANLQDTCVMHGFPGTDTVVEENGHIGHGAVLHGCRIKKNALIGMNAVIMDNAVIGEASIVAASAFVKASQEIPPGVLVAGVPAKVIRPLSEQEMAWKSDGTRTYQELTRRCLATMVETTPLTAVEADRKRIEMPDVVPLTELKNR

SEQ ID NO: 2646 - protein, 267 aa, Thiobacillus denitrificans ATCC 25259
MDAPQFERTRILLDPAEQARLARAHVLVAGLGGVGSYCAEALARAGVGRLTLVDHDVVAASNINRQLPALLSTVGQAKVDVMAARIRDINPACEVVVVREFLIPETVAERVPADVDFVVDCIDSLNCKVALVASSVERGLNVASSMGAGNKLDPSRIRLADISKTSMCALAAVMRKRLRKRGIAKGVLTIFSDEPGRAPLPPQPVEGRGRARAVNGTISYMPPLFGLMLAGAVVRKMIAGGSAATEAPAVAPPPQNPGEKNAGAAGV

SEQ ID NO: 2647 - protein, 175 aa, Triticum aestivum
MAPIVMASSATSVALFQGLKSTGGLPVRRRSIGASLGSVSNGGRIRCMQVWPIEGIKKFEMRSYLPPLSTEALLKQVDYLIRSKWVPCLEFSKVGFIFREHNASPGYYDGRYWTMWKLSMFGCTDSTQVINEVEEVKKEYPDAYVRIIGFDNMRQVQCVSYIAFNPPGCEESGEA

SEQ ID NO: 2648 - protein, 791 aa, Xylella fastidiosa 9a5c
MNENILWLHELRLTDLARVGGKNSSLGEMIGNLTALGVSVPGGYATTAAAFKAFIAYNNLSKRIYDKLATLDVEDVKALTAAGKEIRDWIIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRTLGSKLVRMVYSDSPGERVKIEDTPTELRHCFAISDADVQELAKQALIIEEHYGRPMDIEWAKDGVSGKLFIVQARPETVKSRSHTTQIERFALQQRGEILTEGRAIGQKIGSGISRVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 2649 - protein, 375 aa, Bradyrhizobium sp. BTAi1
MSTKRCYYETLEVERDADETKLKAAFRKLAMKWHPDKNPGDASSEVKFKEINEAYEVLRDADKRAAYDRYGHAAFEQGAGGPHGFGAGFASSFSDIFEDLFGMAGQRRGGTGRERGADLRYNMEITLEEAFQGKTAQIEIPVSVTCESCSGTGAKAGTKPKTCAMCGGAGRVRQAQGFFTLERTCPGCHGRGQMIEDPCPSCSGSGRVTRDRTLSVNIPQGVEDGTRIRLAGEGEAGLRGGPPGDLYIFLSLSQHEFFQRDGADLHCRVPISMVTAALGGEFEVPTIDKGKTKVKIPAGAQSGRRFRIASKGMPVLRSRQTGDMYVQIVVETPQNLTKKQQELLAEFEKLSSGATQPEAAGFFTKVKDFFGKAAS

SEQ ID NO: 2650 - protein, 403 aa, Moritella sp. PE36
MYTNIPKGVKDPIFALNESFRNDPREDKIDLGVGVFKNELGLTPLMKAVEIAESAYVIKNQKTKVYKGLMGNEDFNQEISKLLIENESVRKTAAVVQATGGSGALRLISDYIYSVNPDCTVWVSDPSYANHTPILKDAGLTVCYYDYLDSDSRIVDMGRVTRTLVNSKKGDVVLLHGCCHNPTGADLNMTQWHEIADFMLMKGLTPFVDIAYQGLGDTLEKDVGGLNILLSVFKEVFITSSSSKNFGLYAERVGAAIVVCRDVERVSNVRRRLTNIALKSYAMPPNHGAAIVETILTDPFLKKLWIDELDVMRSQIKNNRKALHDALKESGYIGNIDFITSHKGMFSSFGWSEQFTDLIREKYGIYIVKGGRINFAAITTKDVTRIARSICYTQNVLNVGIAV

SEQ ID NO: 2651 - protein, 412 aa, Escherichia coli CFT073
MADTRPERRFTRIDRLPPYVFNITAELKMAARRRGENIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDMAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 2652 - protein, 233 aa, Bradyrhizobium japonicum USDA 110
MTQAFTPRPLAIAPSILASDFSRLGEEVRAVDAAGADWIHLDVMDGHFVPNISYGPDVIKAMRPHTKKVFDAHLMISPCDPYLEAFAKAGCDHITVHAEAGPHLHRSLQAIRALGKKAGVSLNPGTPIGVLEYVIDLVDLVLVMSVNPGFGGQAFIPSAIGKIRDIRAMTAGRPIDIEVDGGVGPDVAGALAAAGANAFVAGTSVFRGGTQDAYRTNIAAIRNAAAGARGEAI

SEQ ID NO: 2653 - protein, 626 aa, Bacillus cereus G9241
MTICSVNNVTKSFGGNIIFENISLEIKNGERVGLVGRNGSGKTTIFQLLTGMESLDAGAIHMKKGTRIGHVAQIPKFDESMTVYDVLSSAFKIEKELEREMHALEKHMAEEQESSVLQRLMERYGVIQEKFAFLGGYEIEANIMKVANGLQVTELFPRSFLELSGGEQTKVSLAYMLLQKPDLLLLDEPTNHLDLFAVEWLEQFLKEYNGTVMVISHDRYFLDEVVTKIFDLEDGEIHVYHTNYSQFVEEKEERLLQEFQAYQEQQKKIKKMKEAIKRLREWANQANPPNEGLHKRARSMERALERMEKLKKPILERKQMGLQFEGQERSGKDVVVMKEVSKGFADHPLFNEVNLHVRFQERAAIVGRNGTGKTTLLKLLLEEIEPDAGEIRIGSSVKIGYLSQHAYGNMKSNVLEAFREYVAVTEGEARHILAKFLFYGPAVFKKVTQLSGGERMRLRLAQLMYQDINFLILDEPTNHLDIESREVLEEALEQYNGTILAVSHDRYFLNKLFEKTYWIDECKLFEFAGNYAWARQKWEEKLETQVIKQQRQGRKSIETVPVKKKEVRNIEEIETELIHVEEDIYTLECKMEHVVDVEMLEQLYEEKTKKELLRADLYNALENIME

SEQ ID NO: 2654 - protein, 254 aa, Zea mays
MLFRFSSSFLESISTHVDPKLPFISLSKGLELNTLRTMSTIIPRPVGNRRQPFVVLSGPSFAVELMNKLPTAMVVASKDNKLASSVQQLLASPNLRISTSSDVTGVEIAGALKNVLAIAAGIVEGMSLGNNCMAALVAQGCSEIRWLATKMGAKPTTLSGLSGSGDIMLTCFVNLSRNRTVGLRLGSGEKLDRIMGSMNQVAEGVSTAGAVIALAQKYKVKMPVLTAVARIIDNELTPTKAVLELMNLPQVEEV

SEQ ID NO: 2655 - protein, 443 aa, Francisella tularensis subsp. tularensis SCHU S4
MYNLCQLNILQKVYNMYSSNIWHPCTQMKDFEKSPPLNVYRTEGRYIYTKDNRKLFDATSSWWCKSLGHRHPYIIDKLKKQLDKYEHTIFANATNDEIDRFSQRICNLTGMDKTLYASDGSCAVEIALKMTIHLRSFQNQTKKIKFVCLENSYHGETLATMSVSDCGLYSDPYKPLLFDSFKLKNIPYVTGKNDPLWANAERYWNKSQQYLEQHKEFINALIVEPICQGAGGMLIYSKDYLNILCKWCKENDIYIIFDEIMTGLGRLGKLFAYEYLDITPDFLCVSKGLTSGIIPFSIVLTKNQYYEMFYDDQLTKAFLHSHTHSGNVLGAVVANAVLDIFEEENILTNVKDLEKQFSESFLELQEQLPIIKNVRGIGAVIAADLNIDKKRAGLDVYREAIKLGALLRPLGNTIYWLPPFNSTYQEIDLLKQITKQSIINAFK

SEQ ID NO: 2656 - protein, 330 aa, Oryza sativa Indica Group
MAELQRQGCWSLALSPLHVARIEPWYYPNPALYTTFVSSSPVTEDGTAAAVDVLVEAFLEEKERGGGFVEAEEDVYKLMRLVRTLVAKERARAAWRVYKAEVRMGGCEVHEYIYRVMARGMKWLGFEAEAAKVEADFREWEARILPPAKDVLDEMRTKKKKKPDVRTAAEAAQGLQRHEVERRKKQPPPPKQEKAKRVVRWKCAAGCGACCKLDKGPDFPSPEEIFAEHPEDLKLYKSMIGADGWCINYDKSTRTCNIYEERPVFCRVEPKVFEEYFGVPSRPSTFDREACSACVDTIKMVYGEESAELTNFKRVIREESKFRRHQWPIM

SEQ ID NO: 2657 - protein, 207 aa, Bradyrhizobium sp. BTAi1
MSERLLVLVRHGQSEWNLKNLFTGWKDPDLTEQGVSEAKEAGRKLKAHGLTFDVAFTSELTRAQHTLKLILDELGQPGLPTSRNLALNERDYGDLSGLNKDDARAKWGEEQVHVWRRSYDVPPPGGESLKDTLARALPYYVQEILPGVLRGQRTLVAAHGNSLRALIMVLEKLTPEGILKRELATGVPIIYRLKADSTVESKLDLAG

SEQ ID NO: 2658 - protein, 500 aa, Oryza sativa Japonica Group
MAPPPSLLATALLLLLLAIAGGPNAAAVAEAVRYQTLVATPLSPHPYTATAVEDDGLFQGSLAADEGGAAASTVGLRVVHRDDFAVNATAAELLAHRLRRDKRRASRISAAAGGAAAANGTRVGGGGGGSGFVAPVVSGLAQGSGEYFTKIGVGTPVTPALMVLDTGSDVVWLQCAPCRRCYDQSGQMFDPRASHSYGAVDCAAPLCRRLDSGGCDLRRKACLYQVAYGDGSVTAGDFATETLTFASGARVPRVALGCGHDNEGLFVAAAGLLGLGRGSLSFPSQISRRFGRSFSYCLVDRTSSSASATSRSSTVTFGSGAVGPSAAASFTPMVKNPRMETFYYVQLMGISVGGARVPGVAVSDLRLDPSTGRGGVIVDSGTSVTRLARPAYAALRDAFRAAAAGLRLSPGGFSLFDTCYDLSGLKVVKVPTVSMHFAGGAEAALPPENYLIPVDSRGTFCFAFAGTDGGVSIIGNIQQQGFRVVFDGDGQRLGFVPKGC

SEQ ID NO: 2659 - protein, 319 aa, Candida glabrata CBS 138
MSTNSIKLLAGNSHPELAELLSRRLGIPLSKVGVYQYSNTETSVTIGESIRDEDVYIIQTGIGAQEVNDFLMELLILIHACKTASVRRITAVIPNFPYARQDKKDKSRAPITAKLIAKMLETAGCDHVITMDLHASQIQGFFHIPVDNLYAEPSVLNYIRTKTDLKNTILVSPDAGGAKRVASLADKLDLNFALIHKERQKANEVSRMVLVGDVQGKSCLLIDDMADTCGTLVKACDTLLEHGAKEVIAIVTHGIFSGSAREKLANSKLSKIVCTNTVPVDIDLPIVDQVDISPTLAEAIKRLHNGESVSYLFTHAPPA

SEQ ID NO: 2660 - protein, 138 aa, Glycine max
MYQAIPYSSTRPWARPSPAAEPAVAVKAETAEAAASREDAAGVERAVSESPVVVVGRRACCLTHVVKRLLQGLGVNPAVHEVADEAALAGVVPDGGEAAALPAVFVGGKLLGGLDRLMAVHISGELVPILKKAGALWL

SEQ ID NO: 2661 - protein, 472 aa, Erwinia carotovora subsp. atroseptica SCRI1043
MSQNVYQFIDLQRVDPPKKPLKIRKIEFVEIYEPFSESQSKAQADRCLSCGNPYCEWKCPVHNYIPNWLKLANEGRIIEAAELSHQTNSLPEVCGRVCPQDRLCEGSCTLNDEFGAVTIGNIERYINDKAIEMGWKPSVANVIPTGKRVAIIGAGPAGLACADVLARSGVQAVVFDRHPEIGGLLTFGIPSFKLEKEVMVKRREIFTEMGIEFRLNTEVGKDVQMKALLDEYDAVFLGVGTYQSMRGGLDNEDAQGVYDALPFLIANTKQLMGFEAATDEPYISMQGRRVVVLGGGDTAMDCVRTSIRQAATHVTCAYRRDEENMPGSKREVKNAREEGVEFKFNLQPLSVEVNGAGKVCGVKMARTALGVPDANGRRRPEIVEGSEHVLEADAVIMAFGFRPHKMAWLAEHDVKLDDQGRIVAPESCDNAFQTSNPKIFAGGDAVRGSDLVVTAIAEGRKAADGIMNYLEV

SEQ ID NO: 2662 - protein, 308 aa, Brucella melitensis 16M
MLVEKTRLGGTCLNVGCIPSKALIHAADEFHRLTTFAAKSPLGITTQNPAIDFARTLEWKDGIVHRLNSGVAGLLKRSRVRMFQGQARFQDGKTVLVDTDTGRQTIHAENIVIATGSVPVEIQALPFGGNIISSTEALSLEKIPERLAVVGGGYIGLEIGTAFAKLGSRVMVVEATDRILPQYDAELTRPVMARLKTLGVEVLTGTSAKGLSADGKALEIRTQDGAVKAIEADKILVTVGRKPQTDGWGLSEIRLDMDGRFIRIDDRCRTSMRGIYAIGDVTGEPMLAHRAMAQGEMVAEIIAGGKHA

SEQ ID NO: 2663 - protein, 493 aa, Shortia soldanelloides
PTTSGPGASVLEKKNLGRIVQIIGPVLDVTFPTDKMPNIYNALVVQSRDTVGQPINVTCEVQQLLGNNRVRAVAMSATDGLMRGMEVINTGAPLSVPVGGATLGRIFNVLGEPVDNLGPVDTRTTSPIHRAAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPWILGEEHYQTAQRVKQTLQRYKELQDIIAILGLDELSEEDRLTVARARKVERFLSQPFFVAEVFTGSPGKYVALAETIRGFQLILSGELDGLPEQAFYLVGNIEEATAKAMNLEMESNLK

SEQ ID NO: 2664 - protein, 431 aa, Brucella melitensis 16M
MAHFAIKLPDVGEGVAEAELVEWHVKVGDIVREDDLLAAVMTDKATVEIPSSRAGKVIAINGEVGEKIAVGSELVRLEIEGGATEKAEEPQPQAAEPTAPAAAVPEAPVLLQTPVPEKPAAPKRENAGRPFTGAGPLRPEGEKPLATPSVRLRARDAGIDLRRVRGTGPAGRITHEDLDAFFQMESGAAPALSGYAADTSINEIKVIGLRRKIAERMAEAKRHIPHITIVEEVDVTQLEELRNGLNHEKKEGHPRLTLLPFIIRTIVKAVKEQPGLNAHFDDEADIIRQFGGVHVGIATQTPNGLIVPVVRHAESMSVFAAATELSRVTEAARNGTAKREELTGSTITITSLGPLGAIATTPIINRPEVAIVGINKMAVRPMWDGTQFVPRKMMNLSCSFDHRVIDGWDAAVFVQKLKSLLETPAMIFVEG

SEQ ID NO: 2665 - protein, 396 aa, Nicotiana benthamiana
MSCTVAISNLPAFWPVARVPLTKSLLCKSASFSSSSSPNSSKTLTKFPSFTSSSSSSSSPSLQFHILRFQKPLPVPAPAPINLIRNSTECSTSTPNSTSPTVLKRKRPAKLDIPIVSTTFGNFPALPAAAAADFVEVEGDGYYVCCKRGRRGPMEDRFSALVNLQGGSKEGIFGIFDGHGGAKAAKFAAENLNKNIMDEVVTRKDENVMEAVKNGYLKTDSEFLNQEFRGGSCCVTALIRNGDLVVSNAGDCRAVVSRDGIAEALTSDHKPSRKDEKDRIETLGGYVDYCNGVWRIQGYLAVSRGIGDRYLKQWIIAEPETMVLRLNPELEFLVLASDGLWDKVSNQEAVDAARPLCARISKPQLLSASKSLVDLAVSRGSVDDISVMIIQLQQFC

SEQ ID NO: 2666 - protein, 489 aa, Shortia uniflora
GPGASVLEKKNLGRIVQIIGPVLDVTFPTGKMPNIYNALVVQSRDTVGQPINVTCEVQQLLGNNRVRAVAMSATDGLMRGMEVIDTGAPLSVPVGGATLGRIFNVLGEPVDNLGPVDTRTTSPIHRAAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPWILGEEHYQTAQRVKQTLQRYKELQDIIAILGLDELSEEDRLTVARARKVERFLSQPFFVAEVFTGSPGKYVALAETIRGFQLILSGELDGLPEQAFYLVGNIEEATAKAMNLEMESNLK

SEQ ID NO: 2667 - protein, 549 aa, Oryza sativa Indica Group
MTMMGWAVLLVVVASMAGEAAGRFVVEKNSLRVTSPAGLRGVYECAIGNFGMPQYGGTMHGVVVYPKANKKACRSFDDFDLSFKPKPGGLPVFLLVDRGDCYFTTKGWNAQTAGAAAVLVADDRLEPLITMDSPESSGTDYIEKITVPSALVTKKFGDDLKKALENGDMVNVLLDWRESLPHPDERVEYEFWTNSNDECGAKCDMQMNFVRNFRGTAQVLEKRGYTQFTPHYITWYCPEAFVLSKQCRSQCINHGRYCAPDPEQDFNIGYDGKDVVLQNLIQICLFKVGNETHKPWVWWDYVHDFSIRCPMKEKKYTRECANGVIKSLGLDLERINKCVGDPEADEENPVLKAEQDAQDTFRGRVCECPIARGVKFVGDGYTHCEASGVGRCQINNGGCWKETKNGKTVSACSNEESKGCKCPPGFKGDGIKSCEDIDECKDKLFCQCKDCSCENTWGSYECSCGGSNMLYMREHDTCISKVASSSVGWGFLWVIFFGLALAGIGAYAVYKYRLRSYMDSEIRAIMAQYMPLENQETPNQHRPVEHADI

SEQ ID NO: 2668 - protein, 435 aa, Aspergillus nidulans FGSC A4
MVRNIVVIGGTSHPQLTQTICDILGIPPADVLLSKFSVGETRVEIKESVRGKDVYILQSGGGKVNDHLLELLITISACKTASARRVTAVLPLFPYSRQSDIPYNKSGAPLVKSSLEGKGASNGYTFESTPTTPHPGKLEVGNPINGVSIDNLQKSLAKAQLEESSGSPVKKRLPNGLSRSDTMESLKSDSSKSTLPNGLLDDSQDKINKFEPRPGYKQWVAQAGTLVADLLTCAGADHVITMDLHDPQYQGFFDIPVDNLYGRPLLKNYIMRNIANYKEAVVVSPDAGGAKRATAIADSMGMEFALIHKERRPTRITDRQNATMMLVGDVKDRTAILIDDLADTSNTITRAAKLLKKEGASQVYALVTHGILSGDAIDRINASALDKVVVTNSVSQTEHLRRCPKLEVLEVGHVFAEAIRRVHHGESISALFQYE

SEQ ID NO: 2669 - protein, 242 aa, Zea mays
MGLTSTRWMAAQPPPPPEMERPAASGALIYAMVARGTVAVAEHTSYTGNFRDIAAQCLHKLPAGNNRFTYTCDAHTFNFLVSDGYAYCVVATESAGRQIPMAFLEMIKEEFNRRYSGGEAGTATANSLTRDFGPRLRDQMQYCTDHPEEVSKLSRVKAQVDQVKSIMMENIDKAFDRGQQIDGLVTRTEQLHDEAVDFRRQGVQLRRRMWYQNMKVKLIVLGVVVALILIIVLSICHGGCSK

SEQ ID NO: 2670 - protein, 107 aa, Synechococcus sp. RS9917
MSSAAAVTDASFEQDVLQSDVPVLVDFWAPWCGPCRMVAPIVDEISKEFEGKIKVFKLNTDENPNVASQYGIRSIPTLMVFKGGQKVDTVVGAVPKATLSGTISKYI

SEQ ID NO: 2671 - protein, 153 aa, Streptococcus mitis
EHFIRGQYRSGKIDGMKYISYRSEPNVNPESTTETFASGAFFVDSDRFRGVPFFFRTGKRLTEKGTHVNIVFKQMDSIFCEPLAPNILTIYIQPTEGFSLSLNGKQVGEEFNLAPNSLDYRTDATATGASPEPYEKLIYDVLNNNSTNFSHWD

SEQ ID NO: 2672 - protein, 216 aa, Propionibacterium acnes
MNAEQAEQAAPGGLAPAGPRNDYYIPQWEERTSYGVRRVDPYTKLFEDRIIFLGTPVTDDIANAVMAQLLCLQSMDADRQISMYINSPGGSFTAMTAIYDTMNYVRPDIQTICLGMAASAAAVLLAAGAKGQRLSLPNSTVLIHQPAMGQATYGQATDIEILDDEIQRIRKLMENMLATATGQSVEQISKDIDRDKYLTAQGAKEYGLIDDILTSL

SEQ ID NO: 2673 - protein, 782 aa, Idiomarina loihiensis L2TR
MRKTKIVQVLRYFSLAAMVLSGSMTVAAAGWQDGVVIKGEKGSEATDVRIGQERYGPISSNDTLWDIARRYKPHSSVTQYQTMVAIVQANDDAFVDGNMNRMLNGFYLRIPSLQEIKMVNPEAARRQVVVDSQLKTKSQQLSQARQDTQKTRAEQQELLEQAREKAEQTIQEVEQRQEQNFQELRSDMQQSMQAVERMYEENKSLQERIDALASRLDELANNVSKTDELEVQFQQVLAQQRELLEQQAREELEQESGFSDWLQSPLNMLLVSVLPALLIIGLIVFFFLRRSAKPVEEDEEAEEKSSKELTEEEAAAELDKELLGDVPNDSTDGLFDIDGEESTDDEGDDLSALEAELTGNSDEPEAADLSVRLDDGKDDARKEEPKPEAETEPAVEDDLDDDDQAVLPDEEDEESSELSQDELDRLFGEADDDDEQAIDLSVTDEEESPESSSADADEPVSENIEQEGEATEEESAVADVDDIDDILSDNAPSETPEEADSDDERAVDDKPDKGETDSDQESDDLLPDDFDDSEVDDVLAELGLAENEADEPESEKAESIETDSSEAEDEPEADEAQSEEAAEAEETELTSQEESQPVEEDSEEDNLEQLLQESDELTQSLDDLEEEVPDDDAELDKAEDEADKDLESLFGGSDNADNIVDEDEPATEENDTESEAETDAFSATDDDEFVDIDSLMADADEEDEDSDRYQSSAVKDVLPDDESGDAEGAPQDDEPSGQLDLARAYIEMGEEDEAREILQQLAEGDDEALANEAKTLQQKLDS

SEQ ID NO: 2674 - protein, 195 aa, Triticum aestivum
HASAVEIEAEDVIRLILQFLKENQFEETAATLESETSVKIDTIQNKDQFIREIKQGEWDIVLRHVVDLKIPAQKLIDLYEHIILELAELRELGAARTLLRQTEPMYILKQRFPERYLRLEHTLSRTSLDSREIYPNGMTKEKRRQTIAQALINEVTIVEPSRLMTLLGDCIKWQQQQGLLPMNEPFDLFRDSDKV

SEQ ID NO: 2675 - protein, 113 aa, Clostridium tetanomorphum
EVVVCPTFVCLSDVKKVLEDSNIKIGAQNMHFEEKGAFTGEVSPGMLQALNIEYVIIGHSERRQYFNETDETVNKKLKAAFSHNLIPILCVGESLQERETEITEEVIGRQIKL

SEQ ID NO: 2676 - protein, 314 aa, Brassica napus
  misc_feature (251)..(251): Xaa can be any naturally occurring amino acid
GILVFHDPRVRNLMNMKIFVDTDADVRLARRLRRDLVERGRDADSVLEQYAKFVKPAFDDFVLPSKKYADVIVPRGGDNHVAVDLITQHIHTKLGQHDLCKIYPNVYVIQSTFQIRGMHTLIRAKDISKHDFVFYSDRLIRLVVEHGLGHLPFTEKQVVTPTGAVYTGVDFCKKLCGISIIRSGESMENALRACCKGIKLGKILIHRVGDNGMQLIYEKLPRDISERHVLLLDPVLATGNSASQAIELLIXKGVPESHIIFLNLISAPEGIHCICKRFPLLKIVTSEIDQCLNEDFRVIPGLGEYGDRYFGTDE

SEQ ID NO: 2677 - protein, 369 aa, Myxococcus xanthus DK 1622
MGLSIGIVGLPNVGKSTLFNALSAAGAQAANYPFCTIEPNVGVVPVPDDRLDKLSALIKPLKKVPTSLEFVDIAGLVRGASKGEGLGNQFLGNIRQVNAVLHVLRCFEDDNVTHVEGGVNPVRDRDVVDTELCLKDLETVEKRRERSLKNTKVGGKAGEEAKAEVALLDRIKASLDNGITVRAQKLTEEESAVIHDLFLLTDKPVLYVANIGESELGKEDANPHVKAVREMAAKEGFEVVVLAAALESEIQQLPESERPGFLESAGLSEPGLHKVVRAGYKLLGLWTYFTVGEQECRAWTIHQGYKAPQAAGVIHSDFERGFIKAEVMRWEDLVKLGSESAVKEKGMLRVEGKEYVVQDGDCMHFRFNV

SEQ ID NO: 2678 - protein, 113 aa, Clostridium tetanomorphum
EVVVCPTFVCLSDVKKVLEDSNIKMGAQNMHFEEKGAFTGEVSPGMLQALNIEYVIIGHSERRQYFNETDETVNEKLKAAFSHNLIPILCVGESLQERETEITEEVIGRQIKL

SEQ ID NO: 2679 - protein, 323 aa, Shigella flexneri
MHHHHHHSSGVDLGTENLYFQSNAMDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDANMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQALKQLAEQSLDTSALEALADYIIQRNK

SEQ ID NO: 2680 - protein, 258 aa, Oryza sativa Japonica Group
MAIAVRSAAAVARHSLRPPLAAPGSIRGASLLPPQRARGVGPCRARARAASSSATGGGGHLPPLFSVAPMMDWTDNHYRTLARLISKHAWLYTEMVVAETIVHQKDNLDRFLAFPAEQHPIVLQIGGSNLDNLAKATELANAYSYDEINLNCGCPSGKVAGHGCFGARLMFDPEFVGDAMSAIAANCNVPVSVKCRIGVDDRDSYEELCELSSETSHVPLNFLRLPRYEPWKSCQISTLYQMHFYTEKDQSTMGCGML

SEQ ID NO: 2681 - protein, 506 aa, Myxococcus xanthus DK 1622
MPLQRSSPWPPACVYKGGLGARSHARMDAKKLGVMAVLAGVAVAVVPWLLPTGPNANLDAARFLEAGSLAVGAAVVFAGGLLTALTPCVYPLIPITVSVFGARKTEGRGRALLLTSSYIVGMGVVFSALGVLAAKTGQAFGSMLGHPAVVTGLAVFLLLLATSMFGAFELALPSSFQTKLNAVGGAGVAGAFLMGSVSGFLAAPCTGPVLTGLLAFVAKSANTTLGASLLFVYALGIGVPFFLIGVFTVRLPRGGVWMEWVKSVLGIMLVALAFSYLKDAFPWARDVVKGLGLHVGRVPGAVIAALLVAVGVALGAVHRSFKEGAREFSFKALGVALVVAALVLRGGALDGGPVGTLWVSLGLAEPARAPAWQWHHVMPAKQATFSPEAFDQVLAQAKAEGRPVLIDFFADWCAACKELDRDTYPAQQVISESDEGRFLNIKIDATNSEDSLDALLERFGVEGLPTVAFISPEGKVLTQPRVTGFLAPSPFATEMKKARCTDANAC

SEQ ID NO: 2682 - protein, 120 aa, Triticum aestivum
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEE

SEQ ID NO: 2683 - protein, 113 aa, Clostridium malenominatum
EVVVCPPLFVFQKLKKTIIGSNIKLGAQNIYFEEKGAFTGEISPGMLKSLGVDYVIIGHSERRQYFNETDEIVNKKIKAALKHDIMPILCVGESLEEKESGITKEVIGSQMKL

SEQ ID NO: 2684 - protein, 482 aa, Mycobacterium sp. KMS
MDTTALLKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADVDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGIKESGFGREGGTEGIEEYLDTKYIALTK

SEQ ID NO: 2685 - protein, 348 aa, Triticum aestivum
HYRTSLYKKAGWYRSGIPGISSTHASGGIGRLLLYDYDTVELANMNRLFFRPDPRGRTKTDAAVQTLSEINPDVVLESYSLNITTVKGFETFLGSLKARSSNGRSTGVDLVLSCVDNYEARMVVNQACNELRQTWMESGVSEDAVSGHIQLLVPGETACFACAPPLVVASGVDERTLKRDGVCAASLPTTMGVVAGLLVQNSLKYLLKFGQVSPYLGYNSLKDFFPTMEMRPNPQCSNPACLERQKEYMQSKPARDAAAKAKMEAEASAAIEYPVHVDNEWNISVLDDSDTATSSVQRAATDILPEGLVRELPDEDSYVEPPAAPASSGAIDDDLEELQRQLDALNSS

SEQ ID NO: 2686 - protein, 831 aa, Escherichia coli CFT073
MLTIQFLCPLPNGLHARPAWELKEQCSQWQSEITFINHRQNAKADAKSSLALIGTGTLFNDSCSLNISGSDEEQARRVLEEYIQVRFIDSDSVQPTLAELTAHPLPRSLSRLNPDLLYGNVLASGVGVGTLTLLQSDSLDSYRVIPASAQDSTLLEHSLATLAEQLNQQLRERDGESKTILSAHLSLIQDDEFAGNIRHLMAEQHQGLGAAIISNMEQICAKLSASASDYLRERVSDIRDISEQLLHITWPELKPRNNLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDKKRIDIAANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGELQKAIVELKRDGLRHAETITLGIMVEVPSVCYIIDHFCDEVDFFSIGSNDMTQYLYAVDRNNPRVSPLYNPITPSFLRMLQQIVTAAHQRGKWVGICGELGGESRYLPLLLGLGLDELSMSSPRIPAVKSQLRQLDSEACRELARQACECRSAQEIEALLTAFTPEEDVRPLLALENIFVDQSFSNKEQAIQFLCGNLGVNGRTEHPFELEEDVWQREEIVTTGVGFGVAIPHTKSQWIRHSSISIARLVKPVDWQSEMGEVELVIMLTLGANEGMNHVKVFSQLARKLVNKNFRQSLFAAQDAQSILTLLETELTF

SEQ ID NO: 2687 - protein, 485 aa, Prochlorococcus marinus subsp. pastoris str. CCMP1986
MINNLKSDLKLQPVILSGGKGSRLWPLSRECYPKQYLELYEGNKFSLLQNTFLRLNLLDNLEPPIIICNESQRFLVAEQMLKINVVPKSIIIEPVGKNTGPAVALAAIAANKKGQDPALLILSSDHVINDSKEFTATIIEGLIHAKQGKIVSFGVVPTYPETGYGYIESLEELTNFKKSSSIKRFIEKPEEDRAKQFIQSNLFTWNSGIFLFKASTIIQEFNRFAPEIIHICKKSIVSAVSDLDFLRLNNEIFQKCPNVPIDIAIMEKTDKGTVVRLNAGWSDIGNWESVWDNSTKDNERNSTKGNVLLMESHGCYLRSEKRLLVGLGLKDLIVIETDDAVLVINKSSAQKVKHIVEDLEKKNISEGKVNKKIYRPWGSYTSISNGITWQVKKLEVNPGASLSLQMHFHRTEHWIIVDGTAKVEINNHETILNQNESIYVPIQAKHRLSNPGNENLIIIEVQNGKYLGEDDIVRFEDIYGRKKDL

SEQ ID NO: 2688 - protein, 232 aa, Oryza sativa Indica Group
MAAVVRCKPTRLTPIAGLSSSSGGGRRKKAGRRGEAKPPPPPPPQLRGGETKKKKKPDARTAAEAAQGLQRHEVERRKKPPPPPPPPKQEKAKRVVRWKCAAGCGACCKLDKGPDFPSPEEIFAEHPEDLKLYKSMIGADGWCINYDKSTRTCNIYEERPVFCRVEPKVFEEYFGVPSRPSTFDREACSACVDTIKMVYGEESAELTNFKRVIREESKKHEASLNQDKLLDT

SEQ ID NO: 2689 - protein, 919 aa, Vibrio vulnificus CMCP6
MLSLIEQIRTGALWDFPGGVHPAENKRQSNQQPLVHAALANEIVLPLKQHIGKPGNILVNVGDHVLKGQLLTQSNAGFTLPIHASTSGTITAIETRTVAHPSGLSEMCVVITPDGQDTWCEKQPVIDYSQQSSDYLLDVIRMAGISGMGGAGFPTAKKIQSGLGRTEILIVNAAECEPYITADDKLLQEHAEEVLQGIEIVEHILQPKLTIIGIEDNKPEAIKALESAAQNRDIVIRVIPTKYPSGGEKQLIKVLTNKEVPAGGIPADIGILVQNVGSLYAIKRAVMDGEPMVNRVVTLTGNTFETPRNVWVPLGTPVHALLEQFGYQADKKLPRLIMGGPMMGFSLPHANVPITKTSNCILAPTRKEISPAGYEMECIRCGACAEACPASLLPQQLQWHAKAEEFDKCEELNLKDCIECGACAFVCPSEIPLVSYYRQAKAEIRTRAQEADAAERAKLRFEEKKARMEREKEERENRFKKAAEDRRKEMKSTGGDDAIAAAIARVKAQKTQDSEQAPSVKPAVAAAIAKAKAKQAAAADSGSSEPDNSEMVKLREERKRLARERKAEKEQSKTPDSEEQGDKKSAVAAAIARAKAKKAQQPPLASSESSADEPEDKKAAVAAAIARAKARKAQQTDEPAPEQNREESQAAEDAPKKAAVAAAIARAKARKAQQTDESAPEQNREESQPAEDDPKKAAVAAAIARAKARKAQQTSEPAPEQNREESQPAEDDPKKAAVAAAIARAKARKAQQTDEPAPEQNREELQPTEDDPKKAAVAAAIARAKARKAQQTDEPAPEQNREESQPAEDDPKKAAVAAAIARAKARKAQQTDEPAPEQNREESQPAEDDPKKAAVAAAIARAKARKAQQTDEPAPEQNREESQPAEDDPKKAAVAAAIARAKARKAQQAEQKQNTEENE

SEQ ID NO: 2690 - protein, 206 aa, Geobacter sulfurreducens PCA
MVNITSAEFVTSGTRPEHYPPGDLLEIAFVGRSNVGKSSLINVLVNRKSLVRTSSTPGRTQLINFFRVNGSLMLVDLPGYGFARVPPEVKRQWGPMVETYLAGRSCLACVVLIVDVRRTPAEEDRLMLQWLRAYDIPVLVVITKCDKVSKNERAKQASLISRTLGLAPDEMAFFSALSREGRDAIWARIEAIMAEGHSPSVDGAPE

SEQ ID NO: 2691 - protein, 658 aa, Thiobacillus denitrificans ATCC 25259
MHSGSSLQLVLILLAVAVLVAAAARALRLPTMLAYLVTGIAIGPFALGWIPDSDEARYLAEFGVVFLMFSIGLEFSLPRLMTMRMTVFGFGGAQVVLTIVLSAAVAWMLGLPPLAALAVGGIMSMSSTAIVSKMLTERLEVQTSHGRQIFGALLFQDLAVVPLLILIPAFAKESDAMAATLGLALLKATVVLGFLLFVGQRVMRPWFQWVAGHKSPELFTLNLLLFTLGLAFLTESAGLSLALGAFLAGMLVSETEYRYQVEDDIKPFRDVLLGLFFVTIGMRLDPTQVMLDWADVLMIVAAIVIGKGVLVAGLAMAFGSGRPTAWRTALGLAQAGEFGFVLLAQAADLRLLGVEVAQPLLAAMVLSMLIAPLLIHRMDTLTRLLAGSEWSGRAKEVHDISIKSFGKTRHVIVCGYGRSGQNLARLLEAEGITFIALDADPERIRAVAASGVSAVYGDASRREVLVAAGLSRAQAVVVTYSDVHSSMAILRHVRELRPEVPVIVRTIDDTHIDALKAAGAAEVVSEVMEGSLMLASHALMLLGVPLAQVLRRVRDVRDTRYALMRGFFRGASDVDHELDQQSQPRLNTVLITQGSAAAGHTLAELALDELAVEVVAIRRQGIKGVDPQPEAEIRVGDVLVLRGGAGGLAAAEFRLLQG

SEQ ID NO: 2692 - protein, 431 aa, Prochlorococcus marinus str. MIT 9303
MIDSLDLVIDTIVAREVLDSRGNPTVEAEVLLEAGAIGRAIVPSGASTGAHEAHELRDGDSRYMGKGVTKAVNHIEDRIAPALCGISSLDQASVDGTMQELDGSDNKSSLGANAILAVSMATARAAANGLGLPLYRYLGGPMASLLPVPLMNVINGGAHAANNLDFQEFMLVPHGASTFRESLRMGAEVFHTLKGLLSAQGLSTAVGDEGGFAPNLTNNDAAGDLLIQAIEKAGYSPGKDISLALDVASTEFYKDGCYAFGGGSYTSTEMVNELEKLVDRYPIISIEDGLAEDDWQGWALLTKKLGKRIQLIGDDIFVTSTKRLQQGIDQNVANSILIKVNQIGSLTETLQAIDLAGRSGYTSVISHRSGETEDTTIADLAVATRAGQIKTGSLSRSERVAKYNQLLRIEDELGTQALYAGATGQGPRGRS

SEQ ID NO: 2693 - protein, 465 aa, Bacillus anthracis str. A2012
MTIVTFSKSTTDKPSYTYEELSVKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFYQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 2694 - protein, 441 aa, Francisella tularensis subsp. tularensis SCHU S4
MKFSDLGLNSLICSALEKKGYTKPTPIQAQAIPIVLKGNDVMASAQTGTGKTAGFTLPIIQRLLDQPKAQANRIKTLILTPTRELAAQIQEQIQIYAANTHIRSAVIFGGVSINPQMMKLRKGVEILIATPGRLLDLYSQNAVKFDSLNTFVLDEADRMLDMGFINDLKKIHNLLPKKLQTLMFSATFSSEIKNLANEFLNNPQFVSADVVNTTVKKITQKIYTLDKSNKINALISLIKDQNLHQVLVFSRTKNGANKISEKLNNAGISSSAIHGNKSQTARTKALADFKYNDINVLVATDIAARGIDIAQLPCVINLDLSNVAEDYVHRIGRTGRSGQEGLAISLVSADEVESLSNIEHLIGHLLPREELEGFEATHNVPITSMSHKTKAKKIDEVKIIAAKRAKKNNNNKKPSNKNDFAKKIRQKIHQNKNVRKPKAKD

SEQ ID NO: 2695 - protein, 419 aa, Sulfolobus solfataricus
MEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKLEDHDLRTAAMALAVDRVVRAMKARGIL

SEQ ID NO: 2696 - protein, 453 aa, Francisella tularensis subsp. tularensis SCHU S4
MSNNHFDVISLGGGSGGIASAVQAAKFGKKVAIIEKRELGGTCVNRGCVPKKAMWYGANLAEILKHDVAGYGFDVEVKGFNWAKLKEKRATYIGNIHGFYDRLLDKWNITHFNNWGKFKDNKTIVLDDGAELTADHIFISPGAYPIVPKNIEGAELGITSDEFFELEETPKKAVIVGGGYIGVEIAGVLNAHGTDTTIMVRRDKPLMEFDNCISDALVECMQMTDLNIMNHTNITKVEKTGSTLKITTDTDKVLEDVDTLIWATGRAPNTHNLGIENTDIRITDKGVIPANEWSETNVAGVYSLGDASGVPQLTPVAIKTGRYLARRLFNGETNLKANLEYIPTVIFSHPAIGTVGLTEKEARDKYGDENVKVYKSRFTALYCAISGHRMPTVMKLVVTGDNEKIVGCHMIGLNVDEMLQGFAVAINMGATKRDFDDTIAIHPTSSEELVTLV

SEQ ID NO: 2697 - protein, 153 aa, Streptococcus mitis
EHFIRGQYRSGKIDGMKYISYRSEPNVNPESTTETFASGAFFVDSDRFCGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 2698 - protein, 476 aa, Candida glabrata CBS 138
MHDMTGNSTEARRSSVHLNDQHKYIPPWTTPYIIGVGGTSGSGKTSVANKIVSSINVPWTVLISLDNFYKPLNEAERERAFNNEYDFDEPNAIDLDLAYDCILSLKEGKKTSIPVYSFTHHNRDPHKQIPIYGASVIVLEGIYALYDQRLLDLMDLKVYVDADLDICLARRLSRDIVARGRDLQGCLLQWERYVKPDAVKYVKPTMAKADAIIPSMSDNTVAVKLLIKHIESKLELKSEEHMTELVKLGQSGTGPLSDYKNLEVLPQTNQIKAIHTILLDRNVDRDEFSFQFDRIATLLLANTLNDIPVQKPETIITPDGFSVPGQRRCCFDEVTAISTIRSGDCFMKAVKKAFPAMAIGKLLIQSDSLTGEPQLHCEFIPEDISKYRKILIMDSQIISGAAMIMAVQVLLDHKVDIENIHILVYMATELGIRRIINAFGNRIKITAGIVVERNEIKNKKASWALTRFVDNKYFGC

SEQ ID NO: 2699 - protein, 461 aa, Ralstonia eutropha JMP134
MVESNNDGTLKRGLKNRHIQLIALGGAIGTGLFLGIAQTIKMAGPSVLLGYAVAGIVAFFIMRQLGEMVVDEPVAGSFSYFANKYCGHFAGFMSGWNYWVLYILVSMAELSAVGIYVQYWWPGIPTWISALAFFLIINAINLSSVKSFGEMEFWFSIIKVAAIIGMIGFGGYLLMSGNAGPQASITNLWQHGGFFPNGLGGLVMAMAVIMFSFGGLELVGITAAEADQPEKSIPKATNQVIYRILIFYVGALAVLLSLYPWENVVTGGSPFVLIFHALNSNWVANVLNVVVLTAALSVYNSGVYCNSRMLFGLAQQGNAPKSLLKVSKRGIPLTALGVSAAATGLCVLINYFMPGKAFELLMGLVVSALIINWAMISIIHLKFRADKRKAGQETRFKSFGYPLTNYLCLAFLGGILVVMYLTDGLRISVYLIPVWLAVLGISYRLRQKNAVPALQGSVSAQ

SEQ ID NO: 2700 - protein, 128 aa, Zea mays
STRPWKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 2701 - protein, 532 aa, Hordeum brevisubulatum
MGQCCSRATSPDSVQGGANGYGYSHQPKQAQAPPSYNNAQPPPRAEVRYTPPAMNPPVVPPVVAPSKPMPDTILGKQYEDVRSVYSLGKELGRGQFGVTYLCTEISTGRQYACKSISKRKLVSKADKEDIRREIQIMQHLSGQPNIVEFCGAYEDKGSVHVVMELCAGGELFDRIIAKGHYSERAAATICRGVVNVVNVCHFMGVMHRDLKPENFLLATKDENAVLKATDFGLSVFIEEGKMYRDIVGSGLLCCSEVLRRNYGKEIDVWSAGVILYILLSGVPPFWAETEKGIFDAILQGEIDFESQPWPSISESAKDLVRKMLAQDPKKRISSAQVLRHPWLREGEASDKPIDSAVLSRMKQFRAMNKLKKMALKVIASNLNEEEIKGLKQMFMNMDTDNSGTFTYEELKAGLAKLGSKLSEAEVKQLMDAADVDGNGSIDYVEFITATMHRHKLERDEHLFKAFQYFDKDNSGFITRDELETALIEHEMGDADTIKDIISEVDTDNDGRINYEEFCAMMRGGIQQPIKLK

SEQ ID NO: 2702 - protein, 141 aa, Zea mays
  misc_feature (115)..(115): Xaa can be any naturally occurring amino acid
MAGDWQELGQAGAIGLLFAFLVAKLISTGIAFKEDNLRITRSPPTSPIAAAEAAPPVPSHYGSTDGGRGSDSNWKGVESPHLDEEFSAASAFIGGSAAFGTKVPKEAQLPLYGLXKKRHRGALARPQPSGLKLKARAKGKA

SEQ ID NO: 2703 - protein, 809 aa, Arabidopsis thaliana
MSTPAESSDSKSKKDFSTAILERKKSPNRLVVDEAINDDNSVVSLHPATMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWNDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKAALRKSPIAKDVDIGALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFENSAGSGATTGVADPFATSAAAAGDDDDLYN

SEQ ID NO: 2704 - protein, 220 aa, Hordeum brevisubulatum
MDTVAVWQQFDGQEYMTGCPEEQEYRTVWSEPPKRRAGRIKLQETRHPVYRGVRRRGKVGQWVCELRVPVSRGYSRLWLGTFANPEMAARAHDSAALALSGHDACLNFADSAWRMMPVHATGSFRFAPAQEIKDAVAVALEVFKGQHPADACTAEESAPSITSSDLSGLDDEHWISGMDAGSYYASLAQGMLMEPPAAGAWREDREHDAGVDTSTSLWSY

SEQ ID NO: 2705 - protein, 113 aa, Clostridium cochlearium
EVVVCPPFICLPKIREITEGTNIKVGAQNMYFEEKGAFTGEISPIMLEKLNIDYVIIGHSERRQYFGETDETVNKKIKAAFEHNLIPILCVGETLDEKENDVTEEVVSKQVKL

SEQ ID NO: 2706 - protein, 568 aa, Xylella fastidiosa 9a5c
MSSSSIEDIKGKSHRLRGSLLESLANPTTGALHESDQTLIKYHGSYQQDDRDLREERRRQKLEPAYQFMIRTRTPGGVITPQQWLQLDAIATRYANHSLRVTTRQAFQFHGVIKRELKATMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVAIGGGMGTTHGDPDTWPRVGNIIGFITRADLIAISTAIVTTQRDFGNRTLRKRARFKYTIDDRGLDCIVGEIQQRAGITLQPARPFVFEHNGDRYGWIEGEDRHWHLTLSLPAGRIADTESSPLLSGFRAIAQLGIGQFRMTPNQNVVIAGISPGQRATIDALVTQYGLDTGNRAPTALARHAMACVALPTCGLAMAEAERYLPDFNVKLQPILEKYGLAEKPILLRISGCPNGCSRPYLAEIALVGKAPGRYNLMLGGDQRGQRLNTLYRENITETEILAALEPLLGRYQQKRLPGEGFGDFLHRTGIIALPPYPTHRHVISSTLQA

SEQ ID NO: 2707 - protein, 113 aa, Clostridium tetani
EVVVCPPFICLPKIREITEGTNIKVGAQNMYFEEKGAFTGEVSPLMLEKLNIDYVIIGHSERRQYFKETDQTVNKKLKAAFEHNLIPILCVGETLDEKENGVTEEVVSKQVKL

SEQ ID NO: 2708 - protein, 332 aa, Pseudomonas aeruginosa UCBPP-PA14
MRPEPTTTPATLSRRFSVAPMMDWTDRHCRFFLRQLSRHTLLYTEMVTTGALLHGDRQRFLRYDECEHPLALQLGGSVPAELAACARLAEEAGYDEVNLNVGCPSDRVQHNMIGACLMGHPALVADCVKAMLDAVEIAVTVKHRIGINGRDSYAELCDFVGQVREAGCRSFTVHARIAILEGLSPKENREVPPLRYEVAAQLKKDFPDLEIVLNGGIKTLEACREHLQTFDGVMLGREAYHNPYLLAAVDSQLFGSEAPPLSRSEALLRLRPYIERHQAEGGAMHHVTRHILGLAQGFPGSRRFRQLLSVDVHKAADPLRVFDQALELLAGR

SEQ ID NO: 2709 - protein, 113 aa, Clostridium pasteurianum
DVVVAPTSIALEAVVNAVKGTNVKVAAQNAHFEESGAFTGEISLKALQELGVEYVILGHSERREYFNETDAALNKKVKAAFAHGITPILCCGETLEEREANVTNEVTGKQIKL

SEQ ID NO: 2710 - protein, 113 aa, Clostridium magnum
DVVVCPPFVALDAVLKAVKGTNIKVGAQNMHFEEKGAYTGEVAPEMLEKMGVEYVIIGHSERRQYFNETDETVNKKVKKALEHNLIPISCCGESLEERETNVTEEVLGRQIKL

SEQ ID NO: 2711 - protein, 570 aa, Oryza sativa Japonica Group
MAKARRGGHRRCRRRRRWPGRVRGLAEGRAGMGPMGRGTGRGAMGGFPAGAFGLWFSMEESSREGRWWPPARADGDGGRKKMRGGLHAIMLERTKIPLLLPSSTSDKGCLAGSPLPRPPHPPPPPLPFLPDNPRFVHLHLRTTSSPPRPSPTDDPVVTLHAIRATDADVGGLRLSCQPAVLATPVLPDGGGAPARRSRWWAWPWRRRGAVVIGGAGDGGGGRDGCEGSRRAGLGWGRWEGAPGREPMGGVPAGAFGLWFSMEESSREGRWWPPARADGDGGRKKMRGGDSDKLIFERLQREFEAARTAQTEEIPIDDEQWNDGLLATIREKVHMEADRKAMANQANVPADPQFQSRTTYRVKNKVIYCLDGARIGIQYETYFAGEPCEIYHCVLESKSFLEKMTVIEHTLPFFLPIREVESEFLSSNAIKFIDHLEEILQSYVDRREQVRLIKELYGNQIGELFHSLSYNLIEFVMEDFECKVTVSIRYSDLLFTLPSQARVLAWPLRSSRGISVTERRASRSASAQLVPFRLPYAEDALKTLSLPEAFAEIVLSLPRALKRILSSQESD

SEQ ID NO: 2712 - protein, 363 aa, Prochlorococcus marinus subsp. pastoris str. CCMP1986
MNNILITGGAGYLGSHACLNLLEAGYGIYIVDSLENSSFESISRVNRFFKEKNKFADNKIKFFKADITNFEKLKIIFEHALCNNQKIIAVLHFAGLKAVSESEENPIKYWEYNVSGSINLFKVMELYDCKNIVFSSSAAVYGNNQNCPIKEDSSLIPSNVYGKTKKTIEEILTDLHFRKNWGVAILRYFNPVGAHHSGIIGENPISNKNNLFPIICEVAKDNNKKLNIFGKDWPTRDGTCLRDYVHVEDIIDGHEKALRLLLNSKHNLIKVNLGTGKGTTVLELINTFKKVNDIKIEYEFSERRIGDCGVLFADSRLSNSILNWKARKTLDDICRDGWRWGLKNPYGYIKNLEELDLSIYCEI

SEQ ID NO: 2713 - protein, 141 aa, Triticum aestivum
VKLVFPIDFVTADKFAPDAKTGYATDADGIPDEWEGLDCGEQSSKLFREEILKSKTIVWNGPSGVFEFDAFAKGTKSVLEAVIEATKEGATTIIGGGDTATAALNWDAADKVSHISTGGGASLELLEGKELPGVTALSSKN

SEQ ID NO: 2714 - protein, 341 aa, Prochlorococcus marinus subsp. pastoris str. CCMP1986
MDTILVTGSAGFIGSSLSIKLVHKGFRVIGVDNLNSYYSVSLKKDRLKEIIKSTKFNKGKYEGFNFSIENINELEKLFTKYKPKFVVNLAAQAGVRYSLIDPHQYVQSNLVGFHNIIYLSKKYDVRNFIYASSSSVYGGNTNMPFNESQSVDHPVSFYAATKKCNEVIAHSYSHIYDLPTTGLRFFTVYGPWGRPDMAPMIFTKAILSGDEINIFNNGEMMRDFTYIDDVVDGIVGCVYKSAESSDNFNRDKPDPSISFAKHKIFNVGNGNPIKLMKFIELLELSIGKSAKKIFKPMQTGDVIATSANINKLSDWIGYEPKINLTEGIGKFVKWYKEYVRI

SEQ ID NO: 2715 - protein, 298 aa, Blastopirellula marina DSM 3645
MTSASLATLHEYSDTLRDEVDQALNVYSSFGEGCPDRLQEAIRYSLLAPGKRLRPLLTLMAAETCGSDRTQAMPSACAVEMIHAYSLIHDDLPAMDDDDLRRGRPTCHKAFDEATAILAGDALLARALEIVADGYQDPLVAARSCRELAKAAGATALVGGQADDLNEQFGSGDVEMLKAIHRRKTGAMICVSLRLGAIAAGADDQQVAQLNLYGEQIGLAFQIVDDLLDYAGDEAALGKRVGKDAERGKLTYPGLIGVAESRRQAESLIAGAKQSLADFGERANHLEALAQYILERNH

SEQ ID NO: 2716 - protein, 326 aa, Glycine max
MDVPNSPEISVDVPPYLRVHKDSTVERIAGTQVVPAGLDSDTNVVSKDILVVPETGVTGRLYRPNSTPPTANKLPLLVYFHGGAFCISSASDPLYHTSLNNLVAEANVVALSVNYRLAPEHPLPTAYQDSWSAIQWVADASRAKQHHQEDWIRDNVDFDRVFLAGDSAGANLGHYMALKLNNNFPTNDGFDFKVAGLIMVNPYFWGKEAIGVEITDPERKKMVDKWWSFVCPSDKGNDDPLINPFVEEAPGIEGVACDRVLVTVAEKDILRERGKLYHKMLSNSDWRGTAEFHETPGEDHVFHIFNPNCEQAKSLIKRIAHFINEH

SEQ ID NO: 2717 - protein, 639 aa, Blastopirellula marina DSM 3645
MHQILSKIESPADLSNLSNEQLEQLAAEIRDVLCSLVATRTAHFASNLGVVELSIALHRTFDFSRDRLIWDTGHQIYPHKLLTGRYDEFGTIRTTGGLMGYPNPAESDYDLFVTGHAGSSVSTMLGLRSGDDLQGEKDRHAVAVIGDGAFPSGIVFEALNNAGGMNANLLVVLNDNKMSICPRVGGVADYFDRLRMNPFYTGVKSEVLKILNHVPLLGDPTERLLAQCKEAVKAGLHGGMLFEELGFSYIGPIDGHNIGLLRKYMEMVKTLPGPVLLHVVTEKGHGYQPAAADPVFFHTPPAFIDDNGTVVPKKSGGAKAYTNYARDAIAEQMRKCDKVTVMTAAMCQGTKMEPVRDEFPHRFFDTGICESHAVAFAAGQAKTGLRPIVNIYSTFLQRSFDQIFQEVALQDLPVVFTMDRAGLTAADGPTHHGSYDIGYMRLFPNMIVMAPGDAEEVGEMLDFALLQDHPSAIRYPKANAETVERNRTPIGLGKAEVMSTGADGAVICYGAQLADAQRAVETLKSEGLNVGLINARFCKPIDRETIVGAVKTSPFVVTVEEGALMTGFGSAVLEACADEGVDASRVKRLGIPDTFIDHGEREERLAEIFLTAEGIAQVCREMAAKISSLHGDDSLTAGS

SEQ ID NO: 2718 - protein, 350 aa, Oryza sativa Japonica Group
MSLQVPNVQELALTCNRPDQQIPDRYIRPEAGTEEVICGQGINTAIPVIDLAKLLNPQSSQEECAKLRSACQHWGFFQLVNHGVPDDVISDVRRDLTEFFKLPLEAKEAYAKPPDKYEGYGQHFVVSEKQKLDWGDLLHLRLRPTESRDLRFWPAHPSSFRNSMERYSLETAKVARCLLEFLAMDMGVDPESLLEVFRGQPQNMRVNYYPPCRQTGKVLGLSPHCDATSLTLLLHVNDMQGLQIRKDGKWLTIEALDGAFVVNVGDMLEILSNGRYRSVEHRAVVHPEKERISAAVFHQACRDATVGPLPELVTKDGGRPVYKSMAYEDFMKRFFSAKLDGRANVEGMKI

SEQ ID NO: 2719 - protein, 203 aa, Triticum aestivum
  misc_feature (112)..(112): Xaa can be any naturally occurring amino acid
  misc_feature (138)..(138): Xaa can be any naturally occurring amino acid
MSSQGNDQEQDVLPEQTEGFRVGEKKTMNEYQQLDAEDEAMQRYKRSLGIGGDGKYLTDPNDPRQCIILSLTMESQDRPPVTIDLSEEDSLSTLKDKPFKIKEGASYSMTAXKFKVQHEILSGLHYVQIIKRKGIRVXKDQEMIGSYAPNTEANPVYTKRFAVNTAPSGIMARGNYTVISNFIDDDKKVHLIFEWSIMIGKDW

SEQ ID NO: 2720 - protein, 422 aa, Aquifex aeolicus VF5
MEHHLHHIIQETAPYLVLLFMFIFGYTFQKVNIPSIIAFMIIGFLAQPLVPPEKIKDFEIFKHAGIILLFFFIGLEYSFERLRTMLGAWKTGSIDFVFNFIPPFIIAYAFGFDLITALILAAVFYPSSTSIIAKLLMDYKRIASPEAELLIGILIFEDLVAILLLTIIIPLKEAGSIEFTTIPVSLVKLGVAFLLFWLIYKYLIPKINAWLDRVSEEDIFIFFTLGLVLSIGTIFHSLGISEALGAFLLGVIVPETKVLENIEKQLSDLKELSMGLFFFFFAYETQLTKPENLGLLILLIVLGIILKIISTYLAGYVFGLKKKSRLRASLSFVPRGEFSVIMTSFEPALKSTSIPFIFLTAVIGSILFALAPKVADIIYPPKKKKKKKPIKRPKKGYLKRSRAFSEHAPSLQSSRPETPPQQ

SEQ ID NO: 2721 - protein, 382 aa, Candida glabrata CBS 138
MSAPEVSKITAIPPISLNEDREKSSFWSANPLSSFVIDTYRQLHAHRQSLSLVNPGTVENLNKEVSRDVFLSQYFFTGLRADLNKAFTLNPAFQTSHTFSIGSTSLPNYAFSALFANDNLFMQGNIDNDFSLSGRMNYGWNKNNISKINLQIANGQPTMCQLEQDYQASDSSLNFKSLNPSISSNGTLTGVYVGSLLQSISPQLAVGLEVLYSRADAKTPADSGVSYLTRYVSPKQDWIFSGQLQANGALVASFWRKVAPNVEAGIETTLQAGMIPITDPVMGTPIGIQPTIEGSTTIGAKYEYRQSVYRGSVDSNGKIGCFLERKILPTLSVLFCGEIDQFKQESKIGCGLQFETAGNQELLMMQQGLDADGNPLQALPEM

SEQ ID NO: 2722 - protein, 669 aa, Oryza sativa Japonica Group
MEAAALSTVLCVLALVVADADHHVVHVQGRRHRQCQPFSCGHLSNITHPFRRRGDPRRCGVSSYELDCSSDDGKATIRINTGKYYVSSIDYTASIFWVVDANLQDDANSSCPLPRSDQLPYVGLGIPGSHDSWDLGLDDMITWVGFVNCSQELITNSSSKYQPMNCLTTTSSYVYYMLPSFGAPSIQDIEPSCGYLAMTPIGGGSNGNSINLSEYEDVVKSMRGGFAVKFPTYGGPWTTWYGLIKDCLNESVSLADSHDNPLPRVGIKDRIIDILSIDLRFWGCMIGISRRFVFAPLVVMIFLTRKYWKTRIAIDAVEKFLRMQDMLGPKRYAYTDIIAITSHFRDKLGQGGYGSVYKGVFLPGDVHVAIKMLDGNSNCNGEDFISEVATIGRIHHINVVRLVGFCSEEMRRALVYEYMPRGSLNKYIFSSERSFSWDKLNEIALGIARGINYLHQGCEMQILHFDIKPDNILLDDNFVPKVADFGLAKLYPREKSFVSDRALRGTVGYMAPEMVSRSFGVISDKSDVYSFGMLLLEMAGGRRNADPNANSNASRAYYPAWVYDQLIADQQVDEISNVADMHELERKLCLVGLWCIQMKSHDRLTMSEAIEMLEGGVDALQVPPRPFFCDGDGIGNGMPPPQVMDSYFHSSELTAISEEDDGISELASS

SEQ ID NO: 2723 - protein, 222 aa, Zea mays
MDVDGPAPADASARPATNGEAPSGAREVDVGEEDTLAGVLRSFVDGVWYPDEPLLRRLRAASCDAAPRLRGASRNSARDLLEWTRRGSGLRAILVISVGTITLIALTGLLTFMFFLLVATANAIIVSVLMSLAAAGGFLAIFFACLVAVYIGAVSVAIFVISATVISAVVGILVATGWVGFFWMIWFTARKSMVLTKHSFGMTSSAIQSYSASRQVKQKPVD

SEQ ID NO: 2724 - protein, 478 aa, Aquifex aeolicus VF5
MAEVIKGKVVQVIGPVVDVEFEGVKELPKIKDGLKTIRRAIDDRGNWFEEVLFMEVAQHIGEHRVRAIAMGPTDGLVRGQEVEYLGGPIKIPVGKEVLGRIFNVAGQPIDEQGPVEAKEYWPMFRNPPELVEQSTKVEILETGIKVIDLLQPIIKGGKVGLFGGAGVGKTVLMQELIHNIARFHEGYSVVVGVGERTREGNDLWLEMKESGVLPYTVMVYGQMNEPPGVRFRVAHTGLTMAEYFRDVEGQDVLIFIDNIFRFVQAGAEVSTLLGRLPSAVGYQPTLNTDVGEVQERITSTKKGSITAIQAVYVPADDITDPAPWSIFAHLDATTVLTRRLAELGIYPAIDPLESTSKYLAPEYVGEEHYEVAMEVKRILQRYKELQEIIAILGMEELSDEDKAIVNRARRIQKFLSQPFHVAEQFTGMPGKYVKLEDTIRSFKEVLTGKYDHLPENAFYMVGTIEDVIEKAKQMGAKV

SEQ ID NO: 2725 - protein, 343 aa, Ralstonia eutropha JMP134
MDTASELQATIRAMVQPGKGLLAADESGPTIAKRFTTIGVESNEENRRAWRSLLLSTPGLGAHISGVILYEETLGQRADDGTPLPELCARQGIVPGIKVDKGKVPLVNAPGDEITEGLDGLPKRLEAYRQQGARFAKWRAVFNVSDTLPSALAVQANAQVLAAYAAICQASGIVPIVEPEVLMDGDHGLARSAAVTERVLHAVFHALHRYGVVLEHMVLKPSMVIAGKKSAQQTSVQDVATETVRVLKRTVPGAVPGIFFLSGGQTPEQATANLDAMNRLGPLPWPLSFSYGRALQEPPLAAWRGQAANVGKAQQALLQRSLLNGEACQGQYEAAQESMEKVG

SEQ ID NO: 2726 - protein, 465 aa, Clostridium perfringens str. 13
MSNNIGKVVQVIGPVVDIKFANDELPNIFNAIHIKMDDGKILVCEVEQHVGDDIVRTIAMEATEGLRRGVEAVDTGAPISVPVGECVLGRIFNVLGKPLDSGAEVNNEEKYPIHRPAPSFEEQSVVPQMFETGIKVIDLLAPYQRGGKIGLFGGAGVGKTVLIQELINNIAKEHGGLSVFTGVGERSREGNDLYYEMMESGVIKNTALVFGQMNEPPGARMRVALTGLTMAEYFRDQGQDVLLFIDNIFRFSQAGSEVSALLGRIPSAVGYQPTLATEMGALQERITSTTHGSITSVQAVYVPADDLTDPAPATTFNHLDAKTVLSRSIAEIGIYPAVDPLDSSSRILDPRVVGEEHYEVASKVKHILERYKELQDIIAILGVDELADEDKLIVARARRIQKFLSQPFTVAEQFTGMQGRYVPIKETIRGFKEILEGKHDNVPESAFLFAGTIEEVLEKARAMAQ

SEQ ID NO: 2727 - protein, 231 aa, Haemophilus influenzae R2846
MTRKILIVEDECAIREMITLFLSQKYYDVIEASDFKTAINKIKENPKLILLDWMLPGRSGIQFIQYIKKQESYAAIPIIMLTAKSTEEDCIACLNAGADDYITKPFSPQILLARIEAVWRRIYEQQSQFIQIDELSIDENAQRVFFQQQEINLSSTEFKLLHFFMRHPEKVYSREQLLNRIWHNDLEVEYRTVDSYIRRLRRNLAPFQCEHYIQTVRGSGYRFSSYLRDKQ

SEQ ID NO: 2728 - protein, 263 aa, Magnaporthe grisea 70-15
MQPLSNEQVQKLSNYDTLAQADDAQPAIVTSIPEVPITEARKPWQPEDEDRLPRPGVGRANIAATYDQPEGTTEGDYAAKHSDQTVLQQHLEFFDRDRDGIIWPRDTFIGFYRLGFGAVLSFLSIFVIHSNFSYATGDSWIPDPMFRINLSNIHKDKHGSASGAYDAEGRFVPQRFEDLFAKHAQGRDYMTARDVVNLLKGQRMIADPVGWFHAFIEWTATYYMLWPEDGRMKKEDVRGVFDGSIFYTIAARREEKMDEAKRR

SEQ ID NO: 2729 - protein, 198 aa, Sulfolobus shibatae
MSNSAVSYKPIVNIENIVATVTLEQSLDLYAMERSIPNIEYDPDQFPGLIFRLEQPKVTALIFKSGKMVVTGAKSTEELIKAVKRIIKTLKKYGIKIMGKPKIQIQNIVASANLHVNVNLDKAAFLLENNMYEPEQFPGLIFRMDDPRVVLLIFSSGKMVITGAKREDEVSKAVKRIFDKLAELDCVKPIEEEEELEL

SEQ ID NO: 2730 - protein, 324 aa, Pseudomonas putida KT2440
MSRIFADNAHSIGNTPLVQINRIAPRGVTILAKIEGRNPGYSVKCRIGANMVWDAESSGKLKPGMTIVEPTSGNTGIGLAFVAAARGYKLMLTMPASMSLERRKVLKALGAELVLTDPAKGMKGAIEKANEIVASDPEQYFLPGQFENPANPAIHEKTTGPEIWNDTDGAIDVLVAGVGTGGTITGVSRYIKHTQGKAILSVAVEPVASPLISQTLAGEELKPSPHKIQGIGAGFVPKNLDLSIVDQVETVTDEESKAMAIRLMQEEGILCGISCGAAMAAAVRLAEKPEMQGKTIVVILPDSGERYLSSMLFSDMFSEQETQQ

SEQ ID NO: 2731 - protein, 317 aa, Brucella suis 1330
MSSSSDAIKAALEKGRAAGLSATGGKNADYIPFLASVPSDLFGLAVVTADGQTFKTGDADFAFAIESISKVFTLALVMEEIGPDSVREKVGADPTGLPFNSVIALELHNGKSLSPLVNAGAIATASLVPGDTADARWNNILECQCGFAGRRLKLSNEVNQSEQTTNFHNRAIAWLLYSAGTCYSDPMEAVDIYTRQCSTLVTATDLATMGATLAAGGVNPISGKRMVSAGNVAPILAEMTMEGLYTASGDWAYTVGLPGKSGVGGGIMAVVPGELAIAAFSPPLDPAGNSVKAMAAVAAVADSLGHNLYTTRGKVSS

SEQ ID NO: 2732 - protein, 113 aa, Clostridium scatologenes
DVVVCPSFVCLDAVLKAVKGSNIKVGAQNMYFEEKGAFTGEVAPSMLEKMGVDYVIIGHSERRQYFNETDETVNKKVKKAFEHKLIPIVCCGETLEEREKNVTEEVLGRQIKL

SEQ ID NO: 2733 - protein, 173 aa, Zea mays
ADHVGRCRVIPPIKPFPRSSGQTIPWFLLPSANLSKAAGGALQKTTPQLMIRSYELGVLFFPQPLQSVPQFSSPEKTRPFGEGVPLAKTIKPKLVPFCWKGEEGDPSFVGLPVPSQLPPHPYGPQDVPWSGDRGSPKKDVYGSFCPRYGYPVIWFFLFPRKRGFLPLFLFGSV

SEQ ID NO: 2734 - protein, 532 aa, Aspergillus oryzae
MAVLKVASNANAALTLPAILAAAYGWTGANYNIGLKNTENGIVCRFSPEPSGYLHIGHAKAALLNSYFAYEYGDKRGTLICRFDDSNPSKESEEFRESILRDLSLLGVIPDQMYEACIGLIKSGKAYADNTIKEIMQDQRMKGIACACRDMSPRESLAHIEEMKSGSEEGLQWCIRAKISVDDTNKALQDPVIYRCNHEPHHRTGSTWKIYPTYDFCAPFLDSIEQVTHALRTNEYRDRNPQYHWMQEALGLRKVEIWDFSRLNFVRTVLSKRKLTAIVDKGVVWGWDDPRMPTVRGIRRRGCTIPALREFILKQGPSQNIVNMDWTRFWAINKKYIDPVAARYTAIPSLNAVTALIDGVEATTSAEKPKYKNPSLGTKKVIFSKEIIISQDDAQHFKENERVTLMNWGNAIVSRITTDPATGKVLTLNLKLDLESDVKLTEKKITWLAKDSSNMVPIKLYTFDHLISKDKIEKDEDFASFLTNPSEFCTEAWADCNDDTIQFDRTGYLRVDQAYCDGQPAVMFNIPTGKGA

SEQ ID NO: 2735 - protein, 113 aa, Clostridium tyrobutyricum
DVVVCPPYVCLDTVLKAAKGTNIKVGAQNMHFEESGAYTGEIAPAMLESMGVEYVILGHSERRQYFNETDAAINKKVKKAFEHNLIPIICCGETLEEREADVTEEVLGKQIKL

SEQ ID NO: 2736 - protein, 113 aa, Clostridium tyrobutyricum
DVVVCPPYVCLDTVLKAAKGTNIKVGAQNMHFEESGAYTGEIASAMLESMGVEYVILGHSERRQYFNETDAAINKKVKKAFEHNLIPIICCGETLEEREADVTEEVLGKQIKL

SEQ ID NO: 2737 - protein, 471 aa, Bacillus cereus G9241
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLKGFGIHIPTILSSAPGTGKGGIIDLPAVLIILVMTVLLSRGVRESARVNNIMVFIKIAVVLIFIFAGFNYVKPENWTPFMPFGLDGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPILPALTVIFCLYLMLQLSGTAWISFGIWMVIGIAVYFLYSRKHSALNNSKDEEDVANL

SEQ ID NO: 2738 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 2739 - protein, 533 aa, Nonomuraea sp. ATCC 39727
MTDPAAPAEEAVTVAAAVAGTATTEAVAAANPLRDPRDKRLPRVAGPCVMVLFGVTGDLAKRKLLPAIYDLGNRGLLPPGFSLVGFARRDWKDQDFAQLTHDAVKAHARTPFREEVWKQIREGIHFVPGEFSDDGAFDALAMALAEIDETRGTGGNYAFYLSVPPKFFPVVVEQLKRTGLSDAPDGSWRRVVIEKPFGHDLQSAHELNEITTSAFPESSIFRIDHYLGKETVQNIMALRFANNLYEPIWNRSFVDHVQITMAEDIGIGGRAGYYDGIGAARDVIQNHLLQLLALVAMEDPTSFEANSLRREKEKVLKAVRLPANLGLNTARGQYSAGWQGGEKVVGYLQEEGISQESTTETYAAIKLEIANRRWAGVPFYLRTGKRLGRRVTEVAVVFQRAPHLPFSKDDTEILGQNALVVRVQPDEGITVRFGSKVPGTAMEVRDVSMDFAYGESFLESSPEAYERLLLDVMIGDPPLFPHQREVELSWNILDPIEEFWATQGQPEPYESGSWGPESADAMMARDGRVWRRL

SEQ ID NO: 2740 - protein, 347 aa, Brassica napus
  misc_feature (79)..(79): Xaa can be any naturally occurring amino acid
  misc_feature (89)..(89): Xaa can be any naturally occurring amino acid
  misc_feature (102)..(102): Xaa can be any naturally occurring amino acid
  misc_feature (110)..(110): Xaa can be any naturally occurring amino acid
  misc_feature (119)..(119): Xaa can be any naturally occurring amino acid
  misc_feature (124)..(124): Xaa can be any naturally occurring amino acid
MADNKKIKIGINGFGRIGRLVARVILQRNDVELVAVNDPFITTEYMTYMFKYDSVHGQWKHNELKIKDEKTLLFGEKPXVTVFGIRNPXEEIPLGVRPELDXVVEVLTGXVFTDKDKAXAAHFXKGGAPRKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDNRSSIFDAKAGIALSDNFVKLVSWYDNEWGYSTRVVDLIIHMSKA

SEQ ID NO: 2741 - protein, 315 aa, Buchnera aphidicola str. APS (Acyrthosiphon pisum)
MPDMKLFSGNSIPKLAKFIANRLYINLGKASVGRFSDGEISVQINENVRGSDVFIIQSTCSPTNDNIMELVVMVDSLRRASAGRITAVIPYFGYARQDRRVRSARVPITAKVVADFLSSIGVDRVLTVDLHAEQIQGFFDVPVDNVFGSLILLEDMLQRELKNPIVVSPDIGGVVRARAIAKLLYDTDMAIIDKRRPRANVSQIMNIIGDVANRDCILVDDMIDTGGTLCKAAEALKERGAKRVFAYATHPVFSGDAPKNLKNSVIDEVVVCDTIPLSENIELLPNVRTLTLSGMLAEAIRRISNEESISAMFEH

SEQ ID NO: 2742 - protein, 502 aa, Herminiimonas arsenicoxydans
MSDNQSALPTETPIVIPDVAPAIRFQDFGLAPEILKALNDQGYVHPTPIQAEAIPVVLKGMDVMGAAQTGTGKTAGFSLPIIQLLMAHANSSASPARHPVRALILTPTRELADQVAANVKAYSRHTPLRSLVVFGGMDMTPQTAALRGGVEIVIATPGRLLDHVQQKTINLSQTQILVMDEADRMLDMGFLPDLQRIINLLPKQRQNLMFSATFSPEIKKLAATFLKDPVTIEVARSNATAENVTQIIYKVEEEAKRDAVSFIIRERGLKQVIVFSNTKIGASRLARQLESEGVKASAIHGDKSQSERMQALEQFKNGTIEVLVATDVAARGLDIAELPCVINFDLPYNAEDYVHRIGRTGRAGASGDAISLFSDKDARLLVDIEKMIKHKFVPAELIGFTPSSGRTAERSHDRRAHERSPRKDESAPRPSRAPERSPGAASNGSRSAYAAAPRKEKIDPFFTRPYEPAPSTMVSDNKLADQVPAKPQKHKMAALLGGAPKR

SEQ ID NO: 2743 - protein, 405 aa, Buchnera aphidicola str. APS (Acyrthosiphon pisum)
MKTVDIEVKMPDIGLEEVEIIEILVSINEKIAPEQGLITVEGDKTSMEIPSPISGIVKHIFIKIGEKIKTDALIMRCEVENIDFHVKKKEEICLDNNVLNKVEKNFKKDIFFHATPLIRRLARNLNINLYDVVGTGPKNRILKEDLDLYQSNIKENLIEEKNKINFGDSKKSKTKELELSDIQKNIGNNLHRNWMNIPHVTQFDEVDITILEKFRQKYNNEKRNQKKTNENITILVFIIKVVAYALEKFPIFNSSLNINNKKIILKKYINIGFAIDVNNDLFVPVLKDVNKKNIKQLSSELILLSEKARTRKLNIEDMTGGCFTISNLGGIGGSWFSPIINSPEVAILGISKSQIKPSWNGKEFIPSLMLPLSLSYDHRVINGAYAARFITFISRVLSDMHFLIM

SEQ ID NO: 2744 - protein, 401 aa, Prochlorococcus marinus str. MIT 9303
MAKRSLSSLSAADLRSKRVLVRVDFNVPLNENGAITDDTRIRAALPTINDLIDKGARVILSAHFGRPKGQINEGMRLTPVAKRLSELLGKTVIKTESCVGSDAEAKVNAMADGDVVLLENVRFFSEEEKNDANFAQKLAALADAYVNDAFGAAHRAHASTEGVTKFLNPSVAGHLMEKELQYLQGAIDDPKRPLAAIVGGSKVSSKIGVLEALIDKCDKVLIGGGMIFTFYKARGLSVGKSLVEEDKLELAKELEAKAKAKGVQLLLPTDVVLADDFSPDANSQTVSIDAIPDGWMGLDIGPDSINLFQDALADCQTVIWNGPMGVFEFDKFAAGTNAIATTLADLSGKGCCTIIGGGDSVAAVEKAGLAEKMSHISTGGGASLELLEGKVLPGVAALDDA

SEQ ID NO: 2745 - protein, 153 aa, Streptococcus mitis
EHFIRGQYRSGKIDGMKYISYRSEPNVNPESKTETFASGAFFVDSDRFRGVPFFFRTGKRLTEKGTHVNIVFKQIDSIFGEPLAPNILTIYIQPTEGFSLSLNGKQVGEEFNLAPNSLDYRTDATATGASPEPYEKLIYDVLNNNSTNFSHWD

SEQ ID NO: 2746 - protein, 147 aa, Zea mays
MATTPGLCGSVLLSTSFLRKQAMASVNMRMLKANAGVFGLKGGRGGRVSAMASYNVKLITPEGEQEFECPDDVFILEKAEEFGIDLPYSCKAGACSSCAGKVVSGKVDQSDGSYLDDTQIGNGFVLTCVAYPTSDVVIQTHQEDELF

SEQ ID NO: 2747 - protein, 28178 aa, Synechococcus sp. RS9917
MGKRRRRRNRSTSKAQPQATPRRAPGQRVRDLASTATVAAAAMVMFGGGRAALALPQGMTVRGGQLTIQRPDGKTAVIRQGSKRGAADFKRFDIDAGEQVRIEQPDAKSVFLGRVTGGKLTEIHGRLDANGRVLLINPAGVLIGPGGVVNTASFTASTLQVDPDQFMAGGVVELKALPGDDPNAAVINQGTINVADGGFAALVAPHVVNDGVITARLGQVQMASGTAATLDVSGDGLVAVVLDPAVAGSITNRGTVQASHVRLGGGDAAALTAATVNLGGVIEARSAADVLGLDPAVASDAEQQASIEAVSSGVITVDGRVDASASAAGLKGGEVKLLGRAITLKPTAAVEASGPAGGGEVLVGGNDLGQGPEPNAQQVSIEAGAAIRADATQAGDGGRVIVWSDERTDFHGEISAKGGPEGGDGGFVETSSKQTLVVTGKVSTAAAKGKAGQWLLDPEDVEIGDEAAAQEEEAAAQEEEETSAETEETAAEVEAEAEAESEADTNTESKSESESEKEEKVEKGEKDEDEDDEEEETTSAASSESDESSDKPEAETASDSTSDSSGSFISKDSIETARGEGTEVTVVSSGEVSGAESEEASAEKGGLTVISNAEDPAAAVAAAQASEDAESSESSISGSSIETARDAGTEVTVVSSGEVSGAESEEATAEKGGLTVISNAEDPTAAVAAAQASEDAESSESSISGSSIETARDEATEVTVVSSGEVSGAKSEEATAESEASSDRQASPEDPISTPELYTLYLNGDDLNLSAQQEQLSGRNVVIASCEGSCTTDRAGNIFIDSLSGLASLQVLALADVTLEKEISVSGGLSFAGALTFSGTEISIRANELVLSGPVQVAEPVKAAGGPALTISSASSDRAIQLGGAGQASVNLDAPAAELQLGSSTLNKLNQAGLAELKIGGTDHTGGINLDASASLKASNAVSLESQQVNVAGAITASDGNRGGQVTITGDQLTVQGTARIDASGAAGGGEILIGGSWQNENPAVRQAETTTIEAGAVVDASATGNGKGGTIVAWSDITNPTGHTTVAGTLLAKGGAQGGDGGRIETSGYDLKVDGINVSTEAPLGKTGQWLLDPRDITISSSGDTVSGNYTAAADSAFIDVATLQTALNSTNVTVFTGSTGTQAGTISVSSAISSGSTYDLELKAASDIVINADITRSGTGGITLRAGSGSVSGTGDLILGGGTTLSLAHGTTLANDIQLTSGGATIGFAGLAVEYLIVGGGGNGEGIYSGYAQGGGGGDVKTGSLQLSGSSSTITVGAGGTTGTGTTGKGGDSSGFDITAAGGLGSISASGGTSGSGFTGGAGLYDGGGGGGAAGTGTAGTNGSGTRRAGAGGIGIYSDITGSQVGYGGGGAGGYLSNWTVGTGGQSYGGGGPGQSGTANTGGGAGGGKDGGSGVVIVRYQGAQAATGGTTTSGTGTAADYTIHQFTAVGSSTFEINNLAATLTGSISGSDQLTLAADRGTLTLSGANTYTGTTSISGGSVKATSSDALGKGSAVSLSNTAGATLELANTSADPVATPLTVSIGALSGGGISGGNVVLGANTTLSTDGAATPFAGVISGSGTLTKSGAGTLTLTSSNTYSGGTSVSAGTLQLGSGGASGSAGTGTIDIATGATLATNRSNTLILSQAISGDGSVEQAGSGSLTLTSSNTYTGGTTVSAGTLITRSDAALGTGMVSLGGGVSLLIGHGVTLANAIDITGNATIGFADLEVEYLVVGGGGGGAGRDVGGGGGAGGLLTGLTTLGSTTSVTVGDGGAGGTDANGSRHGERGDDSSLGTITAFGGGGAAGYGTVLANSQQDGGSGGGGAGLTNYEAGSGKAGQGFAGGGGAGGSDYGGGGGGGAGGPGASSADGGDGGVGVYVAWADAAELGESGYFAGGGGGAGHRTADPGHSGAGGLGGGGDVPGTDGQSTPAGNGGAGQANTGGGGAASRNAGTSGGAGGSGIVAVRYAGPVTATGGTAKSFTGDGTNGVNGVEYQVHAFTSSGTFTVTDNMVAAITGSISGNGDLTLTTQRGTLTLSGTNNYTGATSITGGTVKATSSSALGSGSAVSLSNTAGANLELANTDLDPTNNNLTVSIGSLSGGGTSGGNVVLGADTTLQIGSAGTSTSYAGTISGSGAITKTGAGTLTLTGNNIYSGGTNVSAGTLQLGSGGSSGSAGTSEIQIASGATLAANRSDTLILSQAISGAGTLSQIGSGRLSIAGDNYDDGNNTGFTGAVSISSGTLGVYNNQALGTAAVSIGAARLEFGRAVTSFANDITLTDAATIGLDTTVEYLIVGGGGGGRTRHGGGGGGGGLLEGSIDLAGWSGDVVVGSGGAAGQKGGDSGALGLTAIGGGSSNSITGGSGAGGSGPQVGGAGTDDQGFAGGSGVGGGAESTYGGGGGGGAAAKGGDASGNGAIGGTGGDGVYVDWVAELGLGDNGYFAGGGGGGVASTSNSAGAGGLGGGGAGSKGTAAATSGDSNTGGGGGGGGFAGDTNATPGSGGSGIVVLRYLGAAAATSGSTADSGAAQTGSGLSDGYTVHTFKSGSQSFTLAASSVTLGGTISGTGTHSVQLDTNGGGLILAGANTYSGDTTITSGRVEVSGSLGQGNYAGAISNAGTLVLNSANNQTLAGNITGKGSLEQAGSGTTTLTGSGNAYTGATTISDGTLRIGDGTANGSLGGNGTVAIGANGQLIFDIISNSTFVSSKNISGAGTFEKTGAGQLTLTGTNSYNLTKISEGTLQIGDGGTTGSAGTGEIQIANGAVLATNRSNGFSITGAITGAGKVVKNGSDLLNLAGANTFSGGMDVTAGTLALSTTNAGGFSGGLRMGLDGNANTELVLAPGVDLQSDLTLNGTVAITLGLPVDYLVVGGGGGGGGDNGGGGGGGGFVEGTAILTSSSAAVVVGGGGSGGTVNQPGAKGGDSKFGSITAVGGGGGAGGDANSGRNATTGGSGGGGDGETNTVNRLGADGTTGQGNPGGDGFSGGGGGGGGAGAQGENATGPGQPGSGGAGLPSTITGTETFYAGGGGGGPDNTTAVTTGYGLGGVGGGGDGKLGTGEAGATNTGGGGGGGGYNSSGTGIGGAGGSGVVVVRYLGDTDIANGGTETAPNTGSAAGYRIHTFNSSGSFDLSGVDFTATISGNVTVNAGAALNVESAGDLTISGNISSADAANAGTVTLTGTPVASHAPFLTTTATTVATGMTVQEALDSITGAKLGGGAVNSGTALTGTITRRSFDSSTGKGYFQVQAQNGLNKVAVVELSQSGSDVQAKVIRAAYGSGDLFGEDFSTGFTNFTIASNSSTNGYGVLNLSFTGSLTLAGDNSGFSGAFNLNSGNLRAESANALTAAAVTLSSSANTQLILANTAADPSTNPLTVAVGSLAGGGGAKGNVGLGAHTTLKVGDASTTSFDGTITGAGGLRKDGSGTLTLTRSNVYSGTTTIANGALQLGNGGALGMIALSNITNDGELIFNRSDEIVLTGSISGTGAIEQAGPGTLRLTAASTYSGGTTVSAGTLITGVTGAAGTGAITLGSATTLLLGHGTTLSNAIDLAGDATIGFAPLEIDVLLVGGGGGGGGSPHGGGGGAGGLIYQSGLLVWDAGAVSVGAGGAGKQGALVSPWPSAGTNKGDTGENTVAFGLTALGGGGGGGYSGGSTSDTAGQAGGSGGGGGRDSNSGTALQPTSASGGFGNDGGPLGSTGGITAGGGGAGQAGQEGFGGDGLDFSTQFGTTFGESGWFAGGGGGSYYAATRPASTGGQGGGGDAGLNNSTGRPGNGLANTGGGGGGAERDGTGKGGDGGSGVVLVRYATSQVATGGSISNFTDAQGTSYTIHAFTDPNAAYTFQPDLAASLTGVISGSGDVTFDTDLGTLTVSGANTFSGATTITGGTVKVTDSGALGSQAAVRIDNTAGATLTLDGTDLSIGSLAGGGSAGGTLNLGNNTLTVGGNNSDSGFAGVISDAGTGTRGSVVKTGTGTLTLSGNSTYGGTTRVEGGLISVSTLGDSVGAIGASQLVFDGGGLRYTGATGSINRAISIEGGKEGRIDVFNPNSTLTLTGAITASDVAGTKLVKQGGGTLILDADNSATLAADTNVAAGTLTLRASAGLGTGALSLAGSSSLLLGHGVDIANNITLNGDATIGLTIQPIDVEYLIVGGGGGGGSSAGVGASGGGGGAGGFVLGQTTISSIDANIITVGAGGGGGSAGGDNPGTSGLSSSAFGITAYGGGGGGGRTYNSATVGVGKNGASGGGSGSQGQTPGDAVHGDQGNTGGSTNNSDGNSTYDNASGGGGGAGGVGGDGVDDSAGGAGGVGKYVAWADAADLGESGWFAGGGGGGISDGRGTRTAAAGGQGGGGDGGVGTDANNNTAVATAGTSATGGGGGGAGGTGHAGGAGGSGIVVIRYRGETFATGGSISTITENNETYTIHAFTSVGSNNSFALDYSNLAAKISGNITGAGKLTTAAGDGTLTLAGDNSYGSTAIAGGTLKITGGSSANPLGSGAISNQGQLVIDRSDNLTIGAAISGSGTLVQAGSGTTTLTATNTYSGQTRIDDGVLQVGAGGTSGSLGSGRLVNNATLAVNRSDDLTFAQVLDGTGNLLKQGAGTLTLTGNNVYSGTTQVAQGVLQLGNGGASGTAGSGAIILDSDVNTANSGGGSLVVNRSGSITLSQVISGEGSLTKQGSGTLSLVANNTYSGGTTVQAGTLALSSDGTNTTPVGAGDLTLEDGSSLLLSSGTSIGNAITLNGLATIAMGIQVDYLVVGGGGGGGAWVGGGGGGGGVLTGTQVIAGGSYGVVVGNKGFGANNYNKMNAATIRATSGGSSSIFGITALGGGHGGSWTAQRAATGASGGGQGYSYAAIPGTEGQGFAGGTGRGNRSNGYPTGGGGGAGGPGGNWSSSKAGDGGVGLYVDWAGAAGLGDDGYFGGGGGGGVHGYGSSPNAAAGSGGKGGGATGAVATTSRPTAAQANTGGGGGGSGNAGGSDSRGGDGATGIVVVRYAGATPAASGGTTVRTVNIGGIDYTFHEFKTTGSASFSVDAMSAALTGTISGSGSLDINAAGGELTLGNSANTYTGSTRVSAGTLSVSNLADGGANSSIGASSNAAANLQLAGGALKYTGTSASSDRNITIAGSGATTIDVVNQGTTLSLSGTSSAGSGGIRKAGAGTLTLSGNHGYSGSTLVAGGTLNVEGTIDGTDLVNVYGNSTLNIATGGSLTTGSGGTFAIGSGKGSHGTVNVSGDLNIGGGKGAVYIGGKLHNTGTAGTGTLNINDGGVVSISGGGQSSISGAQAWRAWLNPWGKGGASGDPGATINVNSGGTLETARVLSEGYNGLAEINFDGGTLKALRSGTLIHQDNDANLSVNIKDTTNGGGLIVDTNGFNVLIAKPMDGSGGLTLDGTGGGTLRLNKANTYTGGTTVDNGTLLLQYASGGTGTIRGDLTVNADGVVDYSTHHTFGWRPNSTGGTIESVTSLTINGGRVGGNNFANHFWGKTTADGTPSGFQLTMDGGELILGGTYNEFYNPTFNLSGNAVIRRATGNTSANLHLRDGGDLTINAADGTNALISAPIRQRNGTADFSFNGPGTVTLSGVNNWTGTSTIDGGRVIVTNDEALGSQYSAKTVNIFGGGVLEAAFTGRPNDHMRIVNLNLGKDGELGGTLAGTGTGHPNYGEFYLHGNVTVAGTSASEISADLRIGGGATRTFTVADVTGDSADDLIISGKLGHYNGISWGYLTKAGAGTLAITGANQIGGATVNEGMLRLIGADANNAFWSRGIRLNKDAGLELNLSSGSTTGSYRITGAGSGGVTKTGAGRIILTNNHAYTGATTISQGTLQLGNGGSRGALGNTTVTIDNGATLAYFRNNGMTLANTVSSSGTGTGPAGGTIEFLGTGNQNQSDYRIGGNSTGFTGNVIIRSGARLGIDSTDAIGQGTVTVDAGGGVFVRIGETGGVANTISNDFIIAGDGWLQSAGRLGALRLISGNITGGVTLAGDARITAWTGQGGIITGIISDGGNGYGLEKTGSGGITLNGLNTYSGATKLSGGTLYVGTLADGGVASSIGQSSNDAANLVFAGGTLAYSGGSVTTDRNFQFANGSNNTIAVTNAATTLTLSGTSPSSTGSLIKRGAGTLELTGAHNYTGLTNVAQGTLLLSGNSTLTSTPTSGVYDGRILIGTGATLKLNTSTNQTFAGVISGGGQLIKDGTSELTLNATNTYTGGTTVDGGTLWLGKGGSSGTIRGSVTVNSGATLDYRDANTFGWVRGASVNKLTINGGTVGGADFGNHFWNNFQLTMNGGELKLGGTVNEFYYPTINVSDDALISQVSSAAMFGLRDGSRITTDVAAGKTLTIDAPLTQRYGSSSLRVRGAGTTELTNTNNKFDGITQIWDTSTLLLSGTGRLAGTTSNIYRGRIHIASGGKLDVDSTATQQWDGVITGTGALNIKAGIVDLGGKSTYSGQTTISDGARLQIARGGSNAEIRGNIQIDSGGTLRYFRGDTNAAIKLHNTISGSGTLQFAGQPTRNSSSYLAYKASAFSGNTEVLSGARLWLSHHEGVGTNGIIKVMDGATLSIAVGDGNNVVNDVEVQGTGWLENVGRIGALRMASGDLTGTITMTGDTRFGAWRGERGVINSVIDDGGNGYDFQKWGNGRLTLTGANTYSGDTIVSGGQLMLANPNGPALYNDPTNTDPANLGRMANPGRVIIRHDEGAGWRYPDVAANLEFGADNQLGPQVDIVFDAVKPYSYMSLRDTTQEVGNLSTGRNPGWAVLQNYEDSSQDTNPGTGQGHLIINQDQNLTFSGYLRNSWTRGTNNSDPLKITKKGTGTLIIARGTKNTGGIDVQEGVLQIGDGNFNGSLLNSNAVTIGADGTLKYYRTDRQNVEGVVRIGHDISGDGTLIFASNNWNSSDVGEKGAGDYRYTGTNTLSSNATFIIDNARLVVFDQADLGANLPTVKVINDGQLYLGKGGTYSNPLEIEGQGWSQPEGTRWGALFAYTYTGGGNATYDGDILLTDNARISALNFGNLTLEGVVSSGNNTYGLNFTGNREITLAGENTYLGNTHVREQLVTLASTGSLYRDAALYNALDAADRGRIILGGSGGQRGNARLRLNADNQIGEFGANGVLNPIDVEFQSGSNRWNFLELRSTDQEIGNIIAGSGHARTVIQSWDGGYDANQSNGLSKTSAATLTINQTVDAGYAGQVRNAWRGQGLLAITKQGDAALTLSGPTNYSGDTTVKGGTLIFTGATRSGNYQIDSGAVLDFNVARGTRDMPVDMTFTGGGTLRKSGDGLLVWGRKAATFDLDAGGWINIAGGTLVAGSWGNENWDSNLASLNIASGATFRSVEAEIRIDALTGGGTWAGGWRSSNFRSTPIIGVADGVGAANAVFSGRIVDYNRAAGDKIQNLIKVGTGTQIFTGTNTYSGITQVQGGTLQIGDGGSTGSLGGHTVIVTGGTFAINRSDTVAFNQKITSAGASDATDITGALDPLPSYDLASLSGSVVQRGSGQTYFTNSANDYTVQTVAEQGTLTLSTTTTNTKGIDVWAGATVELPAKLDGFTNPGGITYTGAGTIVRSAPRGSGVYRTLVGNAGGTIDLSAGGRLVIAGGETRLVNSAKTDWTSNEGSLTVSNSAVLNLWDSGIAPTAGQANTNLYIDALDGDGRIWRTLLDNNAASPASTLIMGVANTNGRFTGTISDSSNASIGNISVEKVGIGTQILANNNGYYGTTLITDGTLQIGAGGLAGRPGFGDITNNANLVFNLANTAPELTLAQNISGTGDLTIVRSGGIRFANDPGKTFSQANVTIQDSGNNRTVQFTGNTTISNGLIVQAGSADYNVSFLGATNSIGGTVTTFANRGTLTLGNEATDSITFAGSLIATAPSRRTISGTVAVQNAGAIDFGSTGATAVNHNATLGGSGTGAIRIGTALLAPNVAFTIGTGNASSISAGFLSGSLADSSSLTLNSAGDISVGGGAVADAITISGGDQVTFANQVVANTLSIGGISTGITFEGRTQVLADGTATNTGLTVNSGAYDIAFLASGNVIRGQSVTFNNTGSLSFGDEITDSTTFFNAVDASSVSAVNLFGTLTVREGRTNQVFTPVNGRQRLQSYDLTSRGGLNLGSAALNITGDAYLYAGAEATGITPGTTGLTDNGSFSAGDVTIADGAFLRLTYASDASAGGSPSLTLGNVSGTADGDASRLLVSAAGPVSLGAVGTDISTLAIGTAGTDGDITFTGALGSSSDRISSIQLSSVNGLVDVQGDLYAGSLQINGNSNVNLYGAVSDVSGASSFATTGTLNLGNASTDQLRFTGGITHVAGSTSLSADLTTNGAVNFAGLGVLNNATIDSGAAATSTVRIGQINLAADTSLSIGTANTTAAISLGGVSAAAPSSAINSDLTLTTSGTVAVTNALSGNLDAVTINRAGDISIGGDLVANTITIADFAGDSLSFGGNVRGNTGVNGGIAALSLGATSNAYDLSFSGATNEFGGANGGDLSFTNTGALALGNASGATFNFGGALTATSASSLSLGGTLTAAGAVSLANASTPIALLGTTTIDTWGANGAITLANGVDLAPGASGSFTLHSGSGAISVQGAIGQASSLSAVAINDQAGNTGLATIGTDSTAGSIRAGSITLGATDLAGSATLQADTISLLGALGSTASGRSDSLTLLSRTANAARSLGSAAGATDLSQIQGEFSRVVIGSANPNERGTLTIDASSGEATSANNLELYGAAITINNGTLASSNAAGSGAILLDATGSISSAGSGGSAVSAAGDLTLRFRGGNGTVLDFTRAFEGDNVRLEQRNAADFTIGTATGSETTLTGTSLANLSVTGASGTLSIGGPGTYAATPGASPALTLNAAANTSSNLALDFNRIVLGADLSLASGKTLSLSSAAGGNIEQTGGVITAANLVLAGAGDVDLATAGSLNAIGSLSSSARGAISLSNAAQSLTINGVSNAASFSATGATAYTVAGVLSAAGDVLLDTSASTITIGASGRVVSLAGDVTLDAGMSGTFINERGADAVSAGGRWTIWSKGWENGTTLNQFGPGSDVNAVLASGNGAVWGASWSGTDASRSTALTGNGYEYGNRYVFASALPAPQSGLLTIRTADATKTYGTALSATDLLGEQYVRLTASLGNLTLADVRGSNNMVGSAFTDEAPNTSGITLSQAFGSAAVTSTGSAGNANVGSYALNLSLGGSLTIDAGVVKSGAVDYTINNAGTDYTFKVVDGGQLRVTPKLLDVAVAGTTREYDGTTNLGGTLSVSTGVGSETLTVTSSSSGFAGADAGQQAWSVSGLSLANGTGTASNYVLRSTELSGIGTIEQRAISASVSGSKVYDGTPSLDTPAITLSNRVAGDDLNLSLTAAFASANAGSGIALNFSNKALSGAAAMNYTLTGATLSGSGTIEQRAIRIGNATTASKVYDGSRDLTISDLAFNLTGVVGSDDVSVTSADLAASLASANAGATSFAGTGSFSLSGNDAGNYSLSNGGSSLTLSGDATVSQRSIDLVVGGTRSYDGTDELASELTSLTVSNAVSGDDLAVRFNTAVGANADAPVASFSSANAGSRDLTVNVAELQLSGAAAGNYALSNNATYTTAGGGTISAAELTLTGVAVADKTYDAGLTTTSFTNSGSLSGLIGTETLSLNATGATATFADKNVGIAKAVTLSGWTLGDGSNGGLASNYTLVLPTDITATVTQADLTVTGLSVADRDYDGTTTASFSGGAITALGNDSVTLDLSGASASFDSRNVGSRTVSFDGALISGTDARNYNLVLPSNLTGEITAKQLQVLGITADGKEYDGTTDVTIDAAGAVFSGVVGGDDVSLDANATISASFASANAGEGVAVTISGYALDSSGNDVGNYSLAQPSDVTADIDRRLITVSGLTADDRTYDGTVDATFDTTSASFGRPTELGGTAVIAADSANLSIATATGEFADKNAGTNKPVTLTEVTLDGSAAANYEVVITSVDGNGNVVPLSDSATITPAAITISAADVTKVYDGTLTVSDGEAVAINGTELFADDQFSGGSFAFTDKNVSRDANDAVLSDKRVTVSGVGIDDGNGGANYTISFADNTTSTITPAPITITGIAGVDRTYDGTDTVDVTDSGVTIAGEVSGETGTLSLDLSGASGTMDDRHANELKPITVSGIELDGTGAGNYDIESVFGAAEGELPTVTITPAPLTVTIEDFTKTYDATTAVDGAVAIVDPNSNTQLFATDKLGEVFASFDNKNAGSGKTITLTGVVVGEDYATTDEDGNAITALAPIGGNYTITLVANTNSTIEKADLVLQGLSAQDKPYDASTSATLEGSAFVSALASDVVRLDGSGSGAFANANVELDATTGNPGLKQVSISGYTISGADSGNYNLLMPSDVLATITPVSLTLSGISVDDKTYDASTIGSYTLSSTTLSTGIGSETLTIRESGFDITGEAINARAVFSGKDVAFDANGNVTTVAASVEGFSLGNGTNGGLAVNYVLELPDDLTATINQAALTVSGAVVANKVYDTTTEALLQDAGSVSALGRDQVNVDSSEAIATFDNKNAGTGKSVTLSGYKLSGADAANYTIGQPTGLTADITKADLVLSGISIDDKTYDGSTTATANIDADAGITITALPGDTVTLSGTASAAFTSANAGTDVGVTVSGLSLGGTDAGNYQIVTDDLTATIFQRAVTISGATAASRTYDGTLTTTISGGSLAAITGEANSGVISADSSAVSLDGSNATGTFADKNVAWTISYAADGITETGRTAAAKDVSVSGFSLTGGAAGNYRLEQPEGLSATINPAALTISGITAATREYDGSTDATLDFSGLSLSGLVSGDQILVDGTGVFADANAGSGKTVNLTTTVSGIDVENYTVTKQATATGTINPKLLTLSGITAEDKEYDGGTTATVDFSAVDLVAAGLIVGSDGTADDVSISSVSGVFTDANAGGNKTVNLTITGGGTDLANYNFGGQTITTATINPKLLTISGTVVDDKTYDGSTNATFTTIGSLSGLVSGQSLTVDAAGSFASKDVVLAPTFNADGTAGADAPAEQAVTVSYTLADGTGLASNYRLADEQLAAVISPAALTITANDVKKVITELDPTLTVRAAGFVAGETTADLSSFSVSRVAGETAGTYAITVSADSTNYDLTLTDGTFKILGAGELLVTLGDVTAEYGTGAANGTTNARYYSALSQAIVTLSDISGDANNGFTIRENGADVFTYGVTTVEAAGDRSTGNALKVGSYQIQGSNATLTAPHLTGAEFSDGWLTVTPQAINALSITSGGTRQYDGTTAMAALTLEAANQVSGDALTISGRGTYASANAGDNLGYTLSGLALSGADAANYFLSANSFTVAPGATGVSITPKQLTVTGSSAADKTYDANRTAVVSAGSLSGFVGTETVSISSVSGQFASADVARDGSNNVVDQDVTATYTLADGSGGGLASNYTVLDQTLQAAINPKTLTLTGVTVSSRAYDGTTTVDASQISSGGVGLSGVINSDAVSVNTGTITGTYNSEDVATATTASLSGFSLTGDKAGNYSLGGSSVDVAAAITAKALTISGTTVADKAYDGNTAATVTANSLNLSGLVGSETLGVSATGTFASQNVAYSGATVANQDVTVSYALADGSGQNAGLASNYSLSGEVLSNAAKITPKALTITGSTAADKVYDGDTSAVVTAGSLSGFIGSETVTIATATGQFASADVARNGSGDVVDQNVTATYTLANGSGGGLAGNYSLADTTGIQAAITPKALTITGASVTTRDYDGSTAATIDTTGASLGGLVNGQTLDVSGSGTFDSKNVGLRTATVTYSLADDTGLASNYSLDGSFSLNGYIDPKAITITAPTVSKTYDGSTAFDLDGADVLALNTTLQTDGTLESGDSLTAASVRFTDKDADGSAGVVLTGVTINDGNFGDNYNVSFAQGTGSIGEQDYVVWIGGTSGDWFDPNNWAVGEVVDSGSISAPGLNLGTGKGLARGRAGAVPDKENVRTVVIPVGVDITFNDSAAGRRGAAKAGEVVLQNLLFDGYGSGSAGELQLTTGTLKAITVKAGGLDLSTGSTLDVSGSIDIELPNGRTSIAAGTIKGAAPLVVKGAGVLRLSGSNTFVGNATIDDGAVLEISSDDALGDAANDITIQGGGVLRAAGTTTIGADRAISLGTGGGSLEAASGKTLTLSSAVSGSGSGNNLVLGGSGTIDLGHGVSLSSGAGISGGSGSYNLKLGGSVSVAGATALNTTGTIELTSGNTYNFTGGFNAASGSTTKLAGSIDTSNSTISLGNVVLTGNTTLDTVNSPGDDVTISGDVSGDYDLTITAGDGTVTFADRIAVKSLDVSADAISFDAAYVVDANDNTTITSHSITTTGTQLFQGGGGAGTDAAITLGANTSLQGSSITLMGAINSATSTSNNLVIAGDAVFGGAAGSTVGSTTALGSLSVSGSTTLDADTSLSSANLNLADVALSNGANNYALTLKPGTAGTVSGVISGGGSLAMGGNGTLSLNGANTYSGGSSVTAGTLVAGDNAAFGAGSVSVSSGAALDLAGFSVANDLNLAGTGVSDSGALFNSASTAATASGAISLSGNTSIVTAGDLTLSGGISDGSGGNNAELIFSNITGETGTVLLGADVTTGGLQRYLANVEATSAVTVTASSLELGANLSSSGVDLTVDAPITLLDDALNSGSGTPQTRTISTGSGAGNLQLAAITGANNSLSLISGSGTTTVSGAVSGVNALSLQAAGASGAVSFHGNLSATSLTTAAAAYNLSLLGSTTTFTDAVSFANTGTLTLGDGDSDSLTFTAGLTAAAPSLVNLRGNLIATGSGAINLGDADTAVAISGVTRIGGPSDATSSGAITLSDVTLADGASLTLGDAAATASADLGSNAITLTSVAAASGSSTAPNLTINSSGAFQSGAIGASSGTELGTISLSRVGGATFTGAVNAASLEFADGVAGSSDTIAVQGDLTLTSGFTVGTGAYAISLTGSSNSIAGSTAFANGGTVTLGDASGDGFNFVGGLSFSGNAPISLAAAVESSTGSLHLGSGTLTLAANSELAAATNLTVGGSLSGSSRTLTIAAGSANTASFLGTVTLADLITSAGSYGVSLTGASNTFTSAIDFANTGAVTLGDATTDLFSFGDGLAISGNGSVNLGATINSSADQLNFGDGSLTLTANSVVDATNNAEVASAAGNTIRFGGSIGDGANAYNLTVNAGSAGDISFIGAIGTNNDDIGAISITVADQVTFDGTVNAASFTQLDAPNTGLTTFTDNFALIGNFDFTGQELKLQGAASTAGGSIEITNAGTYTLDSGASIAADSGITVNGAGGVSLAGDIDSDGSALEFSGPVIVAADITISTGTGAGTISFDKAVSGSGVLTLAAGTGDVIFAAGADVGTSAAKAGGLEISGKNITLRNVYTTGQQDYSATGTITTNSSYVTDGASVRFDGPTVFNDATVVDTTDGGNTTTGADVTFTATVDGDGVGDPSTLTISAGTAGDVTFTGLVGDSTPLGAVTINNAKDVSVNGLIADGVDIAANSITLAGDVDTAGADARFRNAVTLSSAVAVNSANGAITFDSTINGNSALNLTAGTGTVTLTGIAGTSNGSSGELASLTINSASAASLNNIFTTGAQTITADAITLTGNDYASDSTVTYTAPVTLSGRTYIVGTTVTFNDTVDSSQTGSTTDNDSLYVVGNAVLNDVVGETTILGALDVSGTTALNGDGSNPMVVSTTSSQTYANTVTLGADTTLNAKGMDAQAIGMGSNNLTVNETGTAANTNAGNIAGVISGSGTFTKTGAGELTLAGANSFTGDTSITTGRLIVSGTLANVNVIVNSGTTYEVGATDTIGSIAGAGDIEMASGVTLTVGANNSTADFSGVLSGDANFAKLGTGTQTLSGANTYTGTTSIQAGTLVAKNATALGDRSAVSLSNVSGAELVITNPVASPSTDMALTVGSLAGGGTTGGNIELGADTLLNVGDATSDTSFGGEISGDGALQKVNTSELTLTNMNSFAGGTTVDGGTLWLANASSTNAGTVGGVLTINTGATVDFKAHNATGTRDVTNKAQLTEVNINGGTFGGSDYSNYYYFTVNMNDGTWILGGDAAGSNGNDVFDGDINVTGSTSSVIRSIASDLTPGSLRMRNAMSIDVATGATLDVQAAIGSAAEAGSTSLAGTAGITKTGSGTLLLSGANQYQGDTDIDGGTLTVTGSLSDQTAVDLANGTTYNVDSTDTIGSLNGAGNVVFASGMTLTTGGNNDTTTLSGAISGDGNLTKAGNGTLTLAGANTYTGTTTISGGGLTVTGTLGDDGAGTGSYAGTISNSGTLTINTTANQLLSGDISGSGSFAQTGAGTTTLTGDNSYTGATTISAGDLIIENDAPSLSSSSYSGAGDLVIRSAADSFDSALTLPLSKFATTLGSLTVGKASNQTEIVINANVTTDGLQSFYGPVTVNNNVTLESTNGNVAISGAITPDTDGTRSLTIQALNGDISIGGDIGTSAKPFFDLELYAQGMKVNRDTEFHTDNDVVMDFAVTHDVATADTLTVKAGRHITLGTNSSINATDGSLSVLLHADTGNTGNGIIQFFGSSITTGGGSFQTGTGSTHATGGYLTGGDIYFARSGAQSINTGGGDFTIHGETLVATPAGLTIDTGAGNVDFKGVVNSANQYEFVSGTQTWSDARTAAKGSTTGGSTVGDSYLVTITSRLENSIAGLAANYAASWHGAYRPDDKSANWTWSDGPEAVSVFYIQGSPSTGTVQANGKTQPGWYSNFGSGEPNGSLSGGGETRGQFIGTAGFWNDLGSSSTTSGYVKETNLAASELTITSTGNVNFEKAVGFGKTLANLSVTGDEVTFKDTLALDSTGGTITNTGVSSVAGAVTGSGALTKDGAGVLTLQATNTYSGDTTITAGTLEVTGTLGAGNYAGNIANTGTLVINTTADQTLSGDITGTGGVLTKQNTGKLTLTGTNTYTGGTNLTAGILNLGSAAAIGNTGTIDLGGGTLQYSANNNTDYSGRFATTDQTYNIDTNGRDVTFATALTSTTAALNKLGTGTLTLAGANTFEGDITISAGGLTVTGTLDNVDATTGSYAGAISNSGALTIDSAASQTLAGAITGTGSLTQAGAGETILTSTSNSYTGATTISAGTLRVGNGGANGSLGGAGTIANDGAVIFDTSNDITVSKSISGSGTLEQAGSGETTLTGNNTYSGTTSISQGTLQIGSGGTTGTIGTGNITIDTGATLATNRSNGFSITADIDGHGQLIKYAAGLLNLTGTNSFGGGVDVKDGTLALSTTGSSGFGGTLTMGADGNASTTLVLGPSVEVSNAITLNGAVEVMLGLPVDYLVVGGGGGGGGRDIAGGGGGGEVQTGSMILTGSSASVTVGDGGSGGYDVNDSADQNRHGLRGNSSSFFTITSAGGGGGYGWNSASLDSQRSGGTASDGGEIKSGGDGAGTSGQGPNDANPGYGGNGLYVAWADAIGLGDSGYFGAGGGGSSHRSNDDPLFLGVGGLGGGGDALIAGGQAGANNTGGGGGASRDLRKSGGKGGSGIVVVRYLSDTDRAQGGEESSSDGYRVHTFKTVGSSSFSLDVQDFTASLTGSISGSGSLTADASAGELTISGANTYTGATDITGGTVTVTNATGLGNRSAVSLSNVADTKLVVTNPAASPASDMALTIGSLAGGGTTGGNVQLGADTVLNIGDTSSDTSFGGVISGDGALHKVNTSQLTLSNMNTFSGGTTVDGGTLWLANASGTDPGTVGGVLTINTGATVDFKAHNTTGTTNASNTAQLTEVNINGGTFGGSDYSNYYYFDVNMNGGTWILGGTEADGDGNDVSGDIIVTGSSTSVIRSITGDTDPGSLRMRSAITIDVDTDATLDVQAVIGSATGASDTSLAGPAGITKTGAGTLLLSGASQYTGATDIDGGTLSVTGALSDLTAVDLASGTTYNVDATDTVGSIAGAGNIVLGSGFTLSAGANDGSTTFSGVLSGDGTFEKVGSGTLTLTGTNTYTGGTTVTDGVIEGDTAAIQGDITNNALTRFIIADGDSETYAGTMSGSGVLGKTGTGTLTLSTNNDHTGGVTINAGKLIVTADGALGDATSKTLASGTFVKSGATLELQGVNYTQGEPLTMQGGTLISVGSSTWTGLLALDANTSSTISLASATDPLTISGVVSGSGNFTKTGNGQLSLTNDNTHTGGVTVTGGELRLTGNNRTSSYQIDSGAVLNYEIATGTKQADTTTYTGTGTLRKSGAGELQWNTSASSVGTFSLSAGALMDVQAGAMTTGWGSNEVFTNNLADLNIASGATFRNVNSAARFNALTGSGTLESGWGSDVDNVFVGVNNATSTFAGTLADSGENGGKLTLIKEGTGTLTLTGTSTYAGDLYVHDGMVTVDSGGSVSGLRRLDVSGAAGTTLNVQGSVATADGSAFFTGINADGIVNVHGTLTIGDGSEVRIGGRYGDLTQNTRGEGALNVNSGGLVEVGASGGTTNTTNIEVVSNGNADTVGVININSSGVLLTKRSIAGTGSTTSKTTALNLDGGTLKAGADNLNLIVDRNTLVVSLLSGGGTIDTQSYNATITETIEGAGELTKIGSGRLTIEGFHPWTGDTIINAGTLELKSTGDSTTVNSVGEHGTSTVAGAGNQYEINNGSTLLISGSRIDFNGATFRFDSAGGGTINSTSSNFVNRNTTYVTTGGAQNQILSPTTSGGSQLYYNLDTGTVTFDVPAGTNANSDLYIDGYLNNRGEVRKTGAGVMSFERDMRYSGGTTVDAGTLILNDVANNGQGVVKGALTVNSGATVQLTGNNSALGWTGDKVSTLNINGGLVEALTPSGTLNDNTDRMYIWDTAVNFSDGGELRVNGGTSNAAASRRWEISGVTFNVTNPTATASITGRVHFRDSATEFNVASDNADPELLVSAALTEDSANYGFSKSGAGTLKLTGANTYTGGTTISAGVLEVADIKDNAASNLGSGSGSTGFVELSGTGTLRYTGSGAQSTGRTLRIDDANTTATIDISHANGSLQFTSTGGTRDEAFTKAGAGSLRIDGAFSGAAAITTNAGELILTGANTNTGAWAVNNSSRLQIGVGSAAGTLGDGGTVTIANGAEMDVFRSDTALSINNPIDGSGTLRLRGTGNDGESSYTITSAGSFSGATVIDQARLIQEDPLSLGTSTITVQNNGTLQLNMGGASISNALTLNSLGWNLDGSTQLGALEFASTTADTYAGTITLEANSRIGASQNGTISAAIGESGGAFGFTQVGSGTLTLTGANTYTGKTAIDTGTLQLGAGGTTGSLASGSDADFINNGTLVINRSNAVTLFQNISGSGHLIQQGSGTTTLTGSNTHAGTTTINAGTLVAGSTGAITNARVVIADAAGATLQLIDHNATIDRLSGGGSTGGTVNLGGRVLSFGRDNTNSSFAGLISGSGALVKQGSGSYTLSGANTYSGGTTVEAGVLQAGDNAAFGTGRVSVASGAGLDLNGNTIANALTLAGTGFSNSGALFNSSASAATVNGAIALSANTTARNNGALVINGSINAANGASGSALTFANTGLLTLAGTVGGSAPIASLQIDAAAVLDADITTAGSQTYKGAITLGSGITLATTNAAVEFQAALDSAATEANALTINSGTGAVTFADAVGTATGGALGALVVNSGGQTWFQNAVTAASISTDSAGTLLVAGGPISASGVISFGEGMTLSADTRFIATNFSAAAINNAGHQLTIDERGSGQISGVISGNGAFIKEGSGTLALSGANTYSGTTSVDAGVLQLGVSSVVANSAISSSALGLGSTSVASGAALDLAGYSLANALTLSGSGISNSGALYNSSASSTASDVSGAISLAGNTLIQTDGALTISGSIDAATAGGASALTIGNSTGGSGVITLAGAIGSGNAITSLTVADDLNLAASVTSSGNQTFNDAVTLGADVTLTSATGNVQFDSTIDSDSTARALTINAQSTASGKGSVTFDGVVGGTKLAAVDITGHAVTINQAFSSSSTVEITNAGLLTVADDATITAAGGFTQDGAGSMSLGADISTTNNDLTIGSALTLLDDGTNPQTITLSTGSGGGALSLAAITGANNSLDLISGSGTTTVSGAVSGVNALSLQAANATGAVSFQDDLSATSLTTDAGGYNLSLLGTTTNFTDAVSFANTGGLTLGDGDSDRLVFSGGVTATAPSAVHLRGTLEATGTSTISLGDGDTAIAISGITRIGGPSDATSSGAITLSDVTLADDASLTLGDAAATSSANLGSNAITVDTLSGTTGSNASNLVVNSTGSLSAGTIGTDIGSLTLTRAGGATFSSSVDAANLILANAVAGSGQTIAVQGDLTLTSGFTVGTGAYAISITGANNTIAGNTTFTNSGTVTLGDAVGDAIAFTGGLTATAPAKLITAGTVGTSSAAINIGTLELAAATTINSVNSPGADITIASASGPEALTLTAGTGTLTLSGDVDVSSVDASADTININGSTDAVTTTGTQLYTGAVVLGSDTTLLAKDGSTLSSITFAGTLDSSNSGGATPASTFRTLGIIGDAVFDAAVGDTFALGGLTVSGTSALNGGSIKTSGLQTYTGAVTLAANTTLTSGGGAITFDSTLNSDANGNRTLDLTSNAGDITFSGIVGGAQNGTLGAVTINAANNVTLSSTFDAASFSQATAGGGTFQLDGNLTASTGAITINSNAVDLNADLTADGSGKAIAITGSTDLGGDLSSNAGAITLHSPVTLSGAARSISTGSNSAGDITFSGTLDGAQNLTLTAGSGDITFSNTVGGTTRIGALTIASATDVTVTDGKAFSAASIAQLAGSGTTTFGGTLNTNAQIGGSPANDNGIDLTGKAFTFKDTVTTIGSGAVAINNSGLLTINSGASFSLDGAFDQSGAGSISLGAGITTADANITFADAITLTQGVTLSTGTSGAGDISFSNVINSDGTARALTLTAGTGDVVFNTNATAGLTNALASLTITGDNITLRDVTTTGDQTYTASGVIDTNSTYTSSGGAITFDGDTVINSALTIDTTNGGSAANGGAVTFSGSLDSEATEANTLTLTAGTGNIDFDGAVGSATDGALGAVTIHSAGDLTADQSITAASFTQNAGTLTTFRGDITTSTASGLNLTATTIALDGLTIDASSGNGVVRFGGNTRLDDAVTISRGSGAVTFSGTLNSADAESNALTLNGAGGGSITFSGAVGTAGTNNAGRIGALTIDSATDVTVADDKAFYAASIQQLAGSGTTTFGGTVNTNGQIDPSGTTPNTNGIDLTGTNFTFKDTVTTTGSGAVAIVNSGLLTINSGAAFSLDGAFDQSGTGSIRLGAGITTADSAITFADAVTLTQGVSLSTGTSGAGDITFSSALDASTAGTETLTLTAGTGAITFSDVVGATRLGAVTINQAKGVTISQAFSAASFSQADGSNAGTGTFLLDGDLDTNTGAITISSDTVDLNADLTTSAGGTNGLVTINAGSGGLTLDGGTITTTASAAGAASGAIDINSDGNVALAGNLVATGVAGDSTTNAGATGGAVTIDTTGAATLSIANITTSGGDAANGSNGDGGAAGSITLTTAGTITLNSSTITAAGGAGANSGSQGAGADISFSNAVDLAGGDASISTGDTAGDITFDSSVDGNKDLTLTAGSGDIDFDGAVGGSTRIGALTINSANNVTVADTKAFSAASIQQLAGSGTTTFGGTVNTNAQIGGSPANANGIDLTGTNFSFKDTVTTTNGGAVAIDNSGTLTINSGAAFSLAGAFDQSGGGSISLGANITTADANITFADAITLTQSVTLTSSSTVAANPATTGGDITFSDVINSDSTARALTLTAGTGNVVFNTNATAGLTNALASLTISGDNITLRDVTTTDAQTYTATGVIDTNSTYTSSGGAITFAGNTVINSALVIDTTNGGGATGGAIAFNSSLDSKANEAHTLTLTAGTGDITFDGAVGSATDGALGAVTINSANNLTADNVFYAASLRQVAGSGTSTFSGALSTTAADGIELDGTNFDFNSTVSLTLGSLDLDADDTVRFNGLVTTSDTNAGQGLVTVSNGGALTLTATGDMNLAGAFLQDGAGSSSIAADITTTDDNITFQKAVTLTGNVLLDSGAGAGTIAFNSSLDSKATEANTLTLTAGSGNIDFDGTVGSATNGALGAVTINSANNLTADDVFNAASLSQLAGSGTTTFSGALSTTAADGIQLDGTNFDFNDTVTLSLGSLDLDADDTVRFNGLVTTSDTNAGQGLVTVSNAGLLTITSTGEMNLTGAFLQDGAGVVLTAGDITTTDDNITFQKAVTLTGNVLLDSGAGAGTIAFNSSLDSKANAANTLTLTAGTGNIDFDGAVGSATDGALGAVTINSANNLTADNVFYAASLRQVAGSGTSTFSGALSTTAADGIELDGTNFNFNDTVTLTLGNLDLDSTGTVRFNGLVTTSDANNGLVTITNGGALTLTATGDMNLAGAFLQDGAGSSSIAADITTTDDNITFQKAVTLTGNVLLDSGAGAGTIAFNSSLDSKANAANTLTLTAGSGNIDFDGTVGSATNGALGAVTINSANNLTADDVFNAASLRQVAGSGTSTFSGALSTTAADGIELDGTNFDFANTVSLTLGNLDLDADGTVRFNGLVTTSDANNGLVTITNGGTLTLTATGDMNLAGAFLQDGAGVVLTAGDITTTDDNITFQKAVTLTGNVLLDSGSGAGTIAFNSSLDSKANAANTLTLTAGTGNIDFDGAVGSATDGALGAVTINSANNLTADNVFYAASLRQVAGSGTSTFSGALSTTAADGIELDGTNFNFNDTVTLTLGNLDLDSTGTVRFNGLVTTSDENSGLVTITNGGTLTLTATGDMNLAGAFLQDGAGVVLTAGDITTTDDNITFQKAVTLTGPVALSTDSGAGDITFSDTLDATTAGSETLTLTAGTGDISFSDVVGAGARLGAITINQAADVTLSKAFSTASFSQASAAAGTGTFLLDGDLDTDAGAITISSDTVDLDASITTTTGGANGLVTINAGSGGLDLASNQSITTTAATAGDTSGAITINSDGNVALAGNLVATGVAGDSTTNAGATGGAVTIDTTGNSATLSLSDITTSGGDAATGSNGDGGAAGSITLTTTGTITLDNSTITAAGGAGANSGSQGAGADISFSNAVALTTGASSISTGATTGDITFLSTINGAQGLTLTAGTGSLTLTGIAGTDANSADRLASLSVTSAANAALNDVFSTGVQSITATDITLTGTTYNAGSSTITLTGAAVLNENTTIAAATTTFAGTLDSSNNSNTSNLRTLGITGNAVFDAAVGNAYALGGLTVSGTSAINGGSIATLSDSANNISGNQTYTGAVTLAANTTLTSGGGTIWFKDTLNSDANGNRTLDLTSNAGDITFTGITGGTNRLGGVTINQAHNVTLSQAFSAASFSQASGTAGTGTFKLDGDLDTNTGAITISSATVDLNADITADGSGKAITITGATDLGGDLTSNAGDITLHSPVTLSGAARTITTGSGAGDIWFKDTLDGAQNLTLTAGSGDITFSDTVGTTRIGALTINSATNVSVADGKAFSAASIQQQAGSGTTTFGGTLNTNGQIDPSGTPVNLNGIDLTGKAFTFKDTVTTTNGGAVAIDNPGTLTINSGASFSLDGAFDQSGGGSIRLGAGITTADANITFADAITLTQGVTLTSSSTVAANPATTGGDISFSDVINSDSTARALTLTAGTGDVVFNTNATAGLTNALASLTITGDNITLRDVTTSGTQTYTASGVIDTNSTYTSSGGAITFDGDTVINSALVIDTTNGGGATGGAIAFNSSLDSKANAANTLTLTAGSGNIDFDGTVGSATNGALGAVTINSANNLTADDVFKAASLSQLAGSGTTTFSGALSTTAADGIELDGTNFNFNDTVTLTLGNLDLDSTGTVRFNGLVTTSDESAGLVTITNGGALTLTATGDMNLAGAFLQDGAGSSSIAADITTTDDTITFQKAVTLTGNVLLDTGAGAGTIAFNSSLDSKANEAHTLTLTAGTGNIDFDGTVGSATNGALGSVTINSANNLTADAVFNAASLRQVAGSGTSTFSGALSTTAADGIELDGTNFDFASTVSLTLGSLDLDSTGTVRFNGLVTTSDESAGLVTITNGGALTLTATGDMNLTGAFLQDGAGSSSIAADITTTNDNVTFNAATTLTGPVALSTDSGAGDITFSDTLDATTAGSETLTLTAGSGDITFSGVVGGAQNGRLGDVTINQADDVTIAGGKTFSAASFSQASGTAGTGVFSLGGDLDTNTGAITISSATVDLNASITTTAGNDGSTDNGLVTINAGSGGLDLASGNSITTTAATAGTQSGAIDINSDGNVNLAGNLVATGVAGDSTTNAGATGGAVTITTTGTATLSIANITTSGGAADANNTAAGGDAGSITLTTAGTITLDNSTITAAGGAGANSGSQGAGADISFSNAVALTTGAATVDTGATGGDITFDSTINGAQGLTLTAGSGTLTLTGDVNVASIDASGATININGGTDAVTTTGTQTYTGAVVLGSDTTLTASNSGTLSSITFAGTLDSSNNSNTSNFRTLGITGNAVFDGAVGNSYALGGLSVSGTSALNGGSIATSTATGISGNQTYTGAVTLGADTTLTSGGGTIWFKDTLNSDANGNRTLDLTSNAGDITFSGIVGGAQNGTLGAVTINAANNVTLSQAFSAASFSQTTAGGGTFQLDGNLTASTGAITINSNAVDLNADITADGSGKAITITGATDLGGDLTSTGGAITLHSPVTLSGAARTITTGSGAGDIWFKDTLDASTAGAQDLTLTAGSGDITFSNTVGGTTRIGALTIASATDVTVTDGKAFSAASIEQRAGSGTTTFGGTLNTIAQIGGSNANGIDLTGSAFTFKDTVTTTNGGAVAINNSGLLTINSGASFSLDGAFDQSGAGSIRLGADITTTDDNITFQKAVTLTGNVLLDSGSGAGTIAFNSSLDSKANAANTLTLTAGTGNIDFDGAVGSATDGALGAVTINSANNLTADNVFYAASLRQVAGSGTSTFSGALSTTAADGIELDGTNFNFNDTVTLTLGNLDLDSTGTVRFNGLVTTSDANNGLVTITNGGALTLTATGDMNLAGAFLQDGAGSSSIAADITTTDDNITFQKAVTLTGNVLLDSGAGAGTIAFNSSLDSKANAANTLTLTAGSGNIDFDGTVGSATNGALGSVTINSANNLTADQSITAASFSQNAGTGTSSFDGALNLTGAFDFTGQALTLNAAGNTIGGAMTVANAGTFTTADTADLSITGAFQQTGNGSSSLGANLTATGGIAFAKAIALTGSDAVVLATGGASGQDITLGSSTSTGISGTGQALTLNAGSAGDITITGAIGANGSALGAITVSNGDQVAFQGAITAASYTQAAAASTGLTTFDGALNLSGAFDFTGQALTLNDSLNSGSSVEITNAGLLTTAAAADITATAGFTQNGAGSSSIAGNITTTDSNISFLRAVTLTGPVALSTDSGAGDITFSDTLDATSAGAQDLTLTAGSGDITFSGVVGGTTRLGGVTINQAADVNLSNAFSAASFSQASGTAGTGIFTLGGDLNTDTGAITIDSKEVALNANLTTTAGSTNGLVTINAGVGDANGLALTLASGNTITTTAATAGTQSGAITINSDGNVALAGNLITTGSAGAAGGNVTITTTGTTATLSLSDITTSGGAAASSSNGNGGAAGSISIGLTTTGTITLNNSSITAAGGLGDGTGSQGAGTAISFSNAVALTTGAATVDTGATGGDISFLSTINGAQNLTLTAGTGDITLSGAVGGDVNGRLGALTIASANDLSAAAITAASLTQQAGSGTATFSGAINTNTAAGISLTGTNLVLNGSLTTTTGGTLTIAQSGTASIAAAADINADGAVSLTANGGITTAADITTTGDNVTVASATTLSGPIAITTGGGNLIFSSTLDSDANGGRALTITAGSGDITFSGDVGTAGSNNAGRLGAITIASAGNLTATGALNAGSYTQTTGTGLSTFGGAIDLTGAFAFSGEALTLNAALNSGSTVTVTNAGTFSTAAAADITATSGFTQNGTGSSSIAGDITTDAAGISFSKAITLTGDLSLSTGSGTDAGDIAFSETINSDGTARALTLTAGAGDVVFQSGATVGTSSTAGSELASLTISGAALTLRDVTTSGDQTFTASGGINTNSTYTSSGGAISFTGDTVINDALTINTTAGGATGGNVAFSGTLDSKANAANNLSITAGSGNITFSGLVGDTTPLGAVTIASANDVTVNGLRALSLAQTTGTGTTALNGGTFSSGTDQALGTTGSAGVVINNAAISLADSIDTTSSGVVTLNATGGALTIAAAGDINADGTVSLTVTGGINTAGDITTTADNVSLNSPVTLTGDVAINTGAGGGNISFSDVINSDGTPRALTLTANSGNVTLAGIAGTSNSSTGRLASLTVASATNAALNNVFSTGAQSITATGISLTGTTYDAANSTITLNGAAVLEQNTAITAATTSFAGTLDSSNNGASPAVSDFRTLAVTGNAVFDGAVGNAYELGSLSVTGTSALNGGSIKTSGLQTYTGAVTLAANTTLTSGGGAITFDSTLNGGYTLAVNTTGTTTFSGAVGNSTALVSLSTDAGGSTAINGGSIATSGAAGMVFGDAVSLGAATTLTATNGAITFSDTLDSDATAARTLTLTAGSGDITFSEITGGTNRLGAATINQADDVTIAGGKAFSAASFSQASGTAGTGTFTLGGDLNTDTGAITISSATVDLNASITTTAGGANGLVTINAGSGGLDLASGKSITTTATTAGTQSGAIDINSDGNINLIGDLITTGSAGAAGGNVTIDTTGTTATLSISDITTSGGAAASSSNGNGGAAGSIGLTTTGTITLNNSSITAAGGLGNGTGSQGAGAAISFSNAVALTTGAATVDTGATGGDIAFSSTINGAQGLTLTAGTGTLTLSGDVNVASVDASAATINIDGGTDAVTTTTAQLYTGAVVLGSNTTLTADNSGTLSSITFDGSLDSSNDGAATPASNFRTLGITGNAVFDGAVGSSYALGGLTVSGTSALDGSSINTTGAQTYTAAVTLAANTTLTSGGGAISFGSTLNSDGTARDLTLTAGSGDIDFDGIIGGAQNGALGAVTINAANNVTLSNTFSAASFSQATAGGGTFQLGGNLTASTGAITINSNAVDLNADLTADGSGQAIAITGTTDLGGDLSANGGSITFNSPVSLTDAARSISTGSTGGDITFSGTLNGAQDLTLTAGSGDITFSDTVGGSTRLGALTINSATNVTVADTKAFSAASIKQQAGSGTTTFGGTLNTNAQIDPSGTPVNLNGIDLSGSAFTFKGGVTTTGGGAVAIDNSGLLTIGNSAAFSLDGAFAQSGGGSINLGAGITTTDDDIAFSDAITLTNGVSLSTGSGTGTISFSGDINSDSTARALTLTAGTGDVVFQSAADVGTAAAGSELASLSISGNNLTLRNVTTTGAQTFTATTGINTNSTYTSSGGAITFAGDTVINDALVINTTAGGATGGAVTFSGTLDSESTEANTLAITAGNAAIDFDGAVGSALNGALGAVTIHSAGNLTADVAFKAASYTQSAAAAGSLSRFDGALTLSGAFDFIGQALTINGAGNTIGGAMTVANAGTFTTTDNADLSITAAFQQTGNGTSSLGANLTATGGISFAKAIALTGTDAVVLATGGAAGQDITIGTSTIPAGITGSGQDLTLNAGSDGDISVTAAIGASGSTLGAITITGADQASFSGAIDAASFTQSAAAGLTTFDGALNLSGAFDFTGQALTLNDSLNSGSTVEITNAGLLTTATAADITATGAFTQNGAGSSSIAGDISTTDSNISFLRAVTLTGPVALSTGSGAGTITFSSILDATTAGSETLALTAGSGDINFSDVVGGTNRLGAVTINQAADVTLSKAFSAASFSQASGTAGTGIFTLGGDLNTDTGAITISSATVDLNASITTTAGGANGLVTINAGSGGLDLASGKSITTTATTAGTQSGAIDINSDGNINLIGDLITTGSAGAAGGNVTIDTTGTTATLSISDITTSGGAAASSSNGNGGAAGSIGLTTAGTITLDNSTITAAGGLGDGTGSQGAGATISFSNAVALTTGAATVDTGATTGDIAFSSTINGAQGLTLTAGTGDVTLSGITGTAAGDANALASLTVTSANNAALNNVFATGAQSITATNITLTGTTYDADSSTITLTGDTGLDQNTAISAATTSFNGTLDSSNTGGATPASTFRTLGITGNAVFGGAVGNTFALGGLTVSRTSNLNGGSINTTGAQTYTAAVTLAANTTLTSGGGAITFGSTLNSDGTARDLTLTAGSGDIDFDGIVGGATGGTLGAVTMNAANNVTLGDTFSAASFSQATAGTGVFQLDGNLTASTGAITINSKVVDLNASIATTGGNDGSTDNGLVTINAGIGDSNGLALSLVSGETISTTAASDGTQSGAININSVGNVDLAGNLITTGSAAAAGGAITITTSGSGTSISLASLNTSGGAAGNGTGSAGGDAGTIALETPNGQGIVLNNSVIRSAGGLGDGAGAQGAGADISFKNVLSLNGGSITIDTGATGGDLELLGALDGGLAVTLTAGTGDLNIGLNGAIGAITPLASLNISAANLYLFDVTTTGDQTYTSAGTITTNSTYRSAGGAITFAGAVVTNGELVVDTTNNGAVTAGGAVSFQGTVNSAQGLANNLTVDAGNGSVAFDAAIGSTTTLGAITLNTAGLTDIQSTVNAVSISTDAPGTVQLGGNITATGAAGVVFNENASLANTLTITASDANGAVTFGSSLDSAASLASSLTITAGGPVSFVGAVGAASNGELGALTVNTGALTDFQSTLQVASVLTDAPGTVQLGGNITATGSAGAVFNENATLTADVTINTSAGNGPITFGGAITNTDGESLVFDSGNDGDITVTGDIGDLGTGVVTITDANDATFFGSVTAASFTQIDGSGTTTFSDAISLSGDLDFNGTNLTLSGSGNVIGGAMTVTNTGVFTTGNGADLSAGSFAQSGGGTNVIGEDISTTTGALSFTGDLKLTGDQNEAITFSTNGAAGSDITIGGDITNTAGESLVFDSGNDGDITVSGDIGDLGTGAVTITDANDATFNGTLTAASFTQIDGTGTTTFGGKLDLDSSFAFSGNNLTLTGSGNTIGAAMTVANSGVFTTGNGADLSAGSFAQSGGGTNVIGEDISTTTGALSFTGDLKLTGDQNEAITFSTNGAAGSDITIGGAITNTDGESLVFDSGNDGDITVTGDIGDLGTGVVTITDANDATFNGSVTAASFTQIDGSGTTTFSDAISLSGDLDFNGTNLTLSGSGNVIGGAMTVTNTGVFTTGNAADLTAGSFAQSGGGTSVIGEDITTTTGALSFTGDLKLTGDQNEAITFSTNGAAGSDITIGGDITNTAGESLVFDSGNDGDITVTGDIGDLGTGVVTITDANDATFSGSVTAASFTQIDGSGTTTFSDAISLSGDLDFNGTNLTLSGSGNVIGGAMTVTNTGVFTTGNAADLTAGSFAQSGGGTNVIGEDITTTTGALSFTGDLKLTGDQNEAITFSTNGAAGSDITIGGAITNTNAESLVFDSGNTGNIAVTGDIGDLGTGAVTITDANDATFNGTLTAASFTQIDGTGTTTFSDAISLSGDLDFNGTNLVINGVPNTIGADLLVTNSGVFSTGNNAVLAISGALIQDGTGSNTIGADITADQGITIATDITLDGDQDEVITFSTDGNPDSDITIGGAISNTDGESLVFDSGNTGNIAVSGDIGDLGTGSISITNANDATFTGSVTAASFSQSAGTGTTTFSDAITLTGDLDFNGTNLVINGQPNSIGADLLVTNTGTFTTGDNAVLSIAGELIQDGTGTSTIGADITADQGISIATDITLDGSANEVITFSTDGTAGSDITIGGAITNTNAESLVFDSGAAGNIAVSGDITLTDGPSTPSVGGDLTINTANDVLISGILDLTGDLEAITLGQVSLGITSIQGNASITSSNGPILQTGHITVDGDTDLNAGLGDINLPGPGNDFSGSLSAQGRVVRVLAVGLQIPAPPSSGGGGSGGSQAPTAPEQTTVPPTTTSEPRPEPSAPTPPAPPVPPSTTSEPRPEPPVLPGVVPTTTQPTPQAPSVREVIASSTSTALPSLLTNTDPSVVRVQTSTTTTTVLNPISSLTNSQPLAAATTGAATPYPLSMSNPSPSIATAPQTITTTSGSERTSATGNPSLDRQDSSSETTGEATAARGTGSVVQEGPLKPNFRVENQQPERYNMGTASFEIQPGNEVCVSGSGCGSSVTTNTSQEQISPTGTISSPTDDDALSRSNGDDTKPKSQLLSRISRWLMRSL

SEQ ID NO: 2748 - protein, 144 aa, Glycine max
  misc_feature (32)..(32): Xaa can be any naturally occurring amino acid
  misc_feature (49)..(49): Xaa can be any naturally occurring amino acid
  misc_feature (119)..(119): Xaa can be any naturally occurring amino acid
KSKLPLVGNTAPDFEAEAVFDLEFIKFSHLAXVQTDRKSGGLGHLKYPXVSDITKSTSKSYGVLIPDQGIALRGLFIIDKEGVIQHSTINNLAIGRSVDETKITLQALQYVQENPDEVXPAGWKPGEKSMKPDPKLSKDYFAAV

SEQ ID NO: 2749 - protein, 491 aa, Listeria monocytogenes EGD-e
MTDELEQKALITIFGGTGDLANRKLYPSLYHLYSKGSLGDNFAVIGTARREWSNDFFRDKVKESIKDIDGSEKDADAFASHFYYQSHDVTNKESYLTLKDLSDELDAKYELDGNRLFYLAMAPNFFGTIASRIKSEGFVDTDGFHRLIIEKPFGHDLASAEELNNSLRQAFKEDEIYRIDHYLGKEMIQNISVIRFANSIIESLWNNRYIDNIQVTLTEVLGVEDRGRYYDESGALRDMVQNHILQIVSLLAMEPPINLSTREIRHEKVRALRSLRVFEGKEVHQSFIRGQYGPGEVDGKELKGYRQEDNVDPHSNTETFVAAKLEIDNFRWAGVPFYIRTGKRLAKKTTQIAIQFKDVPLNLFGQQQSLGGNVLVIHIQPDEGITLHLNVKEPGQGMVTMPVNLNYIHSSPDGMNTPEAYEKLILDCLRGDATYFSHWDEVSLSWNFIDHIADVWTNTKDHFPNYKSGSMGPKEADDLIQRDGFQWFPID

SEQ ID NO: 2750 - protein, 148 aa, Burkholderia xenovorans LB400
MAYSDKVIDHYENPRNVGAFDPDAANVGTGMVGAPACGDVMRLQIRVNREGVIEDAKFKTYGCGSAIASSSLVTEWVRGRTLDEALAIRNTQIAEELALPPVKIHCSILAEDAIKAAVADFRSRQAIQGTAADSLQLADQPVCSSNPN

SEQ ID NO: 2751 - protein, 113 aa, Tissierella praeacuta
EVVICVPFVCLSEIKKAIENTNIKLGAQNMHWEENGAFTGEVSPKMLKDIGIDYVIIGHSERRQYFNETDTTVNKKIKAAISHGINPIVCVGETLEEREANIEKDIVKNQVLK

SEQ ID NO: 2752 - protein, 239 aa, Oryza sativa
  misc_feature (87)..(87): Xaa can be any naturally occurring amino acid
MAGSGDELMLLGKWPSPFVTRVELALGLKGLSYEYVKQDLVNKSELLLASNPVHKKIPVLIHNGKPVCESSIIVQYIDEAFPDAGAXAALLPADPYERAVARFWVAYVDDKFVPAWVATFRGKTEEEKAEGMKQLLAAVETLEGALKDCSKGKPFFGGDTVGIVDVALGGLISWVKATEVLAGSKIFDEEKAPLLAAWAQRFGELDVAEKVLPDVDGVVEFAKMRLAEAAAAAAAASKN

SEQ ID NO: 2753 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVSKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 2754 - protein, 609 aa, Solanum lycopersicum
MEQYEILEQIGKGAFGSAVLVKHKLEKKKYVLKKIRLARQTDRTRRNAHQEMALISSMQNPFIVEYKDSWVEKGCYVCIVIGYCEGGDMAEAIKKAKGVHFLEEKLCKWLVQLLMALDYLHTNHILHRDVKCSNIFLTREQDIRLGDFGLAKMLTSDDLASSIVGTPSYMCPELLADIPYGSKSDIWSLGCCIYEMAAFKPAFKAFDMQALINKINKSIVAPLPTKYSGPFRGLVKSMLRKNPELRPSAAELLRNPLLQPYVINTHLKLNGPRRNSLPACLPDNDVKKTRFAISESTPVKKNREKRMSCGNDRTLNPSVSDHDYTFSNRRYPKTPSRVSELSVGSPDRGSTVTKKITSKALLVNKNPQVIVPKLTTTPARQVDLRNSDMASRTLVKRSVSTTRRASLPLTNKAAVQELPRRPSLSFLDCIKSPDVSVNAPRIDKMLEFPLASYEDPFHPIRRTSSNSAQGSSGSPQAEYSVMKDKCTIQIPDSKFDRMSSNDAWQGYEGPMVHVDREDITDSSDQNATAGASSRTSSDTRRRRFNMSSYKQRAEALEGLLEFSARLLQEDRFDELGVLLKPFGPEKVSPRETAIWLTKSIKENAPKQED

SEQ ID NO: 2755 - protein, 327 aa, Escherichia coli CFT073
  misc_feature (296)..(296): Xaa can be any naturally occurring amino acid
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIXVILPSSGERYLSTALFADLFTEKELQQNASL

SEQ ID NO: 2756 - protein, 113 aa, Tissierella praeacuta
EAVICVPFVCLSEIKKAIENTNIKLGAQNMHWEENGAFTGEVSPKMLKEIGIDYVIIGHSERRQYFNETDTTVNKKIKAAISHGIKPIVCVGETLEEREANIEKDIVKNQVLK

SEQ ID NO: 2757 - protein, 498 aa, Escherichia coli CFT073
MLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDTLPTEEEQFAAYKAVAEACGSQAVIVRTMDIGGDKELPYMNFPKEENPFLGWRAIRIAMDRKEILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 2758 - protein, 593 aa, Candida glabrata CBS 138
MLHKHTDKQRLPVNIVDHHHIDPCLQDFKLLSKELQDIASNSEKLKALGSKENKESHLLSMKYVIPKEGVPADQAYDMIHNELTLDGNTHLNLASFVNTSTTHEVRKLISENLTKNLADNDEYPQLIELTQRCISMLSGLWNANPEEEPIGCATTGSSEAIMLGGLAMKKMWEKKMKAAGRTDTSKPNIIMSSACQVALEKFARYFDVECRLVPVSRKSHHMLDPNLLWDFVDENTIGCFVIMGTTYTGHLENVAEVGDVLTAIEKQHPEWANKDIPIHVDGASGGFIVPFAFSREQLKAYGVPNWGFDHPRVVSINTSGHKFGLTTPGLGWVLWRDESHLAPELRFRLKYLGGVEETFGLNFSRPGFQVVHQYYNFMNLGYDGYRDTFKRSLFVARVFAHQILRSPIFNDYFEVVSSIHESIDGDKVPDAANDYWENPEKYKPGVPLIAFKFSDKFQKEYPEVPQALLSHMLRTRGWIIPNYPLPHSTDGSDKCEVLRVVFRNEMSLDLAQLLLSDIQAVLRKLQGSYSGLKTISHESDSDKRRDYVYKMLLALASPDADIGEDEDEETKEKKASKKEEIKQRLKRNYRGTC

SEQ ID NO: 2759 - protein, 303 aa, Escherichia coli CFT073
MSTLEQTIGNTPLVKLQRMAPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 2760 - protein, 215 aa, Xylella fastidiosa 9a5c
MSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 2761 - protein, 468 aa, Clostridium perfringens str. 13
MKDVKVLKKEYENAWTKYEEADLKQVFSLSDRYREFMSVAKTERECVKVLANMAESKGFKNFYEVIKNGEKVTAGDKLYSINMDKTITLIKVGSEPLENGLRIIGAHIDSPRMDVKQNPLYEDSGLALLDTHYYGGVKKYQWVTIPLAIHGVVVKKDGTRVDIKIGEDENDPVLGISDLLIHLSADQLDKKGAKVVEGEDLNILVGSMPLKGTEEKEAVKANILVLLNEKYGITEEDFVSAELEVVPAGKARDYGLDRSMILAYGHDDRICAYTSAEALMDLENVDKTCVALLVDKEEIGSVGATGMQSRFFENIIAELMDRKGEYSELKLRRCLQNSMMLSADVTAAFDPNYPSVCEKKNTAYFGHGVVFSKYTGARGKAGCNDANAEYIAHLRNIMDKNGVVWQTGELGKVDQGGGGTIAYILAQYNMEVIDCGVALQNMHAPLEVASKADLYETKKCYKAFFEEA

SEQ ID NO: 2762 - protein, 134 aa, Brassica napus
MSEEDKAAASAEQPKRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVVPGSFLRARAIGLMPMIDQG

SEQ ID NO: 2763 - protein, 455 aa, Francisella tularensis subsp. tularensis SCHU S4
MDNNQDKLKRDILSRHIVMISLGGTISASFFLGIGSILNTVGAFGTVIGFFIGGIIMMLVMISLAEMAFEMPISGSFQSYATKFISPYSGFLTGWLYLLNWLTAAAGGLVAAGIICNNFYPAISVWQFCLAIILIVSLLNLCAVRVFAEIEFWLSAIKIITIIIFIIIGIGIIGGFLHSNKPIAGLVNFYVDGLFPNGFKAFLFGLVIIVCTFQGAEVVGIAAGETKEPEKNIRKAIRSVAVRILLFFVFSSFIIAYVIPYKDSGITNTPFVTVLQLVNIKYVDTIMQLVILSASLSAVNSCFYTCARLMWSMAEANQAPKIFAKISKKQVPIYGVVFVALLSCICLITKFIGAEKIFILVISSSGMVGCMIWIIISMCHIYFRKSLTASQIESLRFKAWGFPLIPYTSILFNSCVILAMFWDPEQRMVVYSGVILILLFSFLYKFYYKKIIVKT

SEQ ID NO: 2764 - protein, 171 aa, Rhodospirillum rubrum ATCC 11170
MNLKDHIREVPDFPKPGILFYDISTLLADPDAWQVTMGRMAKVVAPRLPDVLAGIESRGFLVAAPLALKLGLGFVMVRKKGKLPGATVRHEYALEYGTDTVEVQEGAVLPGQRVVILDDLLATGGTLNAASELLGKMGANVVGAACIIELSFLKGRERTKVPIDSLVAYDS

SEQ ID NO: 2765 - protein, 276 aa, Oryza sativa Japonica Group
MAERGGGGERGGERGGFGRGFGRGGRGDRGRGGRGGRRGPRQEEEKWVPVTKLGRLVKENKIHKIEEIYLHSLPVKEHQIVEQLVPGLKDEVMKITPVQKQTRAGQRTRFKAFVVVGDGDGHVGLGVKCAKEVATAIRGAIILAKLSVVPVRRGYWGNKIGKPHTVPCKVTGKCGSVTVRMVPAPRGSGIVAAHVPKKVLQFAGIEDVFTSSRGSTKTLGNFVKATFDCLMKTYGFLTPDFWRETRFIKTPFQEYTDLLARPKGLVIEAPAEKIEA

SEQ ID NO: 2766 - protein, 727 aa, Bradyrhizobium sp. BTAi1
MVVAQGPGGGEVGPDGRPKQQPQGQPQRPGPGAPPPHQAAPPPPPAPPPAAAPRPAPPPPAPPPAAAPRPAPAPPPPPPPPRAEPPRPAPPPPPPPPRAEPPRPAAPPPPPPPPRAEPPHAAPPPSRAEPPAPPPSRPAPPVAAPPVHTPPPPAPPPASPHEPARPATPPAPPPAAAPVRPTPPTPPAATPAPPPPSSSAPNQRPGTPPSPVTPPPSPPAAGNAPPPAHTPPRSAAPSPQPTPAPTPPGGPGQRPPIQPGAGAPPPGAPQGAPPPRGAPTPPAGTVAPGPGTPPSPATPPAAQTPPPNAQPGTPSPGPRPGTPPTPPPAAGPGPAAGPGAAGPGPGTAAPGPGGPAATPAPGPGSGPGAGAQGAVPPAGPPAMTNRPPPQVAAPIPAPPPPSPQQLTPIAPGAPLVGPQRLEDFRGQRREVQEGGRTLIYEPGRVIVRDPGGQEFVRHDELERFRYGARDIRVMREDRGETRTVVIRPDGSQIVTITAPDGRLLRRIRRDIGGREIIIIDNTYRDPQAVGGFYVDLPPPEIRIPYNRYIVDAEEAPPDVIYDTLVAPPVERVQRRYSLDEVRYSPSVRQLMPSIDLNTITFETGSWEIGPDQVAKLQVIADGLNQAIQRNPREVFLIEGHTDAVGNETDNLSLSDRRAESVATLLTQQFGVPAENLTSQGYGEQYLKEQTQGPSRINRRVTVRRITPLLNGGQAALPPPPPGIAPPR

SEQ ID NO: 2767 - protein, 141 aa, Cistus creticus
KGRILTEGSRVAMLGYGSIVQQCLEAARLLRNFNVNVTVADARFCKPLDTNLIRRLAAEHEFLITVEEGSIGGFGSHVSHFLSLTGLLDGHLKLRPMTLPDRYIDHGSHEDQMEEAGLSSRHLSATVLSLLGRPKEALQFK

SEQ ID NO: 2768 - protein, 493 aa, Prochlorococcus marinus str. MIT 9303
MTNLLLALNFEPQIEGLGSEYWDVVDAARFPRTELRFRNDALLRQLGIEPDAVEDHHLEQAYGCFEARTPLLALRYHGYQFGTYNPLLGDGRGFLYGQLRDRFGQLQDLGTKGSGTTPWSRGGDGRLTLKGGVREIIASEALHRLGVTTSRTLCLVETGEKLWRGDEPSPTRSSVMMRMARTHLRFGTCERLLHLRDAQSLERLLRHVVDVYYPLIAAAYPVQEGNAASAIQAQLLAFYAELVERVARLTAEWMAAGFTHGVLNTDNMSLLGESFDYGPFAFFDQWEPGFTAAYFDQTGLYAYGRQPGTCHNNLRLLQEPLAMLLPRQPMKQSLETFAPIYQSHYRACMQRRLGLPSSFDHNGNIEGGDDAVRKTLALLDAWPIGYGAFFAGLAAQISTNGLPEEPEALLPVVLDGAEPARKVWLDWRDRWWTQQREAVSANPAEAQAINARLQRWNLVKTPIRSVIEEFWQAIDQHDDWQPLQAWLKAICMD

SEQ ID NO: 2769 - protein, 586 aa, Xylella fastidiosa Temecula1
MSPQTSLSILLHPGSPAPMSSSSIEDIKGKSHRLRGSLLESLANPTTGALGESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVTIGGGMGTTHGDPDTWPRVGNIIGFITRADLITISTAIVTTQRDFGNRTLRKRARFKYTIDDRGLDCIVGEIQQRAGITLQPARPFVFEHNGDRYGWIEGEDGHWHLTLSLPAGRIADTEGSTLLSGFREIAQLGIGEFRMTPNQNVVIAGISPGQRAAIDALVTQYGLDTGNRAPTALGRHAMACVALPTCGLAMAEAERYLPDFNAKLQPILEKYGLAEAPILLRISGCPNGCSRPYLAEIALVGKAPGRYNLMLGGDQRGQRLNTLYRENITETEILAALEPLLGRYQQKRLPSEGFGDFLHRTGIIALPPYPTHRHVISSTLQA

SEQ ID NO: 2770 - protein, 476 aa, Aquifex aeolicus VF5
MAKKIRYLDRNKEPTLPPEERVKTFREFELGYSVNLALDEAQRCLFCKDAEQRCIKGCPVHVDIPGFIKKITEGDLVGAYKVITQSDIFPSICGRVCPQERQCEGSCILYYDTVRNRKNKGLPVAIGALEKFVGDFIRISGIEIEEEKEPPTGFRVAVIGAGPAGLSCAHELAKKGHEVHVYEALPKPGGVMYYGIPNARLDKSIIEWEVKRLEKLGIKFFYGYLIGKNITLQELREKYDAVFIAVGAGRGKLGLPGDHLKGVYSAIDFLMRVNLYKANEFPKKGVPVELGKRTVIIGGGFTAVDCAITANRLGVETHVVYRRTRETSSARQEEWDHLMEEGVKIHWLTQPVEVIGNEKGEVVGLKCIKMELGEPDESGRPRPVPVPNSEHIIECDSVIFAIGQRANPIAYEGSGIKTTKWGTIEVNERYETNLEGVFAGGDVINGGDRVVVALAHGKEAAKYIHEYLMSNKEVRK

SEQ ID NO: 2771 - protein, 363 aa, Synechococcus sp. RS9917
MLKAGIVGLPNVGKSTLFNALVANAQAQAANFPFCTIEPNVGTVAVPDPRLQQLSDLSGSKELIPARIEFVDIAGLVKGASQGEGLGNKFLANIREVDAIVHVVRCFEDDDVIHVSGSVGPARDAEVINLELGLADLAQVEKRRERLKKQMRTSKEAQVEDAALERIQAVLEQGGAARSVALTEEEAAMIKPLGLLTAKPIIYATNVSEDDLAPGNRFCEEVVALAASEGAETVRISAQVEAELIELGDEERADYLEGLGVSEGGLQSLIRATYNLLGLRTYFTTGEKETRAWTFKAGMTAPQAAGVIHTDFERGFIRAQTIGWQKLLEAGSLAEARNKGWLRSEGKEYVVDEGDVMEFLFNV

SEQ ID NO: 2772 - protein, 272 aa, Aquifex aeolicus VF5
MIKYGGSAMHDEELRESFARDVVLLKYVGINPVIVHGGGPQISKTLEKFGIKPKFVGGMRKTDEETMHVVEMVLSGDINKDIVALINRYSGEKIYAVGLSGRDGRLLKAKKLDKERYFSELGLPVPEEDIGFVGEIVDVNEELIFTLLSHNFIPVIAPVGVGEEGEAYNVNADLAASEIAGEIKAEKLIYLTDTKGVLDEKGELISSLSKDKAEELIKKGVIREGMIPKVRSALRALEKGVKKVHIIDGRVKHSILLEVFTKEGVGTEITLE

SEQ ID NO: 2773 - protein, 391 aa, Aquifex aeolicus VF5
MLQVRVKPGVEDRIRGFFPWVYRSEIASFSRKPKKGEIVVVRDVNGKFLGYGYINPEVNIAIRILSFDKNEPVTPELIRKRIKQAYEYRKRLYINSNAYRLVHSEGDLLPGLIVDVYGSYLAVEFTTYGMNQFREVILDTLVELLRPKGIYEKVNEIAKRVEGLDVEERVIYGEVPEEVIIWEHDLKYYINIPQGQKTGFFLDQRNARKFVRNLVEPGDRCLDVFCHTGGFALNMKRAGAGEVIGVDISELALKEAEKNARLNGFTDIKWVKANAFDYLRELDKKGEKFDVIIIDPPSFAKNRAAVPNALRGYKELCVRGLKIAKSGGYLAIFSCSFHITEQHLLDVLLQASYDVRRQVRVIAKTFQDLDHPWILQMPNTLYLKGVWVEVV

SEQ ID NO: 2774 - protein, 355 aa, Agave americana
MGDWQELGQAVFIGLIFAFLVAKLISTVISFREDHLKVVREEDLISETVEATPSDDVKNLEGEPRGLDAGKLVSGEARVSDDDDDDDWEGIESTELDELFSAATAFVAATAADRNSAKVSNELQLQLYGLYKIATEGPCTKPQPSALKVTARAKWNAWQKLGAMPPEEAMEKYITIVSELYPSWADGAASKNKDEGTSDSSKAAKGPMGPVFSSFAHEEESDNDLKLDAIHACAREGEADNLLRHIENGVPVNSRDSEGRTPLHWAVDRGHFNVVEILLSRNADVNAKDNEGQTPLHYAAVCDREAIAELLVKHNADTDLKDEDGNSPSDLCSSSWAFMASAEQTKVSLGDTEID

SEQ ID NO: 2775 - protein, 361 aa, Aspergillus nidulans FGSC A4
MDFSEYTGPSDEWVALERDLPADVPDLDPNQLKDAVNKTREEGAARELIEQGLSSKVTLRDHTIPTRDGYSLEARSYRPANVSPSEPLPIYIHLHGGGFLFGTLSSEDATCARIVASLHEQNTPVVVVNVNYRHTPEHIYPTAWNDTEDAFHWIHDHLSEIGGDGERLVMGGISAGAWLTASTTIAQATGRNKDLAQRPKIKGQVLMIPPLAHYNCYDPQLAQIRDPSVSSYVENRDAPVLPFKRMELFTSLLKVTGGKEVEKDLRLNPGNASKEDVKGLPPSTFGVAGMDVLRDEGLLYAKLLAENGVPTQTNVFKGVPHGFRRYGDRLSVCKKWDEVMAGGIKWALDDPAPGPFEIHAF

SEQ ID NO: 2776 - protein, 609 aa, Idiomarina loihiensis L2TR
MSDLSMLALIGVLSISCQWLAWRIKLPAILPLLICGLLLGPTLGLLEPDSLFEDLLFPFVSLAVAVILFEGSLTLKFEEIRGHGRMVTNLVSIGMLVTFVVIAILTHFIMGYGWEISALFGALVVVTGPTVIQPMIRSIRPINKLANILRWEGIIIDPLGALLAVLVYEFIIASQDVAFLHALQAFATTIALGFALGWGAARLLGLALGRGWFPHYLQNVATLTIVLGVFALSNAIQHESGLLTVTVMGMVMANTRNLNMEEILEFKETLSVLLISALFIILAARLDFAEFDALGIPAVILIAIILFAVRPLAVWLSAIGTELRFKDKVLLSWIAPRGIVAAAVSALFALKMEESGWTEAAAVVPLVFLVIMTTVVLQSLTAKPLARMLGLLEPQAKGFLIFGANQMARAVAKSIQESGIPVRLADTNWENIKLARMDNLPVYFGNPASEHAANNIDLTGLGQLLVMSPYKQLNPLVSMYYQDWFGSRKVHGLNGGEQDYRASHQLTENYRKTLNLFGDSVTYSKLASLHFKGAKIKSTPITDSFSFADYQQKYGTRALPMFALDDAEKLHIFTTERELIPQPGWTVIAMISAEPEENDVEQDNAERKE

SEQ ID NO: 2777 - protein, 350 aa, Listeria monocytogenes EGD-e
MTYKITSLAGDGIGPEIMTSGLQVLEAVAKKYNHTFEIESHPFGGAGIDVAQDPIPSSTLKACQDADAILLGAIGGPKWDNAPKRPEDGLLALRKALGLFANIRPIQVPSSITHLSPLKKEIVENTDFVVVRELTGGLYFGEPKHWDESAAVDSLTYTRAEIERIIEKAFEIAATRNKKVTSVDKANVLASSKLWRKIAEEVASRHPDITLEHLYIDAAAMLMIQRPTTFDVIVTENLFGDILSDEASVITGSLGMLPSASHAENGPSLYEPIHGSAPDIANQNIANPMSMISSVSMMLRQSFSLFKEADAIDAAATRTMQAGFLTADLGGNTTTTDFTNEVLKQIEGGE

SEQ ID NO: 2778 - protein, 804 aa, Aspergillus nidulans FGSC A4
MPHHEPSTADGWHGSIPDSFPAEPDRYHLYIGLFCPFAHRVNFVRHLKGLTELIDLSVVMPYPKGDSKGWPGWRFPASNDEYPGATVDRLFGEDYLHKIYFKADSGYKGRYSVPVLWDRKTGTIVCNESLELLRWLPNAFNDFIPSSLASIDLYPEHLRTVIDGLHSWILPHLCTGVYKAGFASDQDQYNKNVIPVFGALNKLEKIVFANGGPFILGYQMTEVDVTVYATLVRFDTVYVQHFKCNLGTVRHDYPVLNNWLKAMYWDVPAARESTDFRHIKENYTKSHYDINPKAITPLGPWPDVEEGVERDWTKLTVGGVSHPAVLEFEKELNEEQAARQPECLHSSLTYDPSPIAAQVHYTQPSVQDRQDAVTPSSPKETPAPPTRIDLKHFPAPLVLPGDDLALDPEQPPQSFQEWYDEEDRNPVTVKRRTVYLIGPPNVDRSAEEVNSWAAPTLGPETGTEAGYGAEGKKEAVLKPPAVDDILPYISAFFSGLPVKKLRPPPSKWKFTPWTEELPKRSKKVSYIALTTPKGEAIRIRTRPCPASDKLYLRQLNLDDLLDVAISILPEDAYALCMLVHHDLFEDDEDIFVCGRAYGGSRVAVVSTARYNPLLDDSLYVGRDHAWPGSHCVCYIEDICKDHDPDDSGTHSGRKRKRKKPGIRQQPHNRSGPLESALAAFISTPPQAGGDDLPALWRYRILRTVSHELAHCFGLDHCVYYACIMQGSASLAEDARQPPYLCPVDLAKVLAATGSSGQKRDQALLEYCEQPGTRDNKHFAALGAWLRWSLQLGSGSSSSLDGGLS

SEQ ID NO: 2779 - protein, 113 aa, Tissierella praeacuta
EAVICVPFVCLSEIKKAIENTNIKLGAQNMHWEENGAFTGEVSPKMLKDIGIDYVIIGHSERRQYFNETDTTVNKKIKAAISHGINPIVCVGETLEEREANIEKDIVKNQVLK

SEQ ID NO: 2780 - protein, 567 aa, Streptococcus pneumoniae
MALEVIMPKAGVDMTEGQIVQWNKKVGEFVKEGEILLEIMTDKVSMELEAEEDGYLIAILKGDGETVPVTEVIGYLGEERENIPTAGAASPEASSVPVASTSNDDDKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVSKINVPGMESPLVMTSDDILEMNEVPESLVIIGGGVVGIELGQAFMTFGSKVTVIEMMDRIVPAMDAEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 2781 - protein, 196 aa, Streptococcus agalactiae 2603V/R
MIPVVIEQTSRGERSYDIYSRLLKDRIIMLTGQVEDNMANSIIAQLLFLDAQDNTKDIYLYVNTPGGSVSAGLAIVDTMNFIKSDVQTIVMGMAASMGTIIASSGAKGKRFMLPNAEYMIHQPMGGTGGGTQQSDMAIAAEHLLKTRHTLEKILADNSGQSIEKVHDDAERDRWMSAQETLDYGFIDAIMENNNLQ

SEQ ID NO: 2782 - protein, 343 aa, Prochlorococcus marinus subsp. pastoris str. CCMP1986
MKAAILVNQKKKLIVDELDLPTSLKVGQVLVKLEYSGICGTQIGEIDGVKGEDKFLPHLLGHEGSGIVEKVGPGVKTVREGDSVVLHWRQGNGIQSEPPKYNWNGKTVNAGWVTTFNTKAIISENRCTKIPANISKEDAALFGCAVTTGFGVIENNAKLKMGESIVVFGAGGIGLNIIQAARLTSAWPIIAVDLFDNRLDLAKKLGATHSVNSSNKSYLDEIENILKDRELDVFIDNTGNTSIIEMGYNLISDQGRLILVGVPKTGENINIFSLPLHFGKKITGSFGGECNPAKDIPRFIKMMQNGLWDLKGLITESYDLENINEAIFSMRTGKTSGRVIIKL

SEQ ID NO: 2783 - protein, 364 aa, Physcomitrella patens subsp. patens
MDRFRKSANKLRDQVVKQQHAVLKQLGGHASGSDIIIDEVELLRHQQLEKAYASTRAAKHFQREVVRCVEGIISNGNKQLEVANKLADECKKYGTEGPEIGMVLSKPSLQYGTAKIQMDKEQDSMLLALNTEVAEPLRAMFNGSPLEDARQLTQRYDRLRQEAEVQAGEVSKRRTKESGGVDSVVKLQVAETKMQELASSMAVLGKEATSAMLAVEAQQQRLTVQRIIALVHTEQAYHKRVAEILDQLQDQLVSELQHSEARVPSSGAAAEAPIFVDANMGNSAYSKHSQSSNYILAEVFNPFEAESHGELSLSVGDHVVVRQVVPSGWSEGECKGQAGWFPSSCVEARQRVSGVAVYEGYIAL

SEQ ID NO: 2784 - protein, 989 aa, Oryza sativa
  misc_feature (240)..(240): Xaa can be any naturally occurring amino acid
MPPAGDAAHAPPPPHRRLVFAFYLTGHGFGHATRAIEVVRHLIAAGHEVHVATAVPEFVFTAELPRSPSSQGLLHIRRAILDCGAVQTDALTVDPLASLLKYHETAVVPRESILRTEAEWLTSINADLVISDVVPVACRVAADVGIPSVCIGNFSWDYIYAEYIVASGDHHRSIVWQIAEDYSHCDILLRLPGYCPMPAFRDVTDVPLVVRGLRKSRSEVRKELGIAENAKVVVFNFGGXGWNLKQEWLPDGWICLVCGASDSQEVPPNFIKLAKDAYTPDAMAASDCMLGKIGYGTASEALAYKLPFIFVRRDYFNEEPFLRNLLESSIEMTRRDFLHGHWKPYLLRALTLQPCYDGPTNGGEVAARILEDTAVGKKCISDKFNGARRLQDAIVLGYQLQRAPGRDVAIPDWYSLSETEVGACPISENIKTKESTESCFEDFEILHGDLQGLPDTMSFLKSLSEFNQSELKSNGKQPQERIAASVLFDWEEEMYIARAPGRLDVMGGIGDYSGSLVLQLPLREACHVAVQRNHPSNQKLWENTQARRLENGGMEPVVQIVSFGSELSNRSPTFDMKLSDLMDVDKPISYEKAREFFCRNPSQKWAAYVAGTILVLMTELDVKFTDSMSILVSSDVPEGKGVSSSASVEVATMAAIAAAYGLNIAPRDLALLCQKVENHVVGAPCGVMDQMTSACGEANKLLAMVCQPAEVKELVAIPNHMRFWGLDSGIRHSVGGGDYGSVRVGTYMGRKMIKCAASDLASESSVSDAPVQSNDYKQNAIELLKSEASLEYLCNIPPHRYEAIYAKDIPEVITGDAFLKKYGDHDDTVTAIDPKRSYNVKAPTRHPIYENFRVETFKALLEAANTDEQLSALGELMYQCHYSYNACGLGSDGTDLLVNLVQEMQHRNMSKGESPSLFGAKITGGGSGGSVCVMGKNCLKSSEEIIEIQQRYKAATGYLPILFDGSSPGAAKFGYLKIRRRPSSPIAAK

SEQ ID NO: 2785 - protein, 305 aa, Prochlorococcus marinus subsp. pastoris str. CCMP1986
MRDAFANEIKRLSEANKNVVLLSGDIGNRMFDKYKSVSPERFFNCGIAEANMMSLASGMALCGLKPVIYTITPFTTTRCLEQIRIGVAYHNAPVVIVGTGSGLSYSELGPTHHSLEDIAILRAVPNINILTPSDKQELTTQLQEAISMNTPSYMRIGKKGEPDLFNESHNLGIGKANILKEGEEILIIGIGPILIEAIEAAKSLKNDGLNIGVASMGSIRPLDDDFLRKMISKKYKYWITLEEHGIVGGLGSTLIEWCSDKQLYDIKIKRLGVKNEFIHKLGNQSYTRNILGIDKKGIINTIKEL

SEQ ID NO: 2786 - protein, 160 aa, Arabidopsis thaliana
TLPFRIGHGFDLHRLEPGYPLIIGGIVIPHDRGCEAHSDGDVLLHCVVDAILGALGLPDIGQIFPDSDPKWKGAASSVFIKEAVRLMDEAGYEIGNLDATLILQRPKISPHKETIRSNLSKLLGADPSVVNLKAKTHEKVDSLGENRSIAAHTVILLMKK

SEQ ID NO: 2787 - protein, 574 aa, Gloeobacter violaceus PCC 7421
MELSESHGVQPMNSRGFPGIPKEGSWTRKARRQAAGQDQVLVTPPPADWRPQPYLEGVGGLGEVLVTLKELVELPLKKPEVLEQLGLEPVRGVLLVGPPGTGKTLTARALAEQLGVRFLAIIGPEMMGKYYGEAESRLRGLFAKAARLAPCLLFIDEIDGLAPDRASTDHEADRRVVAQLLGLMDGVTKTPGVVVLAATNRPDHLDPALRRPGRFDREVRFGVPDRDGRLEILRILTRRMPFDETVDLEAVADRAVGLVGADLKGLCQKAAYRALRRQGGNLESAPGMSVSQSDFVAALKEVKPAVLRAVQVEAPAVAWEAVGGLEPVKQTLRESVEGALLYPELYRRAGAKAPRGILLYGPPGTGKTLLARAVASQARANFIAVKGPELLSRWVGASEQAVRELFAKARQAAPCVIFVDEIDTLAPERGSGGADSGVSDRVVGQLLTELDGLEEAGAVLLIGATNRPEVLDPALLRAGRLDLQLKIDLPDRESRLAILRVHNRERPLAGVDLEFWAGSTEGWSGADLALFSNQAALAAVRRHREAGHTDPARIVLGPDDFEAAYRTLKQQRGD

SEQ ID NO: 2788 - protein, 635 aa, Xylella fastidiosa 9a5c
MIDSTCYPRLSRIQIPEDLRTFQESELRAVADELRNYLIESVGLSGGHFAAGLGVVELTIALHYLYCTPIDHLVWDVGHQTYPHKILTGRRDKISTVKHQGGLAPFPKREESIYDTFGVGHSSTSISAALGMAIVAQRHGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEGFVTIEDNVVAGGAGSGVAELLNAEGIVLPIVHLGLPDAFQQHASREDLLAEAGIDAAGVYAALLSRWPDLAVQNHPLSAVS

SEQ ID NO: 2789 - protein, 470 aa, Geobacter sulfurreducens PCA
MSTGMTTRERLAIDRVHMVELDADSRSRNFDEVNRGLTPEEAVREAQRCIRCTNRQCVAGCPVGVSIPEFITALADGNLREAARILTRDNALPAVCGRVCPQETQCEARCVRGIKGEPVAIGYLERFVADWATANVAELGDEPLPPPTGRRVAVVGCGPAGLTAAGELARKGHGVTIFEALHDTGGVLRYGIPEFRLPKTIIDAEVARLLALGVTVECNVIIGKTLTLAQLREEFDAVFIANGAGLPVMLSIPGENLKGVYSANEYLTRVNLMGAGRDPGSTTPIIAGKRVAVIGGGNTAMDCVRTARRLGAERAMIIYRRSEEQMPARVEEIKHAKEEGVEFVMLTAPIAIGGDKDGWVATLRCLRMELGAPDSSGRRSPVPVEGSAYDIAVDVVVNAVGTRANPLLTATAPELKLNRWGNIATDDNGATSVAGVYAGGDIVRGGATVILAMGDGKQAAAAIHDWLNRR

SEQ ID NO: 2790 - protein, 286 aa, Francisella tularensis subsp. tularensis SCHU S4
MIRIENVVKRKVQQGQKLLPNIKNIILIASGKGGVGKSTVTANLAVCFAKMGAKVGILDADIYGPSQPTLFDLKQNPNTTDKKKIIPLEKYAVKMISIGNLIDPESAVIWRGPIVSRALMQLLNDTDWGDIDYLFLDLPPGTGDIQLTISKNMPVTGAVIVTTPQDLSLIDARRALAMFQKVDIKTLGVVENMSYYICPKCGNSEHIFGEDGAHLLCGKNNIEFLGSLPLHKDIRENADNGKPYVSLDKDDSINTSYMTVAENILNQIEKLPKASSLDSIGVKLEN

SEQ ID NO: 2791 - protein, 305 aa, Desulfovibrio desulfuricans G20
MQIAIIGLGRMGMNMARRLLRGGHEVAVWNRSPAKTQVMEAEGAAGFTSLQALAASLAPPRTLWFMLPAGEATQQRMDEVLPFLQPGDVVVDGANAYWKDDRPRADRLAAHGIRYVDAGVSGGIWGLENGYCTMLGGEAADIRHLAPVLDTLAPPQGWMHCGPAGAGHFVKMVHNGIEYAMMESYGEGFDLLRNGPFSGLDLQGIAALWNRGSVVRSWLLELLDAALKKDPGLASLKGYVDDSGEGRWTVTDAVDHAVPVPVLAQALFRRFESRQDDLFSNKVLAALRNEFGGHAVKNTDEGDAS

SEQ ID NO: 2792 - protein, 244 aa, Zea mays
MSGGGQAAVSFLTKVAKVAAGLGLTASAVSTSLYTVDGGQRAVIFDRFQGVLPAVVSEGTHFLVPWLQKPFLFDIRTRPHSFSSTSGTKDLQMVSLTLRVLARPDVERLPEIFTNLGLDYDDKVLPSIGNEVLKAVVAQFNADQLLTDRPHVSALVREALVRRAGEFNIVLDDVAITHLAYGHDFAQAVEKKQVAQQEAERSRFLVARAEQERRAAIVRAEGESESARLISDATALVGNGLIEL

SEQ ID NO: 2793 - protein, 422 aa, Listeria monocytogenes EGD-e
MELVDLLVTEEDVEKAYEVLKSVVKHTPLEYDFYLSEKYHCNVYLKREDLQRVRSFKLRGAFYAISRLSAEQLEKGVVCASAGNHAQGVAYTCKRMTVPATIFMPTTTPQQKVSQVKFFGGSNVEVVLVGDTFDASATAAKEFAAAHGQTFIPPFDDPDIIAGQGSLAVEMVKDLNKAHEQADYVFAGIGGGGLISGVATYLKAKSPITKIIGVEPDGAPSMTAALKQNQVVTLDKIDKFVDGAAVKEVGSLTFQHAKVLVDEVTTVSEGAVCSTILDMYTKQAIVAEPAGALSVAALETYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLDRVAAFDPSYIPINDNQTLYTLLV

SEQ ID NO: 2794 - protein, 269 aa, Oryza sativa Indica Group
MAVTNGVIHASSREPLFSFGVIADVQYADIPDGRSFLGVPRYYRHSISVLQRAVSTWNKQHNIKFSINFGDIIDGYCPKDKSLWAVQKSRFVVLDAHEFSALGWPRDHPVTAEAMKFLEEKNPNSDKNSPDGLVGVDRRFVMFNGGVGKEQLSWLNDVLQDASARRQNVILCSHLPMDPGSASFAALMWNYDEVMAIVRQYKCVKACFAGHDHKGGHSVDSHGVHHRTLEAALECPPGTSAFGHIEVYPDKLLLVGSDKMADTEMCFEP

SEQ ID NO: 2795 - protein, 164 aa, Pseudomonas fluorescens
MNGVQRVFSISRRQLSVIAAALALTACHSPVNKQPPAPELGSGYRTDLTAQHAERHMAAAANPLAAEAGREMLRQGGSAIDAAIAMQAVLTLVEPQSSGIGGGAFIMLWDGKNVHAYDGRETAPAGATERLFLKADGKPMAFPDAQVGGRSVGTPGVLRALEVD

SEQ ID NO: 2796 - protein, 250 aa, Roseovarius nubinhibens ISM
MTKTAIVTGAARGIGLATTELLLEDGWQVAMVDWDADELARATEGRERILALPLDVSKPDQVAEIMTRTKEAFGGIDALINNAGVADFGPIEETDFARWRRVMETNLDGVFLMTQAATPMLRASGQGAIVNIASISGLRASTLRVAYGTSKAGVIQLTQQQAVELGEYGIRANCVAPGPVRTKLAMAVHSQEIIDAYHDAIPLNRYGSEREIAEVIAFLCSHRASYVNGQTIAVDGGFECTGVGLPALRK

SEQ ID NO: 2797 - protein, 591 aa, Dechloromonas aromatica RCB
MSNLVEVKVPDIGDFAEVPIIDLFVKVGDSIKVDDAICTLESDKATMDVPSPVAGVVKEVLVQLGAKVAEGSLLIKVESGAAAAAPAPQAAAPAAAPAAVPVAAPVAGSHAGGADIECEMLVLGAGPGGYSAAFRSADLGMKTVIVERYATLGGVCLNVGCIPSKALLHVAAVMEEAEHANDLGVTFAAPTVDIDKLRAHKDKVVGKLTGGLAGMAKGRKVEIVRGYGTFIDPHHIEVEVTDGTGQDKTGAKKIVKFQKCIIAAGSAAMHLPFIPKDPRIVDSTGALELRFVPEKMLVIGGGIIGLEMATVYSTLGAKVDVVEMMDGLMQGPDRDAVKVWEKQNAKRFDKIMLKTKTVAVDAKDDGLYVKFEGEGVSPEPVKYDMILQAAGRTPNGNKIGADKAGVAVTERGFINVDAQMRTNVPHIFAIGDLVGQPMLAHKAVHESHVAAEAAAGQKSAFDASVIPSVAYTHPEVAWVGVTEDQAKKDGRKIEAAKFPWAASGRAIANGADYGFTKLIFDAETHRVIGGAIVGPNAGDMIGEVCLAIEMGCDSVDIGKTIHPHPTLGETVGMAAEVAHGTCTDVPAPRKK

SEQ ID NO: 2798 - protein, 546 aa, Dechloromonas aromatica RCB
MSQIIEVTVPDIGDFDSVPVIDLFVKVGDTIKVDDAIVTLESDKATMDVPSTVAGVVKEVLVSLGSKVGEGALLIKVETGGAAAEPAAAPAPAAQAAAPAPAPAAAPVAAAPAAGGGVVEVKVPDIGDFAEVPVIELYVKVGDAIKVDDAIATLESDKATMDVPSTVAGTVKEVLVQIGSKVGEGTVLIKVESGASAPAAAPQAAAPAPAAAAPAPVAAPVAAPAAASPAALAPALAAGSKVHASPSVRAYARELGVDLNKVPATGPKNRIVKEDLTKYVKGVMSGAVAGPTAGGGASLGGGLDLLPWPKVDFAKFGEIEVKPLSRIKKISGQNLSRNWVMIPAVTYHEDADITDIEAFRVLLNKENEKGGGAKLTMLAFLMKACVKGLQKFPEFNSSLDGDNLVLKKYFNIGFAADTPNGLVVPVVKNVDKKSVFELAQESGDLAKQARDGKLKPADMSGACFTISSLGGIGGTYFAPIVNAPEVAILGVNKSAMKPVWDGKQFVPRLVLPLSLTADHRVIDGALATRFNVYIAQLLADFRRVAL

SEQ ID NO: 2799 - protein, 485 aa, Gloeobacter violaceus PCC 7421
MGIEVQVHRQLLQLLRSEQLPTVWPHQLTMGRLVARALSQGRSTLVQVSGSGEHRLSYLLPALSAPEPVILCASETIQQQLLDVDLPLLRRNLATEKPIGLGDRWPGTGWQGVLITDPLTFLRDRLRGGSHFPEGVAVIFDGAHGLEQWAIQALCERIEPADWDDLREGDFERAEFWLDWQVGLSRALSSQPHHRAALSPGRQAELASALGESPPSEAWRRFRAALGAPERAHWVQYYRQSNQFSLVSSPIAVAGDLARALWPRQPAVVIGEALDPAREARTFRSWVGLEEVTCLRFPADPREQEVQLYLPTQLSDPTSSQYRQQIEPVLVELAALAAGPLVILLPEGPLRSHLGTFLASQFGSRVGIHRLQPPPNGITLASWEFWEANHHHLGAPTTLAVCALPFPRLDDPLVAARVQWLKDRRRDWFREYLLPVAIGRLQRGISPLRQTQGLVALLDNRINHRSYGGQLLDALTPARRLRYLE

SEQ ID NO: 2800 - protein, 113 aa, Tissierella praeacuta
EVVICVPFVCLSEIKKAIENTNIKLGAQNMHWEENGAFTGEVSPKMLKDIGIDYVIIGHSERRQYFNETDTTVNKKIKAAISHGINPIVCVGETLEEREANIEKAIVKNQVLK

SEQ ID NO: 2801 - protein, 529 aa, Oryza sativa Japonica Group
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQVKVFKLEHYYAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 2802 - protein, 113 aa, Tissierella praeacuta
EAVLCVPFTIIQDVKKAIENTNIKLGAQNMHWEENGAFTGEISPKMLKELGVDYVIIGHSERRQYFNETDITVNKKIKAAISHDIKPIVCVGETLEEREANTEKDVVKSQILK

SEQ ID NO: 2803 - protein, 385 aa, Myxococcus xanthus DK 1622
MRGEPIVLSTYLSRDAARRLRHGAPWLRREDIVSMEGTPQPGEPVQLRDEDGSVLGLGDVDLEASYAVRRLGQPDEAVEGLIPRHLRHAFERRARLVDDPRFCRVVNDDGDGLPGLIVDRYDTHFVVQTLTRAMDARHEELTRALVEVAGAGAVLLRNDTLRRKALGLPTQRPHVLYGTPPRWCRLLEMGARFTVDLTYGQGTGYAYDQREVRRFVARMAQGSRVLDASCNVGGLFVHAGVHGARHILAFDADADAADLARENAEANGLLGRVMVETGKPLQVLRAVRDTFDLVLLDTPAVATGEEFVELLRHALRRTRHGGWLMVTGYHPPLPQDGFDDLVATACEGEARIATRLARPGLPPDHPTLAGSHGAEHLHAMALEVS

SEQ ID NO: 2804 - protein, 477 aa, Burkholderia xenovorans LB400
MSQYRSFINGEWLGTTSTLPNLNPSDLSDVVGEALLADDALVADAIAAARHAFRSWSLTTPQQRADILDAAGTRILQRKEELGTLLAREEGKRLPEAIGEVGRAGNIFKFFAGEALRIGGEVVSSVRPGMTVEVTREPLGVIGMITPWNFPIAIPAWKIAPALAYGNTVVIKPAEAVPACATELVKILEESGLPAGVVNLLLGPGRVVGEALVASPDIDAISFTGSESTGRAIAVKCVTSGKKVQLEMGGKNPLVVIDDADLDVAVEAALDGSFFSTGQRCTASSRLIVTSAIHGQFVAALQRKASELVVGHALDKATQIGPVLDDRQLQQNLKYLKIAAEEGGQVLGGERVERPTRGYFMRPALVIGTDNTMRINREEVFGPVASVIKVADYEEALAVSNDTPYGLAAGICTTSLKYASHFRRHAEAGMVMVNAPTAGVDYHVPFGGRKRSSYGPREQGTYAREFYTVVKTAYVKA

SEQ ID NO: 2805 - protein, 513 aa, Desulfovibrio desulfuricans G20
MSPADTRVTIGRAMCEETPPEPCGMVIFGASGDLVARKLLPALFGLFRRGLLPERFFMLGFARTPMTDDDFRGRVSESILAAHPQGAGQLDDFLALCRYTYGDYDDPAAYTNLALCSSECVMDYHAAENLLFYLALPPHLHAGVVRHLHGAGLTAEGENGSPWRRVVFEKPFGHDLASALELDSRLCSVLRQEQIFRMDHYLGKETVQSILMFRFANAIFEPLWNRGYVDHVQITVAESLGIEHRGAYYDSAGCLRDMFQNHMMQMLALVAMEPPTSFDPERVRDERVKLLHSIRPWTADDMRHWVVRGQYTQGVTAEGASLAGYRHEPRVAEGSTTETYVAARLFIDNWRWQGVPFFLRSGKRMPRKVSEIAVTFRRVPHSMFGMHSKSEMPANVLVLKIQPEEGIDLHIQAKQPGPKSCMATMALAFKYREIFGINPPDAYERLLLDCMLGDRTLFWSREGVEASWRLITPVLDTWCDNPQTSPLHQYTAGTWGPEAAQRMISAAGRQWRR

SEQ ID NO: 2806 - protein, 348 aa, Physcomitrella patens subsp. patens
MTAEPHPCPSPRGKYVGALGIRPYSFSSSSQRAILKSRDCKTKKPIHFLHLDDFDKETLVHILDRAAEVKAKLKSGDRSYQPLKGMSMSMIFTKPSMRTRVSFETGFYQLGGHAIYLGPDDIQLGKREETRDIARVLSGYNDVIMARLFAHKDLLDLAEYSKVPVINGLTDYNHPCQIMADVLTINEFIGSIEGLKVVYVGDGNNMVHSWLRLAAVFPFHFVCACPKGYEPDAATVERARRAGVSRIEISHDPTEAVKGANVIYADVWASMGQKEDAGNRKKVFQGFQVNEALMKSAGPQAYFMHCLPAERGVEVTDGVIEGPKSIVFPQAENRMHAQNAIMLHCLGF

SEQ ID NO: 2807 - protein, 323 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANEEDMPGESMDHTSFIRQWSDYTI

SEQ ID NO: 2808 - protein, 630 aa, Bacillus anthracis str. A2012
  misc_feature (471)..(471): Xaa can be any naturally occurring amino acid
MDLTQIQNPSFLKDMSISELEGLSEDIRKFLIEELSQTGGHIAPNLGVVELTIALHKLFDSPKDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARTDERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVIMMPKDENEGQHLVYTAMQYEDGPIAXRYARGNGLGVHMDEELKAIPIGSWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 2809 - protein, 470 aa, Vitis vinifera
MTWAFSLGVLDDLTRVCGFYGGAEIDQLYSMTFDIEVALFLGNRWTKHGILRVPKKVRKLLVDDPENSEYVDMEKELEETWRRSSQRTHFVAQKEAALMAEKISVEDCCDFWLKRNYDIGRHFNIDLLISTTILDIGYMDGDGNIDISRASKIINSGNGRLGLKYVRLQVIVLTEELLATAKQSEISLPAFGTNADASPIQHQSGGSSEHLMEPGNNSDHYGKFPIGTKVQAVWSEDGEWYEATIDSLTPDGYYVSYDGWGNKEEVYGIIHSKNRKKYRPQVDPGNVRPIQEEVNALLEAEKEAEATKQAIKRKIAQAAATDFQSRSLPAKLRIEPDDPEDVKIAKRKKIHAFKSKMRFEQLEVTQNKRQNAWQQFQTTKGRAKKLVVGLRPAFGLLSCGLLFPSIWVFLVCFLHAQIGFFSGRKRESIFKSPDDPNGKVGVTGSGKGLTEFQKREKHLHLKGGSADTDD

SEQ ID NO: 2810 - protein, 382 aa, Desulfovibrio desulfuricans G20
MRKTVYFIEGDGIGPEVWNAARPVIDKAVELAYGNGRSLEWKELLAGEKAYAETGTYLPQETLDTLAGAELAIKGPLGTPVGKGFRSLNVTMRQTLDLYACIRPIRYFEGIESPVKHPERVNMVVFRENTEDVYAGIEYKADTDEARKLIAFLRDELGANVDERCAVGIKPMSEKGSKRLVRRAMDFALAQGLPSVTLVHKGNIMKFTEGGFRQWGYELAHDEYAGRAVTEAQAAAGETGLVVKDRIADAMFQEVLIRPEQYSVVATSNLNGDYISDALAAQVGGLGLAPGVNMSDTLAFFEATHGTAPTIAGKDMANPGSLILCGGMLLEHLGWHEAATRIHTAMNTVIGNRTVTVDLASQMQGASTVGCRQFGELLGAAL

SEQ ID NO: 2811 - protein, 449 aa, Listeria monocytogenes str. 4b H7858
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAVPQKVEKNPDGSLTLSLEDGRTETVDTLIWAIGRKPVIQGLQIEKAGVKLLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 2812 - protein, 360 aa, Zea mays
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 2813 - protein, 414 aa, Aquifex aeolicus VF5
MIEDPMDWAFPRIKRLPQYVFSLVNELKYKLRREGEDVVDLGMGNPNMPPAKHIIDKLCEVAQKPNVHGYSASRGIPRLRKAICNFYEERYGVKLDPEREAILTIGAKEGYSHLMLAMISPGDTVIVPNPTYPIHYYAPIIAGGEVHSIPLNFSDDQDHQEEFLRRLYEIVKTAMPKPKAVVISFPHNPTTITVEKDFFKEIVKFAKEHGLWIIHDFAYADIAFDGYKPPSILEIEGAKDVAVELYSMSKGFSMAGWRVAFVVGNEILIKNLAHLKSYLDYGIFTPIQVASIIALESPYEIVEKTAKVYQKRRDVLVEGLNRLGWKVKKPKATMFVWAKIPEWINMNSLDFSLFLLKEAKVAVSPGVGFGQYGEGYVRFALVENEHRIRQAIRGIRKAFRKLQKERKLEPERSA

SEQ ID NO: 2814 - protein, 569 aa, Oryza sativa Indica Group
MALWWPLLVLAAAYALCRILLFLIPPTVPSIDVDASDAHGSWGLCGIYSNGIGSDRVLLYAVLEDANQNKEDSYIYISNDIGSHIASSFQIPPRKGKGAQTDKVQCYEPATMKYLGYFPALTPDEVKEHVAQARKAQKIWAKSSFKQRRQFLRILLKYILEHQDLICEISSRDTGKTMVDASLGEIMTTCEKITWLLDEGEKWLKPEYRSCGRSMLHKKAKVEFYPLGVIGAIVSWNYPFHNVFNPMLAAIFSGNAAVIKIMNRASDTLIPVTLELGGKDAFIVCEDVDLPSVVQVAVRAALQSSGQNCAGAERFYVHKDIYSTFVSQVVKIIKSISVGPPLSGRYDMGAICMIEHSEKLQNLVNDAVDKGAEIAGRGSFGHLGEDAVDQFFPPTVLVNVNHTMKIMQEEAFGPILPIMKFNSDEEVVKLANDSKYGLGCAVFSGNQKRAIKIASQLHCGVAAINDFASSYMCQSLPFGGVKDSGFGRFAGVEGLRACCLVKAVVEDRWWPYVKTMIPKPIQIIAFRPSVQAEDGMNCRLSRVSMVNSGVESLSTQAAELAPKFIGRSS

SEQ ID NO: 2815 - protein, 280 aa, Idiomarina loihiensis L2TR
MQTLLLGYGDIADRVAQRLSGQNEQVTGVCRTPESKPVRQGVNLVAADLNSEQELYQLFQNKWDNVVITLTPAKGAEDSYHQGYVVPCRHLQQVLSQQRHQPNIIYVSSTGVYAQRDGEWIDENSATEPTSDSGKALLQAESIINALPGQTSILRCSGIYGEGRDFLLRQLTQGNVQLRDSWTNRIHQDDVAGFIVHLLTQVNQPKPVYLVNDDEPVKQYEVYQWLAEQLGIELAGNINKKVGPRGSKRCMNKGLKDSGYQLQYANFREGYAPVIKQWQR

SEQ ID NO: 2816 - protein, 473 aa, Idiomarina loihiensis L2TR
MNKNIYQFLDVQRIDPPKRPVEERRIEFKEVYDPMPDVQLKGQADRCLDCGNPYCEWQCPVHNYIPQWLELANEGRVIEAAELMHKTNSLPEVCGRVCPQDRLCEGACTLNDGFGAVTIGSIEKQMVDEAFKQGWRPDLSGVTQRQERVAVIGAGPAGLACADVLTRNGVKAVVYDRYPEIGGLLTYGIPPFKLDKAVMTLRREIFTDMGIEFKLGVEVGKDISFAELEANYDAVFLALGTYKALDGKLKGLDADEVYPALPFLIGNTQKLMAHEPMSQYPLIDVKDETVVVLGGGDTAMDCVRTSIRQGASSVVCAYRRDEGNMPGSRKEVQNAREEGVSFEFNLQPLEVVTDNSGKVSGVKMMRTELGPADADGRRRPQPVPDSEFIMPATAVIIAFGYQPSPPEWLQQHKVELSDWGTVLATGDTEFAMQTSNPKIFAGGDMVRGADLVVTAIAEGRNAAEGMLDYFDAV

SEQ ID NO: 2817 - protein, 537 aa, Roseovarius nubinhibens ISM
MPRTTAPDHTTGPAPDCDLFVIGGGINGCGIARDAAGRGLSVILAEQGDLAQATSSASSKLFHGGLRYLEFFEFRLVREALEEREILLRAMPHISWPMRFVLPLDRDMRFETGTPASNMLSRIMPWMRGRRPAWMIRLGLFLYDHLGGRKILPGTARLDLTRDPVGVPLDPRYRRAFEYSDCWVQDSRLVALNARDAANRGATILPRTRVTEARRVDDLWRLTLTDQQTGTTREVHSRVLVNAGGPWVADILRDVAGQQSKETVRLVRGSHIVTRRLFDHDRAYFFQGRDGRIIFALPYEQEFTLIGTTDKDHPAPDSPAQITEEETDYLCAFASGYFAKPVTRDDIVWSYSGVRPLYDDGASSATAATREYVLSLNEDGPAPLLNIFGGKITTYRRLAEAAMARLAPYFPDMGLNWTAGVPLPGGDFPVAEAAEMPDRLRADHPFLSAPEAQRLIRAYGTEAWTILAGAKDRADLGRDFGAGLTEAELRWLIRHEWARTAEDAVWRRTRLGLRLTPDQIAEIDAAMAEWTSPATAD

SEQ ID NO: 2818 - protein, 494 aa, Bacillus anthracis str. Ames
MSQLAVNLHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDFFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASESLKRVTLELGGKSPNIILPDADLSRAIPGALSGVMFNQGQVCSAGSRLFVPKKMYDNVMADLVLYSKKLNQGVGLDPETTIGPLVSEEQQKRVMGYIEKGIEEGAEVLCGGNNPFDQGYFISPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 2819 - protein, 279 aa, Triticum aestivum
  misc_feature (207)..(207): Xaa can be any naturally occurring amino acid
MGSTRGGDASAIALLLCACFLTALACDSNGAKFAYSGPLGPDHWGGLDPNFTRCAMGTYQSPVDIKTSDVVYNPMLGPLHREYTAANATLVDNIFNIALRCEDAAGTVQIDGVKYKLDNIHWHSPSEHTINGERFAVEQHMVHFSDDGNISVVSILYRLGRPDPFLMQLQDKLSELYVEACRAEKGAPIPAGVVNMWPLRRYAHMYXRYVGSLTTPPCTENVIWNIHGRVREMTLGQAAALIAPLEEGYRRNNRPTQPLNGRTVQFYRRFWKKKGNGKP

SEQ ID NO: 2820 - protein, 767 aa, Oryza sativa Japonica Group
MASSGAPLCSSALVLLPCLFVIAMAALQSGVVVLADAADTVAADRPLSGRQRPLVSNRGKFALGFFQPENSEHWYLGTWYYQISKHTPVWVANRGSPISNPDTSQLTIATDGNMVLLDNSTTAIWSTNISNFTSNSTVGVILDSGNLVLADASNTSIILWQSFDHFGDTWLPGGKLGRNKLTGVSTRLVAWKARNDPVPGVFSLELDPNGTSQYLLQWNSTLQYWTSGNWTGRIFTGVPEMTPTGSYPNSLYTFDYVNGENESYFVYDLKDDSVLTRFVLGEMGQIQFLTWMNGANDWMLFWSQPKAQCDVYSLCGPFSVCTENAMASCSCLRGFGEQNVGEWLQGDHTSGCRRNVELQCSSNGSVVGRSTDRFYTMANVRLPSDAESVVAAELSGQKQKHTKKLITFSVLATGAVLLMIAVLVVILRRRMVKATTRVEGSLISFTYRDLKSVTKNFSEKLGGGAFGSVFKGSLPDATMVAVKKLEGFRQGEKQFRSEVSTIGNIQHVNLIRLLGFCSEKTRRLLVYEYMPNGSLDKHLFGSNQHVLSWNTRYKIALGIARGLDYLHEKCRDCIIHCDIKPENILLDGSFAPKVADFGLAKLMGRDFSRVLTTSRGTVGYIAPEWIAGTAVTAKADVFSYGMTLLEIVSGRRNVQEQGGAAVDGLLPLLAASTLGGGGGGRDELVSAVVDGRVGVNADMGEVERACRVACWCIQDDEKARPAMATVVQVLEGLVEIGVPPVPRSLQILADLANQSNNLRFFSDLPSK

SEQ ID NO: 2821 - protein, 113 aa, Tissierella praeacuta
EVVICVPFVCLSEIKKAIENTNIKLGAQNMHWEENGAFTGEVSPKMLKDIGIDYVIIGHSERRQYFNETDTTVNKKIKAAISHGINPIVCVGETLEEREANIEKDIVKDQVLK

SEQ ID NO: 2822 - protein, 489 aa, Vitis vinifera
MEDANSWIRRTKFSHTIFHRLDSTRLASFPLTISPERNSGLKSRPQRGSLNLKSEPSDPQGRRNAFTNKQRSLSPLPESKLSDEFKEARSDRKRFSTPVPRRKEHEKGIMGKLFSKDSQDPKASNSNKQSNTSPLRHLTSTKNHDKAKFRKEPSWIKYFDHGGGRVTAVEAADEWMADLSKLYLGLRFSHGAHSRLYHGVYEEQPVAVKVIMVPDEEENGALASKLEKQFNGEVSCLSRLHHQNVIKFVAAWRRPPVFVVITEYLSEGSLRAYLHKLEHKSLPLEKLITIALDIARGMEYIHSQGIIHRDLKPENVLVTKDFHMKIADFGIACEEAYCDSLADDPGTYRWMAPEMIKHKSYGRKVDVYSFGLILWEMVAGTIPYEDMAPIQAAFAVVNKNLRPVIPVDCPPAMRALIEQCWSLHPDKRPEFWQVVKVLEQFKSSLALDGTLNLVRYATCQDHKKGLLHWIQKLGPVHHNTSSMPKPKFT

SEQ ID NO: 2823 - protein, 468 aa, Burkholderia xenovorans LB400
MSPIAARLERLPFSRFHFKLLIMGGLGFMFEAIDAAIIAFILPVVRTKWHLTSFETGLLGSSTYVGFLVGALFAGLLGDRFGRRVVMMWALTFFCVLTFVNAFVNDWHTFALLRAIAGIGMGAEGAIIAPFLVEFVSNRYRGAFTGALAGFFSFGFVAAALIGYFVIPLNPEGWRIALVIVSLPVIVLLWWRRSLHESPRWLETRGRHEEAAAVVTDIERQIERSGVTLPPVVPVAGDATLHEYSGSFFGNLKLLWKPPLAKTTLMTWCLWLSVTFCSYAFFVWIPGLLVQHGMTITKSFSVSIAIYLAQIPGYYSSAYFCEKLGRKTTIVTYMGLACASGIWLAFAGSDLTIVLASIAMSFSMNGVNAGEYAYTPEVFPTHLRATGMGTASAFGRIGAICSPMLVGYVYPIWGFAGVFGMTTVILLVGALAVLILGVSTSGKTLEQITADEYSLADDLPGASLKTAK

SEQ ID NO: 2824 - protein, 93 aa, Triticum aestivum
VRPLKDLIEFPRFFSYSLEHRIEPRHKVLVANRINMKLRYMLPGSDEEFAQRVQEAVERRARFEAGEATPETSGAPETPSGNGNGVAAAAACQ

SEQ ID NO: 2825 - protein, 383 aa, Zea mays
  misc_feature (226)..(226): Xaa can be any naturally occurring amino acid
MRQPTSAGGDAGFVRADQIDLKSLDEQLERHLGRRAERGVGLPSGTGSRGGESARLGPEELTPLRRCREDWEIDPTKLVIRGVIARGTFGTVHRGVYDGQDVAVKLLDWGEDGHRSEQEIAALRAAFAQEVVVWHKLEHPNVTKFIGAIMGARDLNIQTEHGHLGMPSNICCVVVEYLPGGALKSFLIKNRRRKLAFKVVVQIALDIARGLCYLHSEKIVHRDVKXTENMLLDKTRTVKIADFGVARVEASNPSDMTGETGTLGYMAPEVLNGHAYNRKCDVYSFGICLWEVYCCDMPYPDLSFSEVTSAVVRQNLRPEIPRCCPSSLANVMKRCWDANPDKRPEMAEVVSMLEVIDTSKGGGMIPKDQTQGWLSCFRRYRGP

SEQ ID NO: 2826 - protein, 170 aa, Beta vulgaris
ALLHSSHTYHEAKHAFAAHGVKCSSVEVDLPAMMGQKDKAVSNLTRGIEGLFKKNKVTYVKGYGKFVSPSEVSVDTIEGGNTVVKGKHIIVATGSDVKSLPGVTIDETKIVSSTGALALKEIPKRLVVIGAGYIGLEMGSVWGRIGSEVIVVEFASDIVPTMDGEIRKQF

SEQ ID NO: 2827 - protein, 465 aa, Vibrio cholerae
MKICPVVLSGGVGSRLWPLSREHFPKQCLNLTDLLSSLLQQTLVRTNHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPTRAETGYGYIKAGQDSCVEKFVEKPDLATAQSYLESGDYLWNSGMFLFQASQYLAELKQHRPAMYAAVESAYGNRTEDLDFIRIGTEAFTACPSESIDYAIMEPTQNAKVVPYNGDWSDIGAWDALHDYCEKDSNHNVLVGDVMAESTTNSLVRAESRLVATIGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFSDRYGR

SEQ ID NO: 2828 - protein, 263 aa, Mycobacterium sp. CH-1
MSAVKAGDRRVAIVTAAAAGIGKAIALRWCREGGCCVMADTDGEGLDAAVAELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 2829 - protein, 821 aa, Physcomitrella patens subsp. patens
MASSGSGTKPEDVPPAPEGRGTKRDFTSAILERKKAANRLIVDEAVNDDNSVVALNTETMDKLQLFRGDTVLVKGKKRKDTVCIVLADETCEEPKIRMNKVVRANLRVRLGDVVSVHQCADVKYGKRIHVLPLDDSVEGVTGNIFDAYLKPYFMEAYRPVRKGDLFLVRGGMRSIEFKIIETDPAEYCIVAPDTEIFCEGEPVRREDEERLNEVGYDDVGGVRRQMAQIRELVELPLRHPQLFKSIGVKPPKGILLFGPPGSGKTLIARAVANETGAFFFLINGPEIMSKLAGESESNLRKAFEEAEKNAPAIIFIDEIDSIAPKREKTQGEVERRIVSQLLTLMDGLKSRAHVIVMGATNRPNSIDPALRRFGRFDREIDIGVPDEVGRLEVLRIHSKNMKLAEDVDLEKVAKETHGFVGADLAALATEAALQCIREKMDVIDLEEDSIDAEILNSMAVTNEHFQTALGTSNPSALRETVVEVPNVTWEDVGGLDNVKRELQETVQYPVEHPEKFEKFGMSPSKGVLFYGPPGCGKTMLAKAIANECQANFISVKGPELLTMWFGESEANVREIFDKARGSAPCVLFFDELDSIATQRGSSGGDAGGAADRVLNQLLTEMDGMNAKKTVFIIGATNRPDIIDSALLRPGRLDQLIYIPLPDEASRLRIFQACLRKSPIAKEVDLEALARHTTGFSGADITEICQRACKYAIRENIEKDIEKEKKRAENPEAMEEDDTDEVSEIKAAHFEESMKFARRSVSDADIRKYQAFAQTLQQSRGIGSEFRFPERPATASGTAANGAAGTVSAFAGGATDEDDLYN

SEQ ID NO: 2830 - protein, 491 aa, Listeria monocytogenes str. 4b H7858
MVFLSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVKQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIVISNPETPFGGVKHSGFGRENGHYGMEEYIQVKFINLKYRD

SEQ ID NO: 2831 - protein, 276 aa, Brassica oleracea
MLSRLFKAGEKVLSNLVNKKDFHMASSNTENPPKVQELYELCKSTFTGKAPSPGSTPVQKLCYLLDSVSPGDVGLEEEAQDDDRGYGVSGVSRVNRVGRWAQPITFLDIHECDTFTMCVFCFPTSSVIPLHDHPEMTVFSKILYGSLHVKAYDWVEPPCIITHDKSQARLAKLVTDKVITPQSELPVLYPKTGGNLHCFTALTPCAVLDILTPPYNESAGRSCSYYIDYPFSTFALEEGVKSVEGKEDEYAWLVQIDTPDELHMRPGSYTGPTIQV

SEQ ID NO: 2832 - protein, 164 aa, Glycine max
  misc_feature (68)..(68): Xaa can be any naturally occurring amino acid
  misc_feature (109)..(109): Xaa can be any naturally occurring amino acid
  misc_feature (116)..(116): Xaa can be any naturally occurring amino acid
  misc_feature (125)..(125): Xaa can be any naturally occurring amino acid
  misc_feature (133)..(133): Xaa can be any naturally occurring amino acid
  misc_feature (135)..(135): Xaa can be any naturally occurring amino acid
VYRASVCMVGPFTGLKSMAGLPTKKTNYDITFIALNCGILQCMRVCPPDGKKKFETLCYLPHLDDAQXAKEVQYLLRKGWIPCLQFQLDHGFVYREHNRSPRYYDGRYXTMWDLPXFGCTDAYQXVKELQEAXTXYPNCFIRIIRFDHLSPSPCINFIAFKSPS

SEQ ID NO: 2833 - protein, 178 aa, Bradyrhizobium sp. BTAi1
MRIDAIPIGKDPPREVNVVIEVPVGGEPIKYELDKEAGTLFVDRFLYTAMRYPGNYGFIPHTLSNDGDPCDVLVANTRAIVPGAVMSVRPVGVLIMEDEAGGDEKIIAVPSSKLTQRYDKVRTYSDLPDITLQQIQHFYEHYKDLEPGKWVKVLRWGNADDAHQLISEGIARAKAAKK

SEQ ID NO: 2834 - protein, 379 aa, Desulfovibrio desulfuricans G20
MADADRIQERMGSVREDIDAVDRELLALLNRRAELSLEVGRIKRDDPGVIFKPFRERDVLEKLRSLSAGPLPEEHLRSIYREILSSSRSLQRPQRVAYLGPEGTFSYFAGIQFLGHSVEFLPQKDLHGVIRSVHARECELGVLPLENSLHGTVGQSLDLFLRYEVFINAELFCRISHSLLTAEKRLSDITTVYSHPQPLAQCGEWLRLNLPGARIIPTESTAAAARRIKGEKGAAAIGHGNLAERLGLSVLASAIEDQPDNWTRFVVVGPVPADREGRDKTSMLFTLPDKSGSLAQVLNILAREDINMKKLESRPLRGEKWQYVFFVDVECDLNHEDYRQLVDELKHVCHSLRILGSYPAGMYFDVARTADGSERLVTE

SEQ ID NO: 2835 - protein, 566 aa, Arabidopsis thaliana
MGSGTNHLKSNTFIKREANMLGKNPWPEKDSGGSSVSRDTGTGKDVQDMTLEDTNTSDHGFNGGHVDVVENFSTGDPMLCDTSAATNDGVYNYSLNSIPDAENDLSFFDNGDKEKNDLFYGWGDIGNFEDVDNMLRSCDSTFGLDSLNNEGDLGWFSSAQPNEETAGAMTDDLKPDKMLENQRTAMLQVEDFLNNSEPNHAVEDEYGYTIEDDSAQGKSSQNVFDTSLQKKDILMLDVEANLEKKQTDHLHHLDGKSDGFSENSFTLQHSGISREIMDTNQYYPPSAFQQRDVPYSHFNCEQPSVQVSACESKSGIKSENKPSPSSASNESYTSNHAQSIESLQGPTVDDRFRKVFETRANLLPGQDMPPSFAANTKKSSKTDSMVFPDAAPIQKIGLENDHRKAATELETSNMQGSSCVSSVVDDISLEATSFRQLQQVIEQLDVRTKLCIRDSLYRLAKSAEQRHHGGNRPEKGAGSHLVTGEADKYAGFMDIETDTNPIDRSIAHLLFHRPSDSSLSSDNNVLSYKSHPMIPQPNSSPSLRIEKQEETTELRPEAEVVTSDNN

SEQ ID NO: 2836 - protein, 176 aa, Synechococcus sp. RS9917
MKHTLSVLVEDESGALSRIAGLFARRGFNIDSLAVGPAESDGRSRLTMVVDGDDHTLQQMTQQLDKLVNVLQVLDLSQIPAVERELMLLKVAAPAEQRSAIFDLVQVFRAKVVDVADEALTLEVVGDPGKLVALERLMAPYGILEIARTGKVALERASGVNTELLKAAISGNRVPA

SEQ ID NO: 2837 - protein, 250 aa, Glycine max
MDRYQKVEKPRAETPIDENEIRITSQGRMRNYITYAMSLLQEKGSNEIVFKAMGRAINKTVTIVELIKRRIVGLHQNTAIGSTDITDTWEPLEEGLLPLETTRHVSMITVTLSKKELDTSSVGYQPPLPADQVKAATDFDYEGEGSPNGRAHGRGGRGRGRGRGNGFISADYEDGGWDRNRGNARGRGRGRGRGFRGRGRGGGYNGPHVDMQDGGYNQDVPQGRGRGRGRGGYRGRGRGFRSNGPIQAAA

SEQ ID NO: 2838 - protein, 619 aa, Aquifex aeolicus VF5
MIVDVKEFLQTHYPFSSLPPSSLENLSKVIKVKYYPKGSEIFKKDEKPLEYLYVIRKGNVSLRSDGVEIDFLSEGDSFGFISLITDSPPSSTAVAETDVILYLIPKEVFKQLMEKYPEFRNYFTTSLAKRIAHTAERVKENGGAKTFEKFLTVQVKDLKLRKVPFILPSESVYEAVKKMVEDNSSCAIVKSEDEEGIITERDVLKKVIYRDLNPKEVKVKEVMTSPLISVEPTDFLFDVLLTMSKNNIRRVVVKEDGNILGVLEDKDIIALETQNLIVIVKEVEKAKSVEELSYLYSLVDDMAVNLFNEGVKPEVISRLISEINDKFISKAIQLAIKELGLEPIVSFSFMVLGSEGRKEQTLKTDQDNALIYDDTYPSLDVDLEDYFKKFGEKISEILLKIGFPPCPSNVMVRNPEWNKGKTEWLKTLEKWFSKPDPENTLKLGIFLDFRNVFGDKTLEEELRKKVFELAKENELLIAYMFKDTVRFKPPLGLFGRLKVEKEGIDIKKGGIFPITSGIRTLAIKNEIAETNTLDRMKKLYEKGVLYKELYENLKEAFNYLQYIRLKSQIEKLKEGKQPDNYVNPERLSKLELDLLKDAFKVVAQFQEFIETKYLTYIPS

SEQ ID NO: 2839 - protein, 399 aa, Haemophilus influenzae R2846
MAFDYQTFRQAFPYFQREDAVIYLDNAATALKPQVLINRTAEFYTSAGSVHRSQYDAAQTAQYEQARTQVKEWVNAEDKRTVIWTSGTTHAINLVANGLMPQLNAEDEILISQADHHANFVTWHETAKKCGAKIRVLPILDNWLIDENALISTLSEKTKLVALNFVSNVTGTEQPIKRLIQLIRKHSHALVLVDAAQAISHIKIDLQDLDADFLAFSAHKIYGPNGLGVLTGKLTALSQLQPLFFGGKMVDRVSNERITFAELPYRLEAGTPNIAGVIGFNAILNWLQKWDFTAAEQHAISLAESVKVRLKSYENCRLFDSPQPSTVVCFIFDGIDCSDLSTLLSEQNIALRVGEHCAQPYLARLGERTTLRLSFAPYNTQEDVEAFFTALDKALDLLQ

SEQ ID NO: 2840 - protein, 364 aa, Zea mays
PRVRFLCVAIGLWAGLAIGFTTEYFTSNAYSPVRDVADSCRTGAATNVIFGLALGYKSVIVPVFAIAVSIYVGFTLASIYGIAVAALGMLSTVATGLAIDAYGPISDNAGGIAEMAGMSRRIRQRTDALDAAGNTTAAIGKGFAIGSAALVSLALFGAFVSRAGVEDVNVLNPKVFVGLLVGAMLPYWFSAMTMKSVGSAALKMVEEVRRQFITIPGLMEGRAAPDYARCVRISTDASLKEMMPPGALVLLAPLVAGTFFGVSTLAGLLAGALVSGVQIAISASNSGGAWDNAKKYIEAGASDHAKSLGPKGSDAHKAAVIGDTIGDPLKDTSGPSLNILIKLMAVESLVFAPFFAAHGGLIFK

SEQ ID NO: 2841 - protein, 489 aa, Synechococcus sp. RS9917
MAGRFSQQHQRVRPSSKEDQVVQKAREHFERTLVPVAGSLAGSVAALEHPSLDGALNYGEIFLRDNVPVMVYLLTQRRFDVVRQFLSVCLDLQSTTYQTRGVFPTSFVEENQELIADYGQRSIGRITSVDASLWWPVLCWLYVKHSGDHAFGSSQKVQRGIQLLLDLVLHPTFEGTPVLFVPDCAFMIDRPMDVWGAPLEVEVLLFGSLRSCIQLMELSRSQHNSRLLDQRLVLTRQWVHDLRRFLLKHYWVTSKTMQVLRRRPTEQYGENQHQNEFNVQPQVIPDWLQDWLENRGGYLIGNMRTGRPDFRFYSLGNSLGCLFGLLTSPQQRALFRLVLHNRDHLMAQMPMRICHPPMDGLEWQNKTGSDPKNWPWSYHNGGHWPSLLWFFGASILLHERRNPHADVLLMGQMKALLEESYWSHLNQLPRQQWAEYFDGPTGTWVGQQSRTYQTWTIVGFLLLHHFLRVNPDDVELLDLDELQPSTAQP

SEQ ID NO: 2842 - protein, 362 aa, Gloeobacter violaceus PCC 7421
MTAILPRSGANWPGLIEHYREYLPVDERTPVVTLREGNTPLIPLESIGRRLGRGLRVWAKFDGLNPTGSFKDRGMTIAVSKAKEAGAQAVLCASTGNTSAAAAAYAARAGLRAYVLIPEGYVALGKLAQALVYGAEVIAIRGNFDQALAIVRTIAEHYPITLVNSVNPFRLQGQKTAAFEVCDQLGTAPDWLCIPVGNAGNITAYWMGFCEYAQRGRIAGRPILQGFEASGAAALVGGKVEPVAHPETVATAIRIGNPASGVRALAAVRASAGAIRVVSDPEILEAYRILACEEGIFCEPASAAAVAGLLKYGHEAPAGGQVVCVLTGNGLKDPDRAIAVSAVEIAPGADPTASAVAKAMGF

SEQ ID NO: 2843 - protein, 401 aa, Vitis vinifera
  misc_feature (167)..(167): Xaa can be any naturally occurring amino acid
  misc_feature (224)..(224): Xaa can be any naturally occurring amino acid
MDRYFAPGTNHLFVPGPVNIPDHVIRAMNRNNEDYRAPPIPALTKDLLEDVKKIFKTTTGTPFLIPTTGTGAWESALTNTLSPGDRTVSFLIGQFSLLWIDQQKRLRFNVDVIESEWGQGANLEILAEKIAADRAHTIKAVCIVHNETATGVTNNLAAVRRILDEYXHPALFLVDGVSSICALDFRMDEWGVDVALTGSQKALSLPTGMGIVCAGPKALEASKXAQSVRFFFDWNDYLKFYKLGTFWPYTPSIQLLYGMRAALDIIFEEGLDNVIERHSRLGKATRLAVEAWGLKNCTQREEWFSDTVTAVVVPPYIDSTEIVKRAWKRYNLSLGLGLNKVAGKVFRIGHLGHLNDVQLLGCLAGVEMVLKDVGYPVKMGSGVGAASAYLQNTIPLIPSRI

SEQ ID NO: 2844 - protein, 186 aa, Rhodomonas salina
TFPKNQVQREISVMKLMYHPHVIKIFDVLEDSKYLFLIIEYACRGELFNFLVEKNRIQNKEALRFFQQIISGLEYCHKHRICHRDLKLENILLDANHNIKIADFGMASLSVPNAMLKTFCGSPHYASPEVVSNEPYNGIKADIWSCGVILYALLIGKLPFDEENDNIRRLFNKIRFEPARIPKTIP

SEQ ID NO: 2845 - protein, 349 aa, Bacillus anthracis str. Ames
MLTQEQIMNALKHVEDPELHKSIVELNMVRNIQMNGTEVKLEVVLTIQGCPLKAKIQQDIEESLYAIGASKVDLTFGSMTKEERADLTEKLKKNTRTETGMPNMLRPDSGVQFLTVTSGKGGVGKSTVTINLATALARMGKKVGILDADIYGFSIPAMMETNQKPTMIDQTAIPVVSHGVKIMSMGFFTEGNNPVMWRGPMLNKWIQNFLANTHWGELDYLLLDLPPGTGDVAIDVAAMIPQAKEIIVTTPHNVASFVASRVGVMAKHTKHEILGIVENMAYFEEQDGSKNYLFGKGGGEMLAEQLQTEVIAQVPFAKREENNGSSVYDEDSLVGEVFTSLAEDIIYKG

SEQ ID NO: 2846 - protein, 113 aa, Tissierella praeacuta
EAVICVPFICLSEIKKAIENTDIKLGAQNMHWEEKGAFTGEISPKMLKELDIDYVIIGHSERRQYFNETDTTVNKKIKAAISCGIKPIVCVGETLEEREANIQNEIVKKQILK

SEQ ID NO: 2847 - protein, 388 aa, Vibrio cholerae
MKIAVAGTGYVGLSNAILLAQHHQVIAVDIIAEKVAMLNNKQSPIVDQEIEYFLAHKTLDFQATLDKQSAYRDADFVIIATPTDYDPQTNYFNTTSVESVIKEVMAINPQAVMVIKSTVPVGYTVRIKNQLGCDNILFSPEFLREGKALHDNLHPSRIIVGERSERAKVFANLLVEGAVKKNIPVLFTDSTEAEAVKLFSNTYLAMRVAYFNELDSYAEAHGLDARQIIEGVGLDPRIGNHYNNPSFGYGGYCLPKDTKQLLANYSSVPNSIIGAIVEANRTRKDFVADSIIKRQPKVVGIYRLIMKAGSDNFRASSIQGIMKRIKAKGIEVVVYEPVLNEPEFFHSRVIKDLNEFKQTADVIVSNRMVEELADVADKVYTRDLFGSD

SEQ ID NO: 2848 - protein, 113 aa, Tissierella praeacuta
EAVLCVPFTIIQDVKKAVENTNIKLGAQNMHWEENGAFTGEISPKMLKELGVDYVIIGHSERRQYFNETDITVNKKIKAAISHDIKPIVCVGETLEEREANIEKDVVKSQILK

SEQ ID NO: 2849 - protein, 334 aa, Vibrio cholerae
MKYLVTGAAGFIGSATVKKLTEQGHHVVGIDNINDYYDVNLKHSRLARIEHPLFHFLKVDIADRAAMAQLFEQEKFERVIHLAAQAGVRYSLENPHAYADSNLVGHLNILEGCRQNKVGHLVYASSSSVYGLNAKVPFATSDSVDHPVSLYAATKKSNELMAHSYSHLYDIPTTGLRFFTVYGSWGRPDMAPFIFTKKILAGEAIDINNHGDMWRDFTHVDDIVEGVVRIADVLPTRNAAWTVESGTPATSSAPYAIYNIGHGSPINLMEFVKAIEEQLGIEANKNFRCMQPGDVYQTYADTADLFAATGYKPKVGVREGVSEFIAWYRDFYNQ

SEQ ID NO: 2850 - protein, 653 aa, Zea mays
MAAHLPRLPVLLLVLLAAHVVSTSTRAEPLLPSTYNVSMCSESFWCGGVEIRYPFYLANATADYSGSYYSCGYTDLSVSCELEVEGPPTTWTPTIRLGGDNYTVKNILYDYHTISLADSDVLGGGECPVVRHNVSFDETWLHNASAFNNLTFFFGCHWGPRDTLPEFAGYNISCDGFSTPTISGGGSFVFKTEDLDEQEEQDFASHCDEVFSVPVGSEALRATDTFSLSRYGYGELLRQGFELEWNRTSEDQCGQCEGSSSGSGSGSGGRCAYNQKREFLGCLCSGGKAGNPFCKPSMSPVCEYRAAPACLLLTPNGAVVAVAFLCLVILTCFLACRHGSLPFKSKNKPGTRIESFLQKNESSIHPKRYTYADVKRMTKSFAVKLGQGGFGAVYKGSLHGRQVAVKMLKDTQGDGEEFMNEVASISRTSHVNVVTLLGFCLQGSKRALIYEYMPNGSLERYAFTGDMNSENLLSWERLFDIAIGTARGLEYLHRGCNTRIVHFDIKPHNILLDQDFCPKISDFGLAKLCLNKESAISIVGARGTIGYIAPEVYSKQFGTISSKSDVYSYGMMVLEMVGARDRNTSADSDHSSQYFPQWLYEHLDDYCVGASEINGETTELVRKMIVVGLWCIQVIPTDRPTMTRVVEMLEGST

SEQ ID NO: 2851 - protein, 485 aa, Zea mays
MAGGSSAEQLLSRIASGDGHGENSSYFDGWKAYDMDPFDLRHNRDGVIQMGLAENQLSLDLIEQWSMEHPEASICTAQGASQFRRIANFQDYHGLPEFREAMAKFMGQVRAGKVTFDPDRVVMCGGATGAQDTLAFCLADPGDAYLVPTPYYPAFDRDCCWRSGVKLLPIECHSSNNFTLTREALVSAYDGARRQGVRVKGVLITNPSNPLGTTMDRATLAMLARFATEHRVHLICDEIYAGSVFAKPDFVSIAEVIERDVPGCNRDLIHIAYSLSKDFGLPGFRVGIVYSYNDDVVACARKMSSFGLVSSQTQHFLAKMLSDAEFMARFLAESARRLAARHDRFVAGLREVGIACLPGNAGLFSWMDLRGMLRDKTHDAELELWRVIVHKVKLNVSPGTSFHCNEPGWFRVCHANMDDETMEVALDRIRRFVRQHQHKAKAERWAATRPMRLSLPRRGGATASHLPISSPMALLSPQSPMVHAS

SEQ ID NO: 2852 - protein, 441 aa, Arabidopsis thaliana
KLSSRKQVVSVFVSNSSNMQKEIAGDAPSAPTTRVRHRKRNSDVGAGAGKPNGNHLLVNDSKKYKSFLIRAYSTFWMIGGFALIVYLGHLYITAMVVVIQIFMARELFNLLRKTHEDKQLPGFRLLNWHFFFTAMLFVYGRILSQRLVNTVTPDKVLYRLVTSLIKYHMAICYSLYISGFVWFILTLKKKMYKYQFSQYAWTHMILIVVFTQSSFTVANIFEGIFWFLLPASLIVINDIFAYICGFFFGRTPLIKLSPKKTWEGFIGASITTVISAFLLANIMGRFLWLTCPREDLSTGWLLCDPGPLFKQETHALPGWISDWLPWKEISILPVQWHALCLGLFASIIAPFGGFFASGFKRAFKIKDFGDSIPGHGGITDRMDCQMVMAVFAYIYHQSFVVPEVLSVDKLLDQIITSLTLEEQQALLVKLGQMLQEKVIGS

SEQ ID NO: 2853 - protein, 853 aa, Arabidopsis thaliana
MNDADASIQIQQMVRFIRQEAEEKANEISISSEEEFNIEKLQLVEAEKKKIRQEYEKKEKQVDVRKKIDYSMQLNASRIKVLQAQDDIVNAMKEEAAKQLLKVSQHGFFNHHHHQYKHLLKDLIVQCLLRLKEPAVLLRCREEDLDIVESMLDDASEEYCKKAKVHAPEIIVDKDIFLPPAPSDDDPHALSCAGGVVLASRDGKIVCENTLDARLEVAFRNKLPEFCSKGSFLEMCVDPKVALRQELRDAKSMNPTGRRCPDPNGVEKKSMCYSSCKTQGFMGGSCQGHKESYLKQKRQRLLTWSSRRDDTVLKNIEIIVFVCPLAPSTSPSFSQYKYLHPLSLITPTTSFFSLYLTNPKLISLSPMESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 2854 - protein, 486 aa, Zea mays
MAGSSAEQLLSRIAAGDGHGENSSYFDGWKAYDMNPFDLRHNRDGVIQMGLAENQLSLDLIEQWSVDHPEASICTAQGAPQFRRIANFQDYHGLPEFREAMAKFMGQVRGGKVTFDPDRVVMCGGATGAQDTLAFCLADPGDAYLVPTPYYPAFDRDCCWRSGVKLLPIECHSSNNFTLTREALVSAYDGARRQGVRVRGILITNPSNPLGTTMDRGTLAMLAAFATERRVHLICDEIYAGSVFAKPGFVSIAEVIERGDAPGCNRDLVHIAYSLSKDFGLPGFRVGIVYSYNDDVVACARKMSSFGLVSSQTQHFLAMMLADAEFMARFLAESARRLAARHDRFVAGLREVGIACLPGNAGLFSWMDLRGMLREKTHDAELELWRVIVHRVKLNVSPGTSFHCNEPGWFRVCYANMDDDTMEVALDRIRRFVRQHQHSKAKAERWAATRPLRLSLPRRGATTASHLAISSPLALLSPQSPMVHAS

SEQ ID NO: 2855 - protein, 498 aa, Hordeum vulgare subsp. vulgare
MRTNPTTSRPGVSTSEEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVALAETIRGFQLILSGELDGLPEQAFYLVGNIDEASTKAITLEEENKSQK

SEQ ID NO: 2856 - protein, 334 aa, Candida glabrata CBS 138
MSTEVISTSVVSEPTQEILPAEYSLDAPEPEHCPGPESEMAGKADACQTCENKDICESLPKGPDPDIPLITENLSGIKHKILVLSGKGGVGKSTFTTMLSWALSADDNLQVGAMDLDICGPSLPHMLGCTDEVVHESNTGWTPVYVAENLAAMSIQFMLPEDDSAVIWRGNKKNLLIKKFLKDVVWDDLDYLVVDTPPGTSDEHISINKYMKESGIDGALVVTTPQEVALLDVRKEIDFCRKAGINILGLVENMSGFVCPNCKGESQIFKPTTGGGEALCKELGIKFLGSVPLDPRIGRCSDEGESFLDEFPDSPATLAVLNVVEELRDAVGDV

SEQ ID NO: 2857 - protein, 464 aa, Aspergillus oryzae
MKSPIPDYLRQVLEKARPDDSGQLANYIDVLAKADPSKMAIALSTVDGNLYSAGDDEVEFSIQSISKAFVYAIAIEDAGLPRVLEKIGVEPSGDAFNKLSLQPGTNRPMNPMINAGAIAAHTLVAGESASAEERVDHILKVLSKLAGRQLKVDEEVYEAELKDANRNMAIGYMLKAAGIISCDPQDAVRGYIRQGSITTNVRDLAMMAATLANAGVNPITGEEIMPHQSARQVLSVMTTCGMYDAAGDWVSRVGMPAKSGVAGGIIGALPGQVGIAVFSPKLDERGNSFRGVKMFEQLSSEMGLHMMDISQVGRATVRTWTLTIAGGAKQPDEREQEVPVFGLRGAVRFAGSERLTRAIVRELTPPNPDDPGSGRHADASAVIFSLKDTYSLNYVALRIISEDMRRLLAADKNVVVIDPVKVLKIDGNPAFKEKSPCVVNDEAEARRYIGGQGCRAVSHSDEFY

SEQ ID NO: 2858 - protein, 310 aa, Rhodospirillum rubrum ATCC 11170
MKILACNSNRPLAEAIATYLNLELTHASVRRFSDMEVWVEILENVRGEDVFVVQSTSYPANDHLMETLVTLDALKRGSARRVTAVIPYFGYARQDRKTGPRTPITAKLVANLITSAGANRVVTLDLHSGQIQGFFDIPLDNLYAAPVFSKHIIENFKGTRPMIISPDVGGVVRARELARRIEADLAIIDKRRERAGVSEVMNIIGDVRGRDCILVDDIVDSAGTLCNAAVALKNAGATSVAAYVTHGVLSGGAVARVTSSPLDSLCITDSIQATEAMRLARNVHQISIAPLMAEAMRRISQEASVSSLFN

SEQ ID NO: 2859 - protein, 460 aa, Bradyrhizobium sp. BTAi1
MSTAEIHYLPQARAPLVPPMPPRAPDSMGAFRRVLLMGENAIATWSQRAYEDEIVRGRFFGSSSYILNTPDTIKHVLVDNWENYVRTDGAIRVLRPVLGEGLLIAEGRAWKHQRRTLAPAFTPRAVAGLIPHMIAVTDDTVTRLKQQCDAPVDLREIMQRMTLDIAGRTMFSFEMGRHGATLRDFVFEYGARLASPHLLDIVLPLSWPTPRDIARRRFRKRWTAFVTLLMAERRAAGKLDDAPPRDLFDLMGAARDPETGAAFTDAQLADEVATMILAGHETTATALFWALYLIALDPASQSKLAQEAGAASDLGDPDRLPFTRAVIDETLRLYPPAFLIARAASGPDRLADFPVKRGDVVLISPWLLHRHEKLWRAPNAFMPERFLPGAAPPERFAYLPFGAGARVCIGAHFALVEAVLALARLVGAFKIELIDRAPVMPIGVVTTQPDRSPLFRITPR

SEQ ID NO: 2860 - protein, 364 aa, Hypocrea jecorina
MKGLILVGGFGTRLRPLTLTLPKPLVEFCNKPMIVHQIEALVAAGVTDIVLAVNYRPEIMEKFLAEYEEKYNINIEFSVESEPLDTAGPLKLAERILGKDDSPFFVLNSDVICDYPFKELLEFHKAHGDEGTIVVTKVEEPSKYGVVVHKPNHPSRIDRFVEKPVEFVGNRINAGMYIFNPSVLKRIELRPTSIEKETFPAMVADNQLHSFDLEGFWMDVGQPKDFLSGTCLYLSSLTKKGSKELTPPTEPYVHGGNVMIHPSAKIGKNCRIGPNVTIGPDVVVGDGVRLQRCVLLKGSKVKDHAWVKSTIVGWNSTVGRWARLENVTVLGDDVTIGDEIYVNGGSVLPHKSIKANVDVPAIIM

SEQ ID NO: 2861 - protein, 660 aa, Physcomitrella patens subsp. patens
MAAEVVWREDGNIRSRFFRGNEHGPTKKCIFNQLPESVIELIFDRLGSKGDRRAISQVCKQWHRVDGLTRKNIYIFNCYSIAPSNLSKRFPNLEKIKIKGKPRAYEFGLLVESWGAHAGPWIEEIASVYPNLEGLALRRMDITDKDLMLLASRCPNLRKLKLHKCSGFSTRGLEFITRSCRTLRVLDIDESHDMEDTGGPWLQLLEKGDGKLESLNIASAGLEEESIKEVLLKLAPSLKCISSLRVSDMELGSFFKILDNSEVPVVELGLGCYSLSQEDPKELVPSFSSRLSKLKILDLKFTTLNAEIQIELLRHCCSVEELELRSVVGDWGMQVISENCKQLKKIRVDQDTSPYMTNHVTQKGMISICEGCRELDFLVMYLTDVNNAALAAVGQYLPKLSDFRIVLLEDQDDVEDLPLDDGIRLLLQGCPMLSRFSVYLRPGGLSNKGLGYIGEFGSKLKWVLLGSSGESDEGFRLMAEGCRQLERLELRNCPFSDKQLAISILNNLPHLKYLWVQGFGATSGLGVALVTQMPGFVVEVMATDQQILGYYTVTHPRTDSPDSVCVINYDPLLDNSAEVCEEGSQGDACSYYAERLYSEHIYSYLRVDEEAPYPGVNKNSHLPKIDENTLYSGVVGLEMYLAGDDNSASSEFCEDSACIC

SEQ ID NO: 2862 - protein, 258 aa, Brassica napus
  misc_feature (98)..(98): Xaa can be any naturally occurring amino acid
  misc_feature (245)..(245): Xaa can be any naturally occurring amino acid
RASPKTLPHTFKPFVCRLQSPQKMSNHKDNFSLADLTSDEDRAGLVNALKNKLAGHSSDVLENLTPQVRARVDALKDIQSQHDELEAKFREERAVLEXAKYEKLYQPLYAKRYEIVNGTTEIELTPEDTKMDEGDDKTAEEKGVPSFWLTALQNNEVTSEEVTEHDEEALEYLKDIKWCKTEEPKGFKLEFLFDSNPFFKNNVLTKSYHVIDEDEPLIEKAIGTEIDWYPGKCLTQRIVKKKPKXGSTNTKPVTKMED

SEQ ID NO: 2863 - protein, 621 aa, Oryza sativa
  misc_feature (520)..(520): Xaa can be any naturally occurring amino acid
MWRHAARRSSAQIRRSGVMSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQFEDFQMKWAFETLQRYRNRFCMFNDDVQGTAGVALAGLLGAVRAQGRPLSDFTKQKIVVVGAGSAGIGVLNMAKQAMLRMPGINRSGEGHNQFWVLDKDGLITKSRKGLDPAVARYARGFGPEEVQDLHEGASLVEVVRKVKPHVLLGLSGVGGIFNEEVLKAMKESDSPRPAIFAMSNPTTKAECTPEDVFKYVGDNAVFASGSPFSNVTLGNGRQGYANQANNMYLFPGIGLGAXLLSGARHITDGMLQSAAECLASYITDDEIRKGILFPSISSIRHITARVGAAVVRAAVDEDLAEGRCDVDARDLKSMTEADTVDFVARKMWYPIYSPLVNDK

SEQ ID NO: 2864 - protein, 388 aa, Mannheimia succiniciproducens MBEL55E
MNLHEYQAKQIFAQYGLPVSEGCACQSLEEAIQAVKKLGGGQWVAKCQVHAGGRGKAGGVKLVKSEEEVRSFFEKFLGQRLVTFQTDAKGQPVNAIYMEACANVKKELYLGAVLDRSSQRIVFMVSTEGGVNIEEVAEKTPHLLHKMPIDPLVGAMPYQGRELAFKLGLQGKQIQQFAQIFCQLGKMFVEKDLSLLEINPLVILDNDQLHCLDAKIVVDGNALYRQPELNAMRDPSQEDAREAAAEQWHLNYVALEGNIGCMVNGAGLAMGTMDIVKLHGGQPANFLDVGGGTTKERVAEAFKIILSDQSVKAILVNIFGGIVRCDLIAEGIVAAVNEVGVSVPVVVRLEGNNAPLGREILAQSGLNIIAATSLTDAAVQVVNAAEGK

SEQ ID NO: 2865 - protein, 297 aa, Aquifex aeolicus VF5
MKDFSFLLILVSLSLLGILFPEFFANLKPLILPLLIVIMLSMGLTLTPEDFKEIARKPFIVFYGALLQYTVMPLSGYLLSKLFKLPPELLVGVVLVGSAPGGTASNLITYLSRGDLSYSISMTTTSTLLSPLFTPLWTYVLAGKYVEVPFLSMFETTLKIVIVPVLLGMVLRYFLRYQINKVEKFLPFLAVFSISLIIAVIFALNSKLLKELSFLVLSVVLIHNVLGFLLGYLFGLLAGLDKRKVKALSIEVGMQNSGLSTVLALKYFSKVSALPSAIFSLSQNLIGVVLSLFFRRL

SEQ ID NO: 2866 - protein, 410 aa, Porphyra yezoensis
MAFVGSTVTGVAGARAPTSKICSSRASFAQFSGMRSVNGARMLQPVQGADANDAFFAAVSTAAVPSASTAPTMKLKVAISGFGRIGRNFLRAWAAKSDTPLEVVCINDTSGVKTACHLLKYDSILGTFAGTVEAGEDSITINGKKVRVVSNRDPLQLPWAEMGVDIVIESTGVFVDKKGASKHLTAGAKKVLITAPGKGEGIQTYVVGVNDQDYTHATDDIVSNASCTTMCMAPFVKVLEDEFGIVKGTMTTTHSYTGDQRLLDAGHRDLRRARSAALNIVPTTTGAAQAVALVIPSMKGKLNGYALRVPTPNVSVCDVVVEVKRPTFKEEVNGAFLKAAQGPMKGILKYSDEPLVSSDFKGMVESTAVDVSMTTVVGDTMVKVLAWYDNEWSYSLRVLDLAEIMANKWE

SEQ ID NO: 2867 - protein, 402 aa, Mannheimia succiniciproducens MBEL55E
MSNFDIITPDLPESVADATVVKWHKAVGDKVRRDEVLVEIETDKVVLEVPALNDGIIESIIEPEGATVVSKQLLGKAALLPVGEVTVRAETPTVAPQIEDSAVASSADTLGPAARRLIAEHDLNVNEIKGSGVSGRITREDVEAVIAQKAASVAAKSAVENTVISSPAAVRTEKRVPMTRLRKRVAERLLEVKNSTAMLTTFNEVDMQPIMQLRKKYAEKFEKQHDTRLGFMSFYVKAVVEALKRYPVINASIDGDDIVYHNYFDISIAVSTPRGLVTPVIRNCDKLSMAEIERQIKALAEKGRDGKLTVDDLTGGNFTITNGGVFGSLMSTPIINPPQAAILGMHAIKDRPVAIDGQVAIRPMMYLALSYDHRLIDGKDSVGFLVTVKELLEDPTRLLLEI

SEQ ID NO: 2868 - protein, 336 aa, Porphyra yezoensis
MVVKIGINGGGRIGRLVLRAALEKGGVEVVAINDPFIALDYMAYMFKYDSTHGPYKGKVEVVDGKLVIDGFTITMFGMRDPAEIPWKDVGAEYIVESTGVFTTTDKAKAHLVGGAKKVVISAPSADAPMFVCGVNEKKYTPDLSIVSNASCTTNCLAPLAKVLHEKYGILEGLMTTVHATTATQKTVDGPSHKDWRGGRGAGANVIPSSTGAAKAVGKVIPELNGKLTGMAFRVPTPDVSVVDLTVRLQKPTTYDDIKATMKAASEDDLAGILGYTEDAVVSTDFVHDNRSSIFDASAGIMLNETFVKLVAWYDNEWGYSNRVVDLITHMSKVDSA

SEQ ID NO: 2869 - protein, 58 aa, Glycine max
MKFFSAFDPWPVFFRREWGRTWPFLAGFAVTGALITKMTAGFTEEDLKNSKFVQAHKK

SEQ ID NO: 2870 - protein, 180 aa, Rhodomonas salina
GAYTGECSADQIVDIGCKWVILGHSERRQYFKEDNEILRTKLEYALSKGLKVMYCIGESLDERNANKTIEVLKSQIEPVKDLMKPESVVIAYEPIWAIGTGVTATPQQAQDTHKELRAYISEACGAATAEAIRIQYGGSANAKNAPELSACPDIDGFLVGGASLKPEFGDIIKAIAAAKK

SEQ ID NO: 2871 - protein, 386 aa, Triticum aestivum
  misc_feature (312)..(312): Xaa can be any naturally occurring amino acid
MDYMNGPGRNHLFVPGPVNIPDQVIRAMSRQNEDYRSPAIPALTKTLLEDVKKIFKTTTGTPFLFPTTGTGAWESALTNTLSPGDRIVSFSLGQFSLLVDGVSSICALDFRMDEWGVDVALTGSQKALSLPTGLGIVCASPKALEAAKTAKSVRVFFDWKDYLKFYKMGTYWPYTPSIQLLYGLRAGLDLLFEEGLDNVIKRHTRLGTATRLAVAAWGLKNCTAKEENFSDTVTAVVVPPYIDSSEIVKHAWKRYNLSLGLGLNKVAGKVFRIGHLGHLNELQLLGCLGGVEMVLKDIGYPVKLGSGVAAAXAAYLSNSTPLIPSQDLSKTHARRQGGREKKKKKNKHRTVPCSGSRACRRSTLLVLVILSVCKVNFHTPICAKGV

SEQ ID NO: 2872 - protein, 272 aa, Vitis vinifera
MYEKVCVPQSCQHTNTFGGMSIPQASPFGEALSGAGSHLLKTELGACGERILGSGSAYMQTNIGRYFSNPHYYFQVNDEYVKNKLKVILFPFLHRGHWMRTNEASGGEFSFKPPIYDINAPDLYIPLMAFGTNLVLAGFFLGINGKFSPEALGMQFSDGLLGWFLEVLLLEATLHSLGGGDVPILDVVAYGGYTFTPLSVVLLAKIVSSYCFYAVTLWGCFCTGVFLVKTIKRILIAEVTSYEKNSSKRNYLLLLVAMTQLPLLFWLGNIRV

SEQ ID NO: 2873 - protein, 91 aa, Glycine max
FSHQYLRTVQNTLKKVRRAIIPAAGLGTRFLPATKAMPKEMLPIVDKPTIQYIIEEAVESGIEDIIIVTGKGKRAIEDHFDFAPELERNLE

SEQ ID NO: 2874 - protein, 238 aa, Brassica napus
  misc_feature (137)..(137): Xaa can be any naturally occurring amino acid
  misc_feature (226)..(226): Xaa can be any naturally occurring amino acid
MASLALSGSCSLAFPLKSRPLLLPRPPSSLNLLKKPLRSTESRFSSVKSPLHIALTKRSTLVKASSSASSPAPVAPAPWQGAAIKPLLASIATGVIIWFLPVPEGVTRSAWQLLAIFLATIVGIITQPLPLGAVALXGLGASVLTKTLTFAAAFSAFGDPIPWLIALAFFFARGFIKNGLGNRVAYQFVRLFGSSSLGLGYSLVFSEALWAPAIPSVSARAGGIFXPWVKSLCVGCGS

SEQ ID NO: 2875 - protein, 154 aa, Beta vulgaris
MESNGKGVSIDGVVLPFEAGEIDFGEPGTNGQHSFYQLIHQGRVIPCDFIGIAKSQQPVYLKGEVVSNHDELMSNFFAQPDALAYGKTQEELQKENVSPDLVPHKTFSGNRPSISLLLPSLTAYNVGQLLAIYEHRIAVEGFIWGINSFDQWGV

SEQ ID NO: 2876 - protein, 137 aa, Boehmeria nivea
FVDGDINDAPLLSKLFDVVPFTHILHLAAQAGVRYAMQNPQSYIRSNIAGLVNLLEVAKAANPQPAIVWASSSSVYGLNKENPFSELHRTDQPASLYAATKKAGEEIAHTYNHIYGLSLTGLRFFTVYGPWGRPDMA

SEQ ID NO: 2877 - protein, 116 aa, Zea mays
NILSAYVIYCFVSQDLALAGSGSIFETLRLGKPLIVVVNEDLMDNHQSELAEELAERKHLFCARPQTLGETIRAMDLETLVPYEPGDAKPVVTLINRFLGFQLIDESIRLFLIHVD

SEQ ID NO: 2878 - protein, 120 aa, Oryza sativa
CLAPFVVSQLRPEIQVAAQNCWAKKGGAFTGEVSAEMLVNLSIPWVILGHSERRSLLGESNEFVGDKVAYALSQGLKVIACVGETLEQRESGSTMDVVAAQTKAISERIKGLRSCTHPAA

SEQ ID NO: 2879 - protein, 395 aa, Physcomitrella patens subsp. patens
MANRYFPNTMPDYSLSLEGSEADYSVMDPDTLLEVAMSIKDEVIQATWIRKGRRVSDPILYTGVLGTAFLCFKAYQITGSKEDLTLCSEIVDSCTVAAKSLHKYVTFLCGQPGIYALGAAAAKSSGDEQSLHRYLQLFHKGGMGMPYELLYGRAGFLWAALFVNKHVGEGTIPSSTTGPIVDAILAGGRAGASQTQSPLMYQWHGSRYWGGAHGLAGIMHTLMHFPLNKKDEEDVKGTLRYMIARRFPSGNYPSSEGNATDRLVHWCHGAPGIAMTLCKASKVFPDEMEFQHAAVEAGDVVWSRGLLRKLGLCHGISGNTYVFLSLYQSTGGKQHLFRAQQFATFLHKNARTLIESGEMHGGDHPYSLFEGLAGTACLFFDLTKPEMARFPAYEL

SEQ ID NO: 2880 - protein, 127 aa, Zea mays
MAEGEETKVEGTREEERADAGAGAEEEEVEVKFRLFDGSDIGPIRCNAAATTVAALKDRVVADWPKDKTIVPKSANDVKLISGGKILENDKNIAQCRAPFGDLPSTVITMHVVVQPSSAKSKPDKKT

SEQ ID NO: 2881 - protein, 131 aa, Glycine max
MASKAALLLCFNVLFFTVVSSTYVPCNPPPKTPKHPPVPKPPSPKQASCPKDTIKFGVCADVLGLINVQLGKPPKTPCCNLIEGLADLEAAVCLCTALKANVLGINLNVPVNLSLLLNYCGKGVPKGFVCY

SEQ ID NO: 2882 - protein, 277 aa, Coxiella burnetii
MIKMEAFIYSEKMLTSVIEIIKFAAKKILSIYSEPTSLVVTKKGDGSPLTKADQLAHDFISAQLTNLTPKIPIISEELDFEIYSNTLLNSYFWLVDPLDGTKDFIKRNGEFTVNIALIKDAKVVLGVVFVPVTNTCYYANKVVGAFKQVGEQPPQQLQLTPQNKARDLNQPIKVAISRHHGLDGIQKFIDKIGPCECVSMGSSLKICSLAEGEVDIYPRLGPTKEWDTAAAQCVLEQAGGKILIETGKSLFYNKLDFLNPKFLALGSRGNPAWVTYL

SEQ ID NO: 2883 - protein, 229 aa, Listeria monocytogenes EGD-e
MTKQANLQKVTAQIEHACEESNRQSEDVTLVAVTKTIDVTGITELYDLGIRHFGENRADVFLEKTVELADKDDICWHYIGSLQTRKVKDVLPQIDYLHSLDRSSLAKEIEKRATKPVKCFLQVNISGEESKHGFSKEEALSFLQEANFTFIEIVGLMTMAPITNSDIELHHVFHELKQLQQEIHALQLKNIPCTELSMGMTNDYGIAITEGATFIRIGRALVNDDNMEV

SEQ ID NO: 2884 - protein, 856 aa, Aquifex aeolicus VF5
MSVDKSKALVLWLDEVTIEDIPIAGGKNASLGEMIRNLSPLGVKIPYGYVVTANAYYYFLDYNNLRDKIRKILEGLNTDDLKDLQRRGHEVRELIRGGTFPPDLEEAIKDYYNKLSEKYKTHAVDVAVRSSATAEDLPDASFAGQQETYLNVVGAENVLVAIKNCFASLFTDRAIVYRERFGFDHFKVGIAVGVQKMVRSDMGASGVMFTLDTETGFKDVVVINAAYGLGELLVRGEVTPDEYIVFKPTLMKGYSAIIEKKLGRKDRKMIYGTGDERVKIVNVPKEDQKKFALNDDEILQLAKWGVLIEEHYSKKNGRWTPMDIEWAKDGILNELFVVQARPETVHSRKKENVVKIYKIKTPEEERKNRVIVKGIAVGDKIATGKARVLFDLKEADQFQEGEILVTDITDPDWEPVMKKAAAIVTNRGGRTSHAAIVARELGIPAVVGTGNATEKIKTGEEITVSCAEGETGYVYEGKIDYEVEEINLENIPKPKTKIMMNIGNPESAFRYASLPNDGVGLAREEFIIANYIKIHPLALLHYEDLKELYEKLERENLIDEKGFVQFKLIYHYANGRLANKLAKGKDKLRVNLRKILQDIENLTFGYEDKATYYIKKLSYGIAKIAAAFYPNPVIVRFSDFKSNEYANLIGGILFEPEEENPMLGWRGASRYYSDVFKEAFGMECKAIIRVRNKMGLTNTKVMIPFCRTPEEGEKVLQVMEEYGLRKGENGLEVYVMAELPSNIVLADRYAQIFDGFSIGSNDLTQLTLGLDRDSELVAHLYDERNEAVKRLIAQLIKTAKEYGRKVGICGQAPSDFPEFAQFLVEQGIDSISLNPDSVLKTMLAVVEMEKKLGVLK

SEQ ID NO: 2885 - protein, 359 aa, Triticum aestivum
  misc_feature (41)..(41): Xaa can be any naturally occurring amino acid
  misc_feature (48)..(48): Xaa can be any naturally occurring amino acid
  misc_feature (72)..(72): Xaa can be any naturally occurring amino acid
  misc_feature (133)..(133): Xaa can be any naturally occurring amino acid
LAAISTAAVPTIFPQVKWYVLVCYLLGEVVSCACLLLTWSXPLPSSNXNGMGLTNLNLAPTYGKIALFIFAXLVGSSDGGVIAGLAACGIIMSIACSAADLMQDFKCGYLTLSSPRSMFISQLTGVVLGCVIXPLTLWLFWAAFDIGDPDGEYKAPFAIIFREMAILGVEGVAALPQHCLEICCAFFLAALAINLLRDVTPASASRFIPIPMAMAVPFYIGAFFGVDMLIGTVILFVWQKLNRRGADDYAVAVASGLICGDGIWSIPSAVLSILRIDPPVCMAFRPSSAFSRCASFYSCTKENEPQHFGAILLLTNCTKRRVTHIHCLPSVFRGFHVSLVIMPKVSLFICIFVLSFFCG

SEQ ID NO: 2886 - protein, 490 aa, Clostridium perfringens SM101
MDNKNFQSKTGFNLENTYLTLPNIFFSEQNPKGSKNPKLIKFNTSLAKELGLNEEILNSDFGLNIFAGNETFPGITPIAQAYAGHQFGHFTMLGDGRALLLGEHVTKDGKRYDVQLKGSGRTIYSRGGDGKAALAPMLREYIISEGMHSLGIPTTRSLAVVSTGEEVLREKFEQGAILTRIASSHIRVGTFAYAAQWGTLEDLKSLADYTIKRHFPNIANSENKYILFLEEVINRQAELIVKWQSVGFIHGVMNTDNMVISGETIDYGPCAFMDTYDTNTVFSSIDYAGRYAYGNQPNMALWNLARFSEALLPLLNPNLDEAVNIAKKSISSFSKLYKKYWFNKMRAKLGLFTKKENDELLIEGLLSTMQKYEADFTNTFVSLTLNKFEDEKVFSSNEFKTWYALWKDRLKEENRPKEEVRNLMMNNNPYIIPRNHLVEEALKNAEKGDFTFMDNLLEALKNPYSYSKDLEKYTKLPEKSDIPYVTYCGT

SEQ ID NO: 2887 - protein, 117 aa, Gloeobacter violaceus PCC 7421
MADCIRLREIVCYGYSGVYAEERRLGQRFIVDADLHIDLRTAGGSDRLEDSLDYGALVTAVRQIVEERQFSLLEALAEAIARRLRQDARVQQVRVVVAKPQPPIPGFTGSVAVEIWR

SEQ ID NO: 2888 - protein, 177 aa, Glycine max
MKESGRKQGTMSPCAACKLLRRRCTRDCVFAPYFPADEPQKFGSVHKVFGASNVNKMLQELPEHQRSDAVSSMVYEANARVRDPVYGCVGAISSLQQQVDVLQTQLALAQAEVVHMRMRQFSPPSEQQQPSVLPEASNSSSENLYHSSRLLSSQTKSLFGMDMVVDQANMGQSLWSY

SEQ ID NO: 2889 - protein, 368 aa, Treponema denticola ATCC 35405
MAINCGIVGLPNVGKSTIFSALTSAPAEAANYPFCTINPNVGIVSLPDARLKKLAEHFNPKKVIPATVEFVDIAGLVKGASKGEGLGNQFLSHIREVGVIAHVVRCFDNDDIVHVSGKIDPASDIETINIELALADLASLDKRAERAEKASRMGKEAQKEAAVVMRAIEKIRPLLQEGKGARLADLTDDERAAIYDTHLITMKPQMYVCNVDETGAQDSNPYIAAVKKIAESEGADTVVICGKFEAELADLESEEERLSFLAEVGLEESGLSQLARAAYHLIGLRTFFTAGEDECRAWTIHAGDTAPKAAGVIHTDFEKGFIKAEVYSFDDFVKYGSEQKIKEAGRYRQEGKAYVVNDGDIMFFKFNV

SEQ ID NO: 2890 - protein, 122 aa, Vibrio fischeri ES114
MSITNEQILDAVAEMSVMQVVELIEAMEEKFGVTAAAAVVAGGAAGGDAAEEQSEFDVILTSAGANKVAVIKAVRGATGLGLKEAKGLVDSAPAPLKEGVDKAEAEALKAQLEEAGASVEVK

SEQ ID NO: 2891 - protein, 140 aa, Oryza sativa
  misc_feature (119)..(119): Xaa can be any naturally occurring amino acid
MDTTIGSVPTASDAAAPAPAANSAPREVGARDVFTVPGDFNLTLLDELEAEAGAGHGGVRLVGCCNELNAAYAANGYARARGGGVGACAVTFTVGGLSAINAVAGAFSENLPVVCIVGXPNSNDYGSNRILHHTIGLPDF

SEQ ID NO: 2892 - protein, 351 aa, Streptococcus agalactiae 2603V/R
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 2893 - protein, 532 aa, Oryza sativa Japonica Group
MADEATTTPLLASYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHACATEREDDAAGGAGGGGGGVFATLRSMWERRWALRRLAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 2894 - protein, 227 aa, Physcomitrella patens subsp. patens
MDSTEALGRCMTAILRHRASDYGLEMQNDGFVLVADLLKLSKNTAAGIPLSSHSVEDVRKAVARDGKRRFGLKEEDGHLYIRANQGHSIRTVESGQLLSLVTSPSQIPVCVHGTYERFMDSIWQEGLKRMNRNHVHFATGLPEQDGVISGMRGSAQVLIYLDVEKAMEDGMKLYVSDNKVVLTEGFDGVVPTKYFKNVVKKLPRGREMPLHPSSNQPKPHENTAADV

SEQ ID NO: 2895 - protein, 494 aa, Euglena gracilis
MTTPSLSSILRHTRPIFKETLRAARPTLQNALPNGFRIASESKDGDTCTVGVWIDAGSRWETEKNNGVAHFLEHMNFKGTGKRSRQDIEFGMEKMGAHLNAYTSREHTCYYVKCFKKDVPEAVDILADILLNSKRTEQDLDAERQTIVQEKEDVEARIDEVLMDHLHSAAFEGSGLGLSILGPLENIQKSITKGMIDDFVKTHYTGPRMALVGSGAVDHGQLCDLASKYFGALPTGQPKPSGFTRFLGGDKRETNQLNPLTHVAVAFQTPGISHPDAIKIKVLEQLLGSYSRDKGEAAYSCFARAIVMDFYDPKVGQFFRPNKAGHNPIHSLNAFWAPYSDVGLLGFYAIAEPGKSYGHEWENILHYAMRELIRVSRNISEEEFERAKNQLKLQTMLQLDGTTNIADDIGRQVLSFGARVPLASFFEQLDAISREDLIRVGPRVLLRQGPRGGGDWRHGQRARVRRPAGGDLLRGPLSCPLCTPLPRQSVVCMA

SEQ ID NO: 2896 - protein, 474 aa, Euglena gracilis
MKSVVRSKGTQALFRRFSSALGDSINPNQVGVGDNVIRVNGRLFEVDKVQEKGLKTSVLDNGTKVITLDNGGSVAQLTFLYKDGPVYENIFNAGISSFMKHALTKDGLTSSEYITKTFLQKAGIIVHEPTVVNKSAIAFTVEGFRDTLAQPAVADKFWQSLLFPRFSPENVKEVKRLVELESKETKRDSPFAYLQDILHKTAFKGSPLGHTSFVPAYNLGYIDSNKLFDRWDAHYGFGNIAVIATNIEHEAVLAAITDSAWVARAHNKVGGVAAPASKYSGGEGYDVVHRAKEFDDQFTDVYSTYTAYAFKAPGRSNLKEHAASLVIAQALSNAVSPVLNTSFAPKRLEVFYQAYDTVGLIGLSSVQASNAQLKAFKAALSKIGTLSEADLAVHKSAALLTAYGNVESWRATQATLIDSFNTTGQPLSPLEIVSAIKAVSADTVKSVVATMLGSPATLVHHGDSPCAPTLDALQ

SEQ ID NO: 2897 - protein, 248 aa, Amaranthus tricolor
IGAGKMGKLVIKHLVAKGCTKMVVVKRSEERVAAIRVEMPDVQIIYKPLPEMLACPAEADVIFTSTASESLLFKKENVQALPPVGSGVGGVRRFIDISVPRNVGSCISELENAKVYNVDDLKEVVAANKEDRLRKAMEAQAIITEEIKEFEAWRDSLETVPTIKKLRGYAERLRVAELEKCLSKMNPDLSKKDKRAVDDLSRGILNKLLHGPMQHLRCDESKGRTLNETLENMHELNRMFSLETLENM

SEQ ID NO: 2898 - protein, 617 aa, Triticum aestivum
MPEAPMAAGAGAGDGVSWEEAHRQVLDLIERVTRCAGEIQRQVLVEILAQNAPAEYLRRIGVPGAAPGADDAFRRLAPLTTYEDILPDVIRIANGDSSPILSGKPIREFLTSSGTSGGERKLMPTIEEEMDRRSMLYSLLMPVMSQAMPGLDKGKAMYLYFVKAESRTPGGLPARPVLTSFYRSRHFLERPHDPYTVHTSPDEAILCVDAYQSMYAQLLCGLVHRADVLRVGAVFASGFLRAIHFLEKHWERLCRDIRTGELDAEITDCAVRAAVGRVLRPDPALADAIEDACKRSSWKGVIRRVWPNTKYIDVIVTGAMAQYIPTLDYYGGGLPLACTMYASSECYFGLNLNPICSPADVAYTLIPTMCYFEFLPVQSGSSAAAGEPDHRDLVNLVDVKLGKEYELVVTTYSGLYRYRVGDVLRVAGFKNAAPMFNFLRRKNVALSVDADKTDEAELHAAVSSAVQHLEPFGASLVEYTSYADASTIPGHYVLFWELRAGGGSTTPVPAFVFEDCCLAVEESLNSVYRQCRAADRSVGPLEIRVVSEGTFDKLMDLALSRGASINQYKAPRCVRPGPVVELLDGRVEGRYFSPKCPKWSPGSAQWTGGHGKTLSTS

SEQ ID NO: 2899 - protein, 480 aa, Physcomitrella patens subsp. patens
MVKICCIGAGYVGGPTMAMIALKCPDIEVVVVDISKPRIAAWNSDELPIYEPGLDEVVKKCRGKNLFFSTEVEKHVAEADIVFVSVNTPTKTRGLGAGKAADLTYWESAARMIADVSKSDKIVVEKSTVPVKTAEAIEKILTHNNKGINFQILSNPEFLAEGTAIEDLEKPDRVLIGGRTTPEGQKAVAALKAVYAHWVPEDRIITTNLWSAELSKLAANAFLAQRISSINAMSALCESTGADVSEVAYAVGKDSRIGPKFLNASVGFGGSCFQKDILNLVYICECNGLPEVAHYWKQVVSINDYQKTRFVKRVVSSMFNTVSGKKIAILGFAFKKDTGDTRETPAIDVCHGLLGDKAQLSIYDPQVTEDQIKRDLAMNKFDWDHPQHLQPQSPTAFKQVSVVWDAYEACKDAHGICIITEWDEFKKLDYQKLYDNMQKPAFLFDGRNVLNVEEMRKIGFVVYSIGKPLDPWVKDLQVSI

SEQ ID NO: 2900 - protein, 247 aa, Roseovarius nubinhibens ISM
MSGKTTHFGFQTVPEAEKAGRVQGVFGSVASKYDVMNDAMSMGIHRIWKDAMMDWLAPRPGQRLLDVAGGTGDISFRFLNRAGSGHATVLDLTEPMLVEGRKRAEAAQMADSLDWVVGDAMALPFADNTFDVYTISFGIRNVTRPEEALREAYRVLRPGGRLMVLEFSQIPNEMMQKVYDLYSFHIIPRMGQAIAGDRDSYQYLVESIRQFPDQKTFLGMVREAGFGNAKYRNLSLGIACLHSGWKL

SEQ ID NO: 2901 - protein, 493 aa, Rhodococcus sp. RHA1
MPSTNIQYITRSGMISYTSLFIGGQWVAPSTAATISVTSASTEEVIGVVPEGAPADADAAVAAARRAFDDPTGWASLEPSRRAETLEKLAAAIGESSEDIVRLVSEQNGMPISTARAVEGGFPGALLRLYAGMVRDQQLEEERPGMFGGHVVVRRQPVGVVAAIVPWNFPQTLLFSKLAPALAAGCTVVIKPSPETVLDVFRLAELLEQAGLPHGVVNIVPGGRELGAYLVEHPGVDKVAFTGSTPAGRSIAEACGRLLRPVTLELGGKSAAIVLDDAELVSSAQDLFGATLLNNGQTCFVGTRILAPRSRYDEVVDVFTQMAASAVVGDALDEATMVGPMASSTHRDRVEGYIAQGKSEGARLTTGGGRPERDRGWFVQPTIFADVDNSATIAREEIFGPVLSIIPYGDIDDAVHIANDSGYGLGGTVWSQDLEHAGAVARRVQTGTVGINHYIPDPAAPFGGVKGSGLGREFGPEGLANYQQQQSIYFPPV

SEQ ID NO: 2902 - protein, 386 aa, Aspergillus parasiticus
MTGLDMEIIFAKIKEEYARTDDVGKRQIQGHIRELQVGFYSDWDVVMRLSSGPLQVALTKVGIDLGIFRSLKESDTPITLAEIVKKTGASPRLLGRILRTQAAFGLIKETGPQEYTSSAFTDVFANSDAAGAVVQLFDISGPCTQILPDFLAERNYQDITSNKDCVFQKAFGSDLTMFEWMPQHPKHMESLGHLMALERPVSWVDHYPVLEELGGFPAPDKVLMVDIGGGFGQQSKALRAKFPDLPGRLIVQDIPQTLANAQPAAGIEFMEHNFFEPQPIQNAKFYYLRHVFHDWPDEQCVLILKQIIPAMGPESQILIDEMVIPSTGVPWQAAFTDLLMMNSLGGVERTRAEWDDLMEQVGLEIIQSKVYDSKEQAILVAVPKRT

SEQ ID NO: 2903 - protein, 424 aa, Burkholderia sp. 383
MAIVEVKVPQLSESVSEATMLQWKKKPGEAVAQDEILIELETDKVVLEVPAPAAGVLAQVLQNDGDTVVADQIIATIDTEAKAGAAEAAAGAAEVKPAAAPAAAAPAAQPVAAAASSTTASPAASKLLAEKGLSAGDVAGSGRDGRVTKGDALAAGSAPKAAPAAAPAKTAAAKPALPEVKVPASAATWLNDRPEQRVPMSRLRARIAERLLESQQTNAILTTFNEVNMAPVMELRNKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 2904 - protein, 254 aa, Zea mays
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMDPDHPFYSNISKDRRYADLTEDQLPSCESLKDTIARALPFWIEEIVPQIKEGKRVLIAAHGNSLRGIVKHLEGLSEEAIMELNLPTGIPIVYELDKNLKPIKPMQFLGDEETVRKAMEAVAAQGKVKK

SEQ ID NO: 2905 - protein, 476 aa, Burkholderia sp. 383
MSKEFDVVVIGAGPGGYIAAIRAAQLGKTVACIEKWKNPAGALKLGGTCLNVGCIPSKALLASSEEFENTSHHLADHGITVDGVKIDVAKMLGRKDAIVEKMTSGIEFLFKKNKITWLKGHGKFTGKTDAGVQIEVSGEGETEVVTAKNVIIATGSKARHLPGIPVDNKIVSDNEGALTFDAVPKKLAVIGAGVIGLELGSVWRRLGAEVTVLEALPAFLGAADEALAKEAAKLFKKQGLDINLGVQIGEVKATANGVSIAYTDKDGNAQTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIAANASDLIAEAVVAMEFKAASEDIARICHPHPSMSEVMREAALAVDKRSLNS

SEQ ID NO: 2906 - protein, 370 aa, Zea mays
IQMGLAENQLSLDLIEQWSMEHPEASICTAQGASQFRRIANFQDYHGLPEFREAMAKFMGQVRAGKVTFDPDRVVMCGGAAGAQDTLAFCLADPGDAYLVPTPYYPAFDRDCCWRSGVKLLPIECHSSNNFTLTREALVSAYDGARRQGVRVKGVLITNPSNPLGTTMDRATLAMLARFATEHRVHLICDEIYAGSVFAKPDFVSIAEVIERDVPGCNRDLIHIAYSLSKDFGLPGFRVGIVYSYNDDVVACARKMSSFGLVSSQTQHFLAKMLSDAEFMARFLAESARRLAARHDRFVAGLREVGIACLPGNAGLFSWMDLRGMLRDKTHDAELELWRVIVHKVKLNVSPGTSFHCNEPGWFRVCYANM

SEQ ID NO: 2907 - protein, 370 aa, Zea mays
IQMGLAENQLSLDLIEQWSVDHPEASICTAQGASQFRRIANFQDYHGLPEFREAMAKFMGQVRGGKVTFDPDRVVMCGGATGAQDTLAFCLADPGDAYLVPTPYYPAFDRDCCWRSGVKLLPIECHSSNNFTLTREALVSAYDGARRQGVRVRGILITNPSNPLGTTMDRGTLAMLAAFATERRVHLNCDEIYAGSVFAKPGFVSIAEVIERDAPGCNRDLVHIAYSLSKDFGLPGFRVGIVYSYNDDVVACARKMSSFGLVSSQTQHFLARMLADAEFMARFLAESARRLAARHDRFVAGLREVGIACLPGNAGLFSWMDLRGMLRERTHDAELELWRVIVHRVKLNVSPGTSFHCNEPGWFRVCYANM

SEQ ID NO: 2908 - protein, 163 aa, Gloeobacter violaceus PCC 7421
MNLPNWITFSRLLAVPALLVILAPVPGPGQRIAAAVIFALAAATDWLDGYLARRLGQVTELGKFLDPLVDKLLVLAPMLMLVELGQLPGWGVFLILARELAVAGWRVGQSKISGANNWGKAKTVVQILAVIFLIMLWPGGEVLFWAAVALTLISGGIYLWPRR

SEQ ID NO: 2909 - protein, 369 aa, Listeria monocytogenes str. 4b H7858
MGQLKGLPVEDGFRMPGEYEPHIGCFMIWPERPDNWRLGGKPAQQNYKEVAVAISNFEPVTMFVSPNQYKNARKELPDTIRVIEMSNDDAWIRDYGPSFLVNDKGEMRGVDWGFNAWGGLLDGLYFPWDKDNQIAKKVCDIERLDYYSQKDFILEGCSIHVDGEGTLVTTEECLLSEGRNPNLTKIEIEQTLKKYFHVQKVIWLKHGFYLDETNGHVDNIFNFVAPGEVVLSWTDNKSDPQYEISRECYDILANQTDAKGRTFIIHKLHCPDPVLITQTESEGVEAINGTFPRQAGDRLAASYVNYYTANGAIIFPLFDDPKDKDAQELLEQLYPDRKIVGIKAREILLGGGNIHCITQHLPDKSTIRE

SEQ ID NO: 2910 - protein, 427 aa, Corynebacterium diphtheriae
MFLCLIVGKPARGAEILDRLGFVRSKQNVLAIVLAGGEGKRLFPLTEDRAKPAVPFGGTYRLIDFVLSNLVNAGYLKICVLTQYKSHSLDRHISQAWQFSGPTSQYIASVPAQQRLGKRWYMGSADAILQSLNLVYDERPDYVLVFGADHVYRMDPEQMVADHIASGKAVTVAGIRVPRSEASAFGCIQADENNNITEFLEKPADPPGTPDDPSMTFASMGNYVFSTDALIQALKEDENNPDSEHDMGGDIIPYFVSMGQANVYDFNKNVVPGSTDRDRAYWRDVGTVDAFYEAHMDLISVHPVFNLYNQQWPIRSTERGDLPPAKFVQGGIAQASMVAQGSIVSGSTVRNSVVSTDVVVEEGATVEGSVIMPGARIGKGAVVRHCILDKNVVVSDGQVIGVDRERDEQRFQISPGGVVVVGKNFVV

SEQ ID NO: 2911 - protein, 512 aa, Gloeobacter violaceus PCC 7421
MEVRPMVVAAPAASASESIFKPRYDNFIGGQWRAPLKGQYTDNITPVNGRVLCQVPRSTVEDIELALDAAHAARESWGALSAAERSNILLKIADRMEANLHKLAVAETWDNGKPIRETTGADVPLAVDHFRYFAGCIRAQEGSISEIDGNTIAYHFPEPLGVVGQIIPWNFPILMAAWKLAPALAAGNCVVLKPAGPTPASILVWLEVVGDLLPAGVLNVVIGPGPEVGKALAASKRVAKVAFTGETETGRQIMQYAAQNIVPVTLELGGKSPNLFFADVMNADDDFLDKAVEGFVMFAFNQGEVCTCPSRALVHESIYEKFIDRAVRRVASIKQGNPLDPETMLGAQVSQAQMEKIARYVELGKQEGAEVLIGGERNSEPGEGLAGGYYYKPTVMKGHNQMRIFQEEIFGPVLAVTTFKDAEEAVRIANDTPYGLGAGVWSRDINTAYRVGRGIQAGRVWVNCYHVYPAHAAFGGYKASGVGRETHKMMLSHYQQTKNLLVSYDTKPQGFF

SEQ ID NO: 2912 - protein, 493 aa, Anemarrhena asphodeloides
MRINPTTSSPAVSALEEKNLGRIAQIIGPVLDVVFPPGKLPNIYNALVVQGRDIVGQQINVTCEVQQLLGNNRVRAVAMSATDGLTRGMEVVDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKETLQRYKELQDIIAILGLDELSEEDRLTVARARKIERFLSQPFFVAEVFTGSPGKYVGLAETIRGFQLILSGELDGLPEQAFYLVGNIDEATAKAMNLERG

SEQ ID NO: 2913 - protein, 468 aa, Shewanella sp. MR-4
MSNDFQFIEVGRKDPTKHPAAKRSTQFIEIYQPFAQAQVTEQADRCLDCGNPYCEWKCPLHNYIPNWLKLAQQGRIMEAADLVHETNTLPEICGRVCPQDRLCEGACTLNADFGAVTIGNVEKYITDTAIAQGWRPDMSKVTPRKEKVAIVGAGPAGLGCADILARNGVKAVVFDKYPQIGGLLTYGIPSFKLDKAVMATRRTVLEGMGIEFKLGVTVGKDVAFNQLLEEYDAVFLGMGTYTAMKAGLEGEDAQGVYQALPYLIGNTHHLMGSSNPDTPYLNLAGKRVVVLGGGDTAMDCVRTAVRQGASSVICAYRRDEANMPGSRREVQNAREEGVNFLFNRQPVAIKTQDGKVVGVECVETQMGKADASGRQRAEAIEGSEQLLDADAVIIAFGFQPSPAPWFADYGIELDQWGRVKASKQADNPFQTTNPKVFAGGDMVRGSDLVVTAIAEGRDAAQGILNYLD

SEQ ID NO: 2914 - protein, 370 aa, Triticum aestivum
  misc_feature (270)..(270): Xaa can be any naturally occurring amino acid
  misc_feature (292)..(292): Xaa can be any naturally occurring amino acid
MDPATKLRFDSPLLRVYEDGRVERLFGTETTPPGFDAATGVTSKDVVIDAATGVFARLYVPDLVAAGSGSQRKKLPILVYFHGGGLVLDSAASPTYHRYLNSVASKAGVLAVSVNYRLAPEHPVPAAYDDSWAALSWAASRDDPWLSEHGDAGRIFLAGDSGGANIVHNIAIMAGTRDGLPPGARIEGAIIFHPMFGGKEAMDGEAMDMRAITEKLWPIICPESADGMDDPRLNPLARGAPSLQKLACRRLLVCSADGDFALPRAAAYYXQAVRPAGWPATVEWLESKGEKXVFFLSKPEFDPAMQMMTRVVAFFADIDSKGTPGSGNSLRIARLSKPKTNYFGNPDRKIKANFWLTQNKNKGGRSNFPE

SEQ ID NO: 2915 - protein, 492 aa, Vibrio fischeri ES114
MKRLKYFVSNVAILIIIKALIMTNSTPIRSTHFDAIVIGSGPGGEGAAMGLTKANLNVAIIEREPSVGGGCTHWGTIPSKALRHAVSRIIEFNSNPLYCKNNTSLHSTFSDILGHAKSVIDKQTRMRQGFYDRNQCSLIFGEASFVEKNTVAVTAKDGSIETYTADKFIIATGSRPYRPEGINFNHSRVYDSDSILSLKHDPRHIIIYGAGVIGSEYASIFRGLGVKVDLVNTRDRLLSFLDNEMSDALSYHFWNSGIVTRNDENFEHIEANDDGVIMHLESGKKMKADCILFANGRTGNTDKLNLSAVGLEADSRGQLKVNDNYQTDVEHIYAVGDVIGYPSLASAAYDQGRFTAQAITKGKAEARLIDHIPTGIYTIPEISSVGKTEQELTAAKVPYEVGRSSFKHLARAQIAGKDIGSLKILFHRETKEILGIHCFGERAAEIIHIGQAIMEQKGEANTIEYFVNTTFNYPTMAEAYRVAALNGLNRLF

SEQ ID NO: 2916 - protein, 257 aa, Bacteroides thetaiotaomicron VPI-5482
MREKLTVIKVGGKIVEEEATLLQLLNDFAAISGHKVLVHGGGRSATKIAAQLGIESKMVNGRRITDAETLKVVTMVYGGLVNKNIVAGLQARGVNALGLTGADMNVIRSVKRPVKEVDYGFVGDVEKVDASLLADLIHKGVVPVMAPLTHDGQGNMLNTNADTIAGETAKALSALFDVTLVYCFEKKGVLRDENDDDSVIPEITRAEFEQYVADGVIQGGMIPKLENSFEAINAGVTEVVITLASAIKDNEGTRIKK

SEQ ID NO: 2917 - protein, 486 aa, Bacillus cereus ATCC 14579
MITTEIKRVKNHINGEWVESTGTEVEAVPNPATGKIIAYVPLSPKEDVEKAVEAAKAAFETWSKVPVPNRSRNLYKYLQLLQENKDELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFNEDNYVGPLIRESHKERVLGYINSGVADGATLLVDGRKINEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLSTNGTDGVQFYTRKKVVTERWF

SEQ ID NO: 2918 - protein, 359 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLKIGPNEPSLSILSIENAYGLARYAVICQENGLVPIVELEILVDGSHDIHKCAAITERVLAATYKALSDHHVLLEGTLLKPNMVTPGSDSPKVAPEVVAEHTVRALQRTVPAAVPAVVFLSGGQSEEEATVNLNAINQVKGKKPWTLSFSFGRALQQSTLKAWSGKEENVKNAQDALLTRAKANSEATLGTYKGNSQLGEGASESLHVKDYKY

SEQ ID NO: 2919 - protein, 112 aa, Brassica napus
  misc_feature (93)..(93): Xaa can be any naturally occurring amino acid
  misc_feature (100)..(102): Xaa can be any naturally occurring amino acid
  misc_feature (104)..(104): Xaa can be any naturally occurring amino acid
  misc_feature (107)..(107): Xaa can be any naturally occurring amino acid
MASSMLSSAAVATSPAQATMVAPFTGLKSSAAFPVTRKSNTDITSIANNGGRVSCMKVWPPVGKKKFETLSYLPDLTDVELAKEVDYLLRNKXFPCVEFXXXPXFVXKTCIP

SEQ ID NO: 2920 - protein, 435 aa, Arabidopsis thaliana
MERYKILEELGDGTCGSVYKAVNLETYEVVAVKKMKRKFYYWEECVNLREVKALRKLNHPHIIKLKEIVREHNELFFIFECMDHNLYHIMKERERPFSEGEIRSFMSQMLQGLAHMHKNGYFHRDLKPENLLVTNNILKIADFGLAREVASMPPYTEYVSTRWYRAPEVLLQSSLYTPAVDMWAVGAILAELYALTPLFPGESEIDQLYKICCVLGKPDWTTFPEAKSISRIMSISHTEFPQTRIADLLPNAAPEAIDLINRLCSWDPLKRPTADEALNHPFFSMATQASYPIHDLELRLDNMAALPNLELNLWDFNREPEECFLGLTLAVKPSAPKLEMLRNVSQDMSENFLFCPGVNNDREPSVFWSLLSPDENGLHAPVESSPLSLSFSPMQQHTVGPPQSSGFTMTSSMQPNMLDRPWMAVSAPFQQSHYL

SEQ ID NO: 2921 - protein, 1034 aa, Arabidopsis thaliana
MDKISIRCFIFLVLTSFVTTVSCLSAATDYREVEDEHEFSYEWNQENGPAKWGKLRPEWKMCGKGEMQSPIDLMNKRVRLVTHLKKLTRHYKPCNATLKNRGHDMMLKFGEEGSGSITVNGTEYKLLQLHWHSPSEHTMNGRRFALELHMVHENINGSLAVVTVLYKIGRPDSFLGLLENKLSAITDQNEAEKYVDVIDPRDIKIGSRKFYRYIGSLTTPPCTQNVIWTVVKKVRTVTKNQVKLLRVAVHDNSDTNARPVQPTNKRVDSSSNARPVQTTNKQHCIVSQNHSISMSLATTMIVLFLQIITCFLFTTTVSSPHGFTIDLIQRRSNSSSFRLSKNQLQGASPYADTLFDYNIYLMKLQVGTPPFEIAAEIDTGSDLIWTQCMPCPDCYSQFDPIFDPSKSSTFNEQRCHGKSCHYEIIYEDNTYSKGILATETVTIHSTSGEPFVMAETTIGCGLHNTDLDNSGFASSSSGIVGLNMGPRSLISQMDLPYPGLISYCFSGQGTSKINFGTNAIVAGDGTVAADMFIKKDNPFYYLNLDAVSVEDNRIETLGTPFHAEDGNIVIDSGSTVTYFPVSYCNLVRKAVEQVVTAVRVPDPSGNDMLCYFSETIDIFPVITMHFSGGADLVLDKYNMYMESNSGGLFCLAIICNSPTQEAIFGNRAQNNFLVGYDSSSLLLQGASPYADTLYDYSIYLMKLQVGTPPFEIVAEIDTGSDIIWTQCMPCPNCYSQFAPIFDPSKSSTFREQRCNGNSCHYEIIYADKTYSKGILATETVTIPSTSGEPFVMAETKIGCGLDNTNLQYSGFASSSSGIVGLNMGPLSLISQMDLPYPGLISYCFSGQGTSKINFGTNAIVAGDGTVAADMFIKKDNPFYYLNLDAVSVEDNLIATLGTPFHAEDGNIFIDSGTTLTYFPMSYCNLVREAVEQVVTAVKVPDMGSDNLLCYYSDTIDIFPVITMHFSGGADLVLDKYNMYLETITGGIFCLAIGCNDPSMPAVFGNRAQNNFLVGYDPSSNVISFSPTNCSALWS

SEQ ID NO: 2922 - protein, 307 aa, Saccharomyces cerevisiae
MLISSRIVRSSLVNVPLRLSRCFTQAHRACKEEEVNSPLSSAAEQPEQKYTHFGSKTVLKSTKQKLVGDVFSSVANRYDLMNDVMSLGIHRLWKDHFINKLDAGKRPNSTTPLNFIDVAGGSGDIAFGLLDHAESKFGDTESTMDIVDINPDMLKEGEKRAMEQGKYFKDPRVRFLVSNGEKLEEIDSDSKDIYTVSFGIRNFTDIQKGLNTAYRVLKPGGIFYCLEFSKIENPLMDFAYQQWAKVLPVMGSMIANDYDSYQYLVESIERFPDQETFKSMIEKAGFKSAGYESLTFGICAIHWGIKV

SEQ ID NO: 2923 - protein, 296 aa, Synechococcus sp. WH 5701
MFTVALPLALAFIMLSLGISLTPADFGFSLRRPHPLLAGVLCQVVLLPLVAFLLIRLFSLPGELGVGVLVLACCPGGITSNVMTRLARGDVALSISFTALASLITTITLPLILTVGGRALMGTALPTVSITGLGLKMFVMTTLPVLVGVYLRQRRQALAQRWERPCERMATALFFLILAITILSEWQTLIDNLTSLGPVLLVLNVGMLAIGTAVAQIFRLPASQVSCVAIESGFQNGTVGIAVGALLVQASRSGGGLSAYSLPSAVYGVLMMVTILPYLVWRRSIQPTADPSVIEP

SEQ ID NO: 2924 - protein, 92 aa, Arabidopsis thaliana
MENNTFSSKSINLLILLLLLCTFLCQTESALPSHQELVITGRRMMSYYKPNTDIGTPSSTSDRGGGGNGRRLMSQMDVGASSSGQGGGRNRH

SEQ ID NO: 2925 - protein, 373 aa, Mannheimia succiniciproducens MBEL55E
MSNTIKSRAAVAFAPNEPLKMVEIDVERPKKGEVLVKITHTGVCHTDAFTLSGADPEGVFPVVLGHEGAGVVVEVGEGVTSVAVGDHVIPLYTAECRECEFCKSGKSNLCVSVRETQGKGLMPDGTTRFSYNGQPIFHYMGCSTFSEYTVVADVSLAKINPQANPEEVCLLGCGVTTGIGAVHNTAKVQEGDSVAVFGLGGIGLAVIQGAKQAKAGRIIAIDTNPAKFELAREFGATECLNPNDFDKPIQQVIIEMTKWGVDHTFECIGNVNVMRAALESAHRGWGQSIIIGVAGAGQEISTRPFQLVTGRTWKGSAFGGVKGRTQLPGMVEDAMKGIIRLRPFVTHTMPIERINEAFDLMHEGKSIRTVVHY

SEQ ID NO: 2926 - protein, 178 aa, Zea mays
  misc_feature (151)..(151): Xaa can be any naturally occurring amino acid
YVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTIVKGKNIIIATGSDVKSLPGITIDEKKVVSSTXGYIGLEMGSVWNRLGSEVTVVEFAPDI

SEQ ID NO: 2927 - protein, 370 aa, Cryptococcus neoformans var. neoformans JEC21
MANILKRSALKLGMIPADGIGKEVLPAAQRVIEALGSSIPKTTFVPLVAGWEEFNKNGKALPDDTVSALRECDGAMFGAVSSPSHKVAGYSSPIVALRKHLDLYANVRPVSSVPIPGQPSPKAVDLVIVRENTECLYIKQEEISGEGEDRVALATRKISAKASSRIGRMAFEIALRRGQEREAARAAGKDVWWKGEPKVTIVHKSNVLSVTDGLFRETVRAVKEGKGGEKYAGVKLEEQIVDSMVYRMFREPEFFDVCVAPNLYGDIISDGAAALVGSLGLVPSINAGDNFIMGEPVHGSAPDIEGKNIANPIASIRSAALLLSSLGYIEPAAKINAAVNAVLVEGQYLTPDLGGKSSTTEVTEAVLKRL

SEQ ID NO: 2928 - protein, 147 aa, Mycoplasma pneumoniae
HRSGLSEHDWEGMETLTKHWSTHQIVGDDLYCTNPAIAEKGVAHKATNSILIKLNQIGTLTETIKAINIAKDANWSQVISHRSGETEDTTIADLAVAACTGQIKTGSMSRSERIAKYNRLLQIELELGNNAKYLGWNTFKNIKPQKA

SEQ ID NO: 2929 - protein, 631 aa, Clostridium butyricum
MKKYRVNVQGMTCSGCEQHVAVALENMGAKAIEVDFRRGEAVFELPDDVKVEDAKNAIADANYHPGEAEEFQSEQKTNLLKKYRLNVEGMTCTGCEEHIAVALENAGAKGIEVDFRRGEALFELPYDVDIDIAKTAITDAQYQPGEAEEIQVQSEKRTDVSLNDEGNYDYDYIIIGSGGAAFSSAIEAVALNAKVAMIERGTVGGTCVNVGCVPSKTLLRAGEINHLAKNNPFVGLHTSASNVDLAPLVKQKNDLVTEMRNEKYVNLIDDYGFELIKGEAKFVNENTVEVNGNQITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHVEINGKKRIIEAEQLLIATGRKPNTESLNLHAAGVEVGSRGEIVIDDYLKTTNSRIYSAGDVTPGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMAPYLTMAEGLKLAVLTFDKDVSKLSCCAG

SEQ ID NO: 2930 - protein, 352 aa, Arabidopsis thaliana
KTQFRPVQCQIHHTYKITISLTSSSSSSYHYSLISPSLLLQKSTASSFNQKETPVSVSAMEFFQKAKAIRMRNSHNKYLTADDDEETVTQNRNGSTKNVRWTVEPVRDSFHVIRLKSCYGKYLTASNERFLLGATGKKVIQLKLSRVDSSVEWEPVREGSKIKLRTRSGNYLRGNGGLPPWRNSVTHDVPHLSATQDSISWDVDVVEILTDSEFKTESAKAPPPKTTSPPPHRRPTSSPLSAESPRTSSSLSDRSDSDSVESPPKSDGRTIYYHVADEEGHVEDETTVGYAFTFKGNSVAELTQTLREETCMEDAVVCTRSPLNGKLFPLRLQLPPNNGTLHVILLPSSASL

SEQ ID NO: 2931 - protein, 283 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAY

SEQ ID NO: 2932 - protein, 400 aa, Triticum aestivum
  misc_feature (167)..(167): Xaa can be any naturally occurring amino acid
  misc_feature (229)..(229): Xaa can be any naturally occurring amino acid
  misc_feature (249)..(249): Xaa can be any naturally occurring amino acid
  misc_feature (260)..(260): Xaa can be any naturally occurring amino acid
  misc_feature (279)..(279): Xaa can be any naturally occurring amino acid
HSRTSLYKKAGRVPVRNSRDIVDPRVRTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGXRGYLVDKVLDKTGMKGTGKWTVQQAAELSVAAPTIEASLDSRFLSGLKDERVAASKIFQGDXSSGETVDKAQLIEDVRKALXYASKICSYAQXGMNIIKAKSTEKGWGLNLXGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 2933 - protein, 117 aa, Rickettsiella grylli
MNNSSIVTLNDASFESEVLQFNATPILVDFWAEWCGPCKAISPILDKLSEKYRGKIKIGKLNVDENPKTPAKYGVRGIPTLILFKDGKAVETKVGALLESQLESFLEKHLTNPGTST

SEQ ID NO: 2934 - protein, 403 aa, Bacteroides thetaiotaomicron VPI-5482
MDIQKIREDFPILSRTVYGKPLVYFDNGATTQKPRLVVDALVDEYYSVNANVHRGVHYLSQQATELHEASRETVRQFINAGSTNEVVFTRGTTESINLLVSSFGDEFMQEGDEVILSVMEHHSNIVPWQLLAARKGIAIKVIPMNDKGELLLDEYEKLFTERTKIVSVVQVSNVLGTVNPVKEMIATAHAHGVPFLVDAAQSIPHMKVDVQDLDADFLVFSAHKVYGPTGVGVLYGKEEWLDRMPPYQGGGEMIQHVSFEKTTFNELPFKFEAGTPDYIGTTGLAKALDYVNGIGLDPIAAHEHELTTYALKRLKEIPNMRIFGEAADRGAVISFLVGDIHHFDLGTLLDRLGIAVRTGHHCAQPLMQRLGIEGTVRASFAMYNTRSEVDALVAGIERVSQMF

SEQ ID NO: 2935 - protein, 588 aa, Hordeum vulgare
MALSCMRCPSVAAGPAVRRPSSSVALSLARCGGRPAAVASGGWRIHAVAGKGVVKGPMDTAVENTVAPAAPSPVENGTSSAITVEEYEDLASLAKDDEASVSITVVGASGDLAKKKIFPALFALYYEGCLPKHFSIFGYARSKMTDAELRHMVSKTLTCRIDKRENCSEKMEEFLKRCFYHSGQYDSEEDFRELGKKIELHQGPRVSNHLFYLSIPPNIFLDVVKCASKSASSASGWTRVIVEKPFGRDSESSAALTRGLKEFLAEDQIFRIDHYLGKELVENLSVLRFSNLVFEPLWSRQYIRNVQLIFSEDFGTEGRGGYFDSYGIIRDIMQNHLLQILALFAMETPISLEAEDIRNEKVKVLRSMKPLRLEDVVIGQYKSHTKGGITYPGYTEDKTVPKGSLTPTFAAAALFINNARWDGVPFLMKAGKALHTKQAEIRVQFRHVPGNLYKGSFGTDLDRATNELVIRVQPDGGIYLKINNKIPGLGMRLDRSNLNLHYAARYPKEIPDAYERLLLDAIEGERRLFIRSDELDAAWELFTPLLKELEQKRMAPELYPYGSRGPVGAHYLAAKYNVRWGDLGGSEH

SEQ ID NO: 2936 - protein, 506 aa, Triticum aestivum
  misc_feature (201)..(201): Xaa can be any naturally occurring amino acid
  misc_feature (239)..(239): Xaa can be any naturally occurring amino acid
  misc_feature (341)..(341): Xaa can be any naturally occurring amino acid
MQSEIWLLWATLAAALLFYLTSAARRGGTGARQPRGPTPLPVLGNVLDLGGNLHHTLARLARVHGPVMKLKLGLVTIVVVSSRDAAREAYTRYDRHLAARAVPDAANAVGNSGRSMIWLPSSDPLWKTLRGIVASHIFSPRGLAAARGVRERKVRDMVGYFRCHAGEEVDVGQAVYGGVLNLVSSAFFSVDVVDVGSESRXGCGRSVEDIIAALAKPNVSDIFPFLRPLDLQGWRRWAXARYQKVFGILDGIVDRRLADARTSNGEHAHGDFLDSLLELVSTGKIGRDKVTVILFDLFSAGTDTMAITVEWAMDELLRHPHAMAKVHADMADILGGKEHGXTLEEPDAANLPYLQAVVKEVMRLHPVAPIMLPHQAAEDGVEIGGFAVPRGATVIFNVWAIMRDSAAWERPDEFVPERFLLDKAVDRAVEFRGKDYEFIPFGSGRRLCPGLPMAERVVPFVLASLLHAFEWRLPDGVSADEMDVTEKFTTVNTLAVPIRAVPVVVT

SEQ ID NO: 2937 - protein, 374 aa, Chlamydomonas reinhardtii
MALMMKSSASLKAVSLAALAAPSLCAPGKYDEELIKTAGTVASKGRGILAMDESNATCGKRLDSIGVENTEENRRAYRELLVTAPGLGQYISGAILFEETLYQSTASGKKFVDVMKEQNIVPGIKVDKGLVPCPTPTMSWCMGLDGWTSAAEYYKAGARFAKWRSVVSIPHGPSIMLPRLAYGLARYAAIAQNAGLVPIVEPEVLLDGEHDIDRCLEVQEAIWAETFKYMADNKVMLQGILLKPAMVTPGADCKNKAGPAKVAEYTLKMLAARAPPVPGIMFLSGGQSELESTLNLNAMNQSPNPWHVSFSYARALTNTVLKTWQASPRTVQAPRLAAQARKANSDAQQGKYDATTEGKEAAQGMYEKGKGYVY

SEQ ID NO: 2938 - protein, 576 aa, Burkholderia sp. 383
MTTAPIRPDAGPQHADHFAALDAASPPPTRRIGLDALAGLSIAGLLIPEAVAYAGLANLPPQAGLIALLSGLVVYALTGSSRFAIVSSTSSSAAVLAATVLAESGMALAAQLALAAALVAMTGVLFILAGAARLGGMSDFVARPVLRGFTFGLALTIVIKQLPKILAISVQHSDAPHVALDLITGAPHANLASVVLGAIALALLFALGRSSRVPATLVVIVLSIAAGYAIDWQRYGIAIVGHIDFKHIEFGLPTLDRNAWMQTIELAFALMLILYAESYGSIRNFALKHGDSVSPNRDLVALGCANLVSGLLHGMPVGAGYSATSANEAAGAQSRFAGLWAAGVVALIVWLLLPQLARTPEPVLAAIVIFAVSHSLHPSVFRPYWAWHRDRLVVIAALLAVLVLGVLHGLLAAIGVSLLLTLRKLSEPNVSVLGRLRDSHDFVDVASHADAKPVPGVLIVRPEAQLFFANADRMLNRVRALMKAAPDAHTVMLSLEETPDVDSTTIESLRTFAAECTARGLRLAIVRLKVHALHALRRAADDTLHDNAMSELSVDESLQLLQAGMPPDGSDGTTAA

SEQ ID NO: 2939 - protein, 49 aa, Koliella antarctica
IDHYLGKELIENLTVLRFANLVFEPLWSRQYIRNVQVIFSGDFGTEGRG

SEQ ID NO: 2940 - protein, 457 aa, Streptomyces coelicolor A3(2)
MSTDSPKDLSRTAYDHLWMHFTRMSSYENAPVPTIVRGEGTHIYDDKGRRYLDGLAGLFVVQAGHGRQELAETASKQAQELAFFPVWSYAHPKAVELAERLANEAPGDLNKVFFTTGGGEAVETAWKLAKQYFKLTGKPTKYKVISRAVAYHGTPQGALSITGLPALKAPFEPLVPGAHKVPNTNIYRAPIHGDDPEAYGRWAADQIEQQILFEGPETVAAVFLEPVQNAGGCFPPPPGYFQRVREICDQYDVLLVSDEVICAFGRLGTTFACDKFGYVPDMITCAKGMTSGYSPIGACVISDRLAEPFYKGDNTFLHGYTFGGHPVSAAVGIANLDLFEREGLNQHVLDNEGAFRATLEKLHDLPIVGDVRGNGFFYGIELVKDKATKESFDEEETERVLYGFLSKKLFENGLYCRADDRGDPVIQLAPPLISNQETFDEIEQILRATLTEAWTKL

SEQ ID NO: 2941 - protein, 410 aa, Mycobacterium sp. MCS
MLLSLIAVSAVLAGWGVLARRMERWRVTAPMVIVLAGVLIGLATSDRVADGLNTEIAEHVAEIILAILLFVDATDVRGGLFGYEPKAAMRILFVSLPLGVATALIFGLWLLPGSSWAVLLVIACIVVPIDFAPVSSILRDRRVPERVRDLLNVEAGYNDGIVSPLFIFALVLADQDTRADTPLQALEAAVPQAAKAILVGLLVGTLLALAANGAQQRGWTTHQSNRLILVAAPLLAFGLSLAIDGNGFVSAFVCGIAFKYLRHSDDLRGDLELVDDVGFLLTVGMWFAFGVAAVAIFEVGVTLGAVVFSLLALTVVRIVPVLIGMLGTRFDLPERLLVGGLGPRGTTTIVFGLLAFNVLDGGDEHTVGLVVVLCVLGSVILHGVAAPAAAHAYAARHPASRDAEHSGPGK

SEQ ID NO: 2942 - protein, 528 aa, Pseudomonas putida
MASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGAARWFAGVLEAENVPGLDVPGIDFRALAKGYGVQALKADNLEQLKGSLQEALSAKGPVLIEVSTVSPVK

SEQ ID NO: 2943 - protein, 479 aa, Streptomyces coelicolor A3(2)
MSTELRRLRNYIDGEFRDAADGRTTEVVNPATGEAYATAPLSGQADVDAAMAAAAAAFPAWRDLVPAERQKALLKIADAFEERAEELIAAEVENTGKPIGLTRSEEIPPMVDQIRFFAGAARMLEGRGAGEYMEGLTSFVRREPIGVCAQVAPWNYPMMMAVWKFAPALAAGNTVVLKPSDTTPASTALMADIIGSIVPKGVFNVVCGDRDTGRLMVEHETPAMASITGSVRAGMSVAESASKDLKRVHLELGGKAPVVVFEDTDIPKAVEGISEAGYFNAGQDCTAATRVLVHESVHDEFVSALAKAASEIKTGQPDDEDVMYGPLNNPNQLKQVSGFIERLPAHAKVEAGGHRVGDKGYFYAPTVVSGLKQDDEIIQREVFGPVITVQAFRDEDQAVEWANGVEYALASSVWTKDHGRAMRMSKKLDFGCVWINTHIPLVAEMPHGGFKKSGYGKDLSGYGFEDYTRIKHVMTSLDM

SEQ ID NO: 2944 - protein, 269 aa, Marinobacter sp. ELB17
MFDPTTLKDKVVFIAGGTSGINLGIAKGMAAVGAKVAVLGRNADKAAAAAQEISESVKSSNGHSAIALTADVRDPDQVASALQACVAQLGKIDCLISGAAGNFPAPAVGISPKGFKTVIDIDLLGTYNVFHLGFQHLNKGASLIAISAPQAVSAMPFQVHVCAAKAGINMMIKCLAVEWGASGITVNGISPGPISGTEGAERLAPTPETKAIMAKKIASKRFGEAKEIADAAIFLASDMGHYMNGTIMTVDGGTELGDASMDCLSVPSR

SEQ ID NO: 2945 - protein, 419 aa, Mycobacterium sp. MCS
MPASPQSLCAFIDASPSPFHVCGTVADRLRDAGFTELAEGDAWPSAAGDYFTVRAGSLVAWRAGENPHAPFRIVGGHTDSPNLRVKQHPDRFVSGWRIVALQPYGGAWLNSWLDRDLGISGRLSIRAGDSLEHRLIRIDEPILRVPQLAIHLSEDRKGVSLDPQRHVNAVWGVGGSARSFLGYIADRAGVAEDAVLAADLMTHDLAPSTLVGADRELVSAPRLDNQATCYAGLEALLAAQPRDVVPVLALFDHEEVGSTSDHGAQSELLPTVLERITLAAGGHREDLLRRMSGSVVASGDMAHATHPNYPERHEPGHLIEVNAGPVLKVQPNLRYATDGRTAATFALACAQAGVPMQRYEHRADLPCGSTIGPMTSARTGIPTVDVGAAQLAMHSAREVMGADDVAAYSAALQAFLSPA

SEQ ID NO: 2946 - protein, 375 aa, Oceanobacillus iheyensis HTE831
MGKRDYYEILGIDKSASQDEIKKNYRKLARKYHPDVNKEADAAEKFKEVKEAYEVLSDDQKRAQYDQFGHSGPQSQGFGGFGGGAQDFGGFGDIFDMFFGGGGRSRDPNAPQQGNDLQYTMILDFEEAVFGKETDIEIPKEESCDTCNGSGAKPGTKPETCSHCHGSGQLNQEQNTPFGRVVNRRVCNYCQGTGKIIPDKCNTCGGSGTVQKNKKIHISIPAGIDEGQQIRVAGKGESGKNGGPAGDLFVVIKVRPHDFFVREGDHIFCELPLTYAQAALGDELEVPTVHGKVKVKVPAGTQTGKTFRIKGKGAPNVRGRGHGDQHIKIKVMTPTNLSEKQKDLLREFNELGGNESTDEQDDNIFQRFRRAFKGE

SEQ ID NO: 2947 - protein, 244 aa, Nitrosomonas europaea ATCC 19718
MTNSTHFGFTTVSETEKARKVAEVFHSVAARYNLMNDLMSMGLHRLWKRFAIDVSGAKPGDKVLDIAGGTADLTRLFLEKTGSTGEVWLTDINNSMLSIGRDRMLNDGKSVPVAQCDAEKLPFPDNYFDRVCVAFGLRNMTHKDAALREMWRVLSPGGSLIVLEFSKVWKPLQPLYDTYSFKALPFMGKIVARDDTSYRYLAESIRMHPSQEELKQLMQQAGFERVEYFNLTAGVVALHRGYKF

SEQ ID NO: 2948 - protein, 197 aa, Zea mays
VITKFCSERIAKYAFEYAYLNNRKKVTAVHKANIMKLADGLFLESCREVAKKYPGIQYNEIIVDNCCMQLVAKPEQFDVMVTPNLYGNLVANVAAGIAGGTGVMPGGNVGQDHAIFEQGASAGNVGNEKIVEKKRANPVALLLSSAMMLRHLQFPSFADRLETAVKRVIAEGKYRTKDLGGTSTTQEVTDAVIAKLG

SEQ ID NO: 2949 - protein, 498 aa, Eustrephus latifolius
MRINPTTSGPAVSTLEEKNLGRIVQIIGPVLDVVFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEMENNLKK

SEQ ID NO: 2950 - protein, 149 aa, Triticum aestivum
ANFAEADSFFCFVELLSGLRDNFCQKLDNSVVGIRGTLSKLSQLLKKYDGELQHHLEITTEVNPQFYAFRWITLLLTQEFNFADIIHIWDTLLSDPDGPQETLLRICCAMLILVRKRLLAGDFSSNLKLLQSYPPTNIGHLLYVANKLQ

SEQ ID NO: 2951 - protein, 394 aa, Glycine max
EVGVDVDVDGDGDGDGDDDVDGDVDGDDEVEKKEGRNSGGTHHYPLRPEAEDCAFYMKTGNCKFGFNCKFNHPIKRKSQAVKEKAGEREETTERSGMTECKYYQRSGGCKFGKSCKYNHTRGKISTAPAPLLELNFLGLPIRPGERECPYYMRTGSCKFGANCKFNHPDPTAVGGGGGNPPSGYGNGGSISLQGVSQTSVPSWSSPRTLNEASPFVPMMLSPTQGVSTQSSDWNGYQASVYLPERSIHPPSTFVMNNPAIDTNVYMHHQKQMPVDEFPERPGEPECSYFLKTGDCKFKSNCKFHHPKNRVARLPPCNLSDKGLPLRPDQSVCSHYSRYGICKFGPACKFDHPINLQPVMIPGLEQQSYSNSASAGVAGIGGSTGVTDATIQQSV

SEQ ID NO: 2952 - protein, 734 aa, Bacteroides thetaiotaomicron VPI-5482
MDSILFWLVPVASVLALCFAYYFHKQMMKESEGTPQMIKIAAAVRKGAMSYLKQQYKIVGCVFLGLVILFSIMAYGFHVQNVWVPIAFLTGGFFSGLSGFLGMKTATYASARTANAARNSLNSGLRIAFRSGAVMGLVVVGLGLLDISFWYLLLNAVIPADALTPTHKLCVITTTMLTFGMGASTQALFARVGGGIYTKAADVGADLVGKVEAGIPEDDPRNPATIADNVGDNVGDVAGMGADLYESYCGSILATAALGAAAFIHSADTVMQFKAVIAPMLIAAVGILLSIIGIFSVRTKENATVKDLLGSLAFGTNLSSVLIVAATFLILWLLQLDNWIWISCAVVVGLLVGIVIGRSTEYYTSQSYRPTQKLSESGKTGPATVIISGIGLGMLSTAIPVIAVVVGIIASFLLASGFDFSNVGMGLYGIGIAAVGMLSTLGITLATDAYGPIADNAGGNAEMAGLGAEVRKRTDALDSLGNTTAATGKGFAIGSAALTGLALLASYIEEIRIGLTRLGTVDLSMPNGDVVSTANATFVDFMNYYDVTLMNPKVLSGMFLGSMMAFLFCGLTMNAVGRAAGHMVDEVRRQFREIKGILTGEAEPDYERCVAISTKGAQREMVIPSLIAILAPIATGLIFGVTGVLGLLIGGLSTGFVLAIFMANAGGAWDNAKKYVEEGNFGGKGGEVHKATVVGDTVGDPFKDTSGPSLNILIKLMSMVAIVMAGLTVAWSLF

SEQ ID NO: 2953 - protein, 546 aa, Geobacillus kaustophilus HTA426
MKTYRMTVQGMTCTGCEQHVARALEAIGAKLMDVSFRRGEVVFALPEGTDVDMARQAVKNAHYEPGEAEEITASARSVIDGEGEYDYMIIGSGGAAFSSAIEAVKYGAKVAMVERGTVGGTCVNIGCVPSKTLLRAGEIYALARNHPFLGLHTSAGPVDLAPLVKQKNELVEQLRQAKYADLIGEYGFDFIQGEARFIDRQTIEVNGQTLSAKRFLIATGASPAVPDIPGLHDVDYLTSTTLLELKKVPKRLAVIGAGYIGMELGQLFHHLGSEVTLMQRSSRLLKEYDPEISEAVARALTEQGIRVITGASFERVEQDGNTKKVYVNVDGRTRVIEADELLVAAGRTPNTAALNLPAAGVEVGARGEILIDEYTRTTNPSIYAAGDVTLGPQFVYVAAYQGAVAAANAIGGLNKRWDTAVVPAVTFTHPAIATVGLTEQRAKENGYDVKTSVLPLEAVPRAIVNRETTGVFKLVAEARTGKLLGAHIVADNAGEVIYAAALAIQFGLTIDDLRHTLVPYLTMAEGLKLAALTFDQDVSKLSCCAG

SEQ ID NO: 2954 - protein, 311 aa, Burkholderia sp. 383
MTKTFPRLIVFGEALTDFIRDDAQHWHSVAGGSCWNVARVGARLGVPTAFAGTVSRDTFGDELMRKSADAGLDLRFIRQVDRAPLLAMVVSKQPPHYFFIGENSADLAFDPADLPAGALDAAEIVHVGSLGVVREPLASRLIEVAHAARAAGKRISFDPNFRAPMAAPSYRDTLRKLAGLADWIKVSDEDLRGLFPELDEAAALAQLRTWAPDATMLVTRGASGMQLLHRDTVLFQPAFPTAVADTVGCGDASIGGWLASQLARPDASDAEHLRYAAACAAVACAHAGAYAPTAAEVTDMIDRSADAAVSQ

SEQ ID NO: 2955 - protein, 459 aa, Vibrio vulnificus YJ016
MTAPFNTLSLKPELLSTLDSLGYTEMTPIQAQSLPLVLDGKDVIGQGKTGSGKTATFALGLLSNLNVSRFRVQSLVLCPTRELADQVATEIRTLARGIHNIKVLTLCGGMPMGPQILSLEHGAHILVGTPGRILDHLSKGRIDLAELNTLVLDEADRMLEMGFQDAIDAIIDAAPTQRQTLLFSATFPEQIETIASKVMQNPEMVKVESTHQKSTIEQRFYQLESTEERDNALEALLLTHRPESTVVFCNTKKEVQNVTDELNHRRFSVIELHGDMEQRERERALTMFANKSISILVATDVAARGLDVDNLDAVINFELSRDPEVHVHRIGRTGRAGAKGIAISFFSEKELYRVERIEEYMGIDVHPAKLPQPENPKPYYPSMRTIQILGGKKQKVRAGDILGSLTKEAGIDGKLIGKINILPMVSYVAIDNSVAKIAEQQLQNGKMKGRNFKARIMKG

SEQ ID NO: 2956 - protein, 272 aa, Vibrio fischeri ES114
MDSTLSHLIPEVINIARASGQLILDIYEKGDFEEFIKSDETPVTSADLAAHKLIIEKLSQLTPDIPILSEEDAGISLEQRAQWERYGLVDPLDGTQEFIARSGDFATIIALVENNRPVMGVVYGPVSGVTYYAYEGKGAWKIPDMDESVRISTLKHEDEKQPIAIAISRRQDINNITRCMSSDWNYDLVPLGSAALKACLVAEGAVDCYLRLGPTGEWDTAATQCIVQEAGGRILSTELEPLSYNERESLENPNFIVLGDENLPWNNILTCK

SEQ ID NO: 2957 - protein, 501 aa, Suaeda liaotungensis
MSIPIPSRQLFIDGEWREPIKRNRLPIINPSTEETIGEIPAATAEDVEAAVSAARRALKRNKGRDWAATSGAHRARYLRAIAAKVSEKKDHFVKLETMDSGKPLDEAVLDIDDVSTCFEYFADQAEALDNKQKYPVKLPMDRFKSHVLRQPIGVVGLISPWNYPLLMATWKIAPALAAGCTAVLKPSELASVTCLEFGEVCNEVGLPPGVLNILTGLGPDAGAPLVSHPDVDKVAFTGSSATGSKVMGSAAQLVKPVTLELGGKSPIIVFEDVVDLDVAAEWTIFGVFWTNGQICSATSRLLVHESIAAEFVEKLVKWSKKIKISDPFEEGCRLGPVISKGQYDKIMKYISTAKSEGATILCGGSRPEHLKKGYFIEPTIVTDITTSMQIWKEEVFGPVLCVKTFSTEEEALELANDTEYGLAAAVFSKDLERCERVTKALEVGAVWVNCSQPCFCHAPWGGVKRSGFGRELGEWGIENYLNIKQVTSDISDEPWGWYKSP

SEQ ID NO: 2958 - protein, 293 aa, Rickettsiella grylli
MKKLTPLEAHVILSKGTEPPYSGKYVRFNKQGDYACKQCGSLLYHSSAKFDSGSGWPSFDDEITGAIKRVPDPDGHRTEIVCQRCGAHLGHVFQGERLTPKNIRHCVNSISLEFIPKEFNKKTLEKKEKEKAYKKETAIFAGGCFWGVEHLMKQLPGIISITSGYIGGHTSNPSYEEVCTRNTGHAEAVEIIFDPQKVSYETLAKHFFEIHDPEQLNQQGPDSGEQYRSEIFYTNPEQKEIALKLIKQLKNKGFQVVTTLTPATKFWKAEDYHQNYYEKTKKQPYCHFYTKKF

SEQ ID NO: 2959 - protein, 504 aa, Bacteroides thetaiotaomicron VPI-5482
MSKKALLMILDGWGLGDQKKDDVIFNTPTPYWDYLMNNYPHSQLQASGENVGLPDGQMGNSEVGHLNIGAGRVVYQDLVKINRACADNSILQNPEIVSAFSYAKENGKSVHFMGLTSNGGVHSSMVHLFKLCDISKEYGIDNTFIHCFMDGRDTDPKSGKGFIEELSAHCEKSAGKIASIIGRYYAMDRDKRWERVKEAYDLLVNGQGKKATDMVQAMQESYDEGVTDEFIKPIVNANCDGTIKEGDVVIFFNYRNDRAKELTVVLTQQDMPEAGMHTIPGLQYYCMTPYDASFKGVHILFDKENVANTLGEYIASKGLNQLHIAETEKYAHVTFFFNGGRETPFDNEDRILVPSPKVATYDLKPEMSAYEVKDKLVDAINENKYDFIVVNFANGDMVGHTGIYEAIEKAVVAVDACVKDVIEAAKAQDYEAIIIADHGNADRALNEDGTPNTAHSLNPVPCVYVTGNKAAKVEDGRLADVAPTILKIMGLEAPADMNGQILIK

SEQ ID NO: 2960 - protein, 167 aa, Saccharomyces cerevisiae
MSRKLKKTNLFNKDVSSLLYAYGDVPQPLQATVQCLDELVSGYLVDVCTNAFHTAQNSQRNKLRLEDFKFALRKDPIKLGRAEELIATNKLITEAKKQFNETDNQNSLKRYREEDEEGDEMEEDEDEQQVTDDDEEAAGRNSAKQSTDSKATKIRKQGPKNLKKTKK

SEQ ID NO: 2961 - protein, 158 aa, Arabidopsis thaliana
TCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNNSNRKVKSKG

SEQ ID NO: 2962 - protein, 255 aa, Arabidopsis thaliana
LSSLSLLTMATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNNSNRKVKSKG

SEQ ID NO: 2963 - protein, 480 aa, Neisseria meningitidis FAM18
MKQLAMYINGRFENDFNGEWRDVLNPSTEETIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVVAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 2964 - protein, 487 aa, Synechococcus sp. WH 5701
MVHLHEMLLWSEFHPTFCPVMTVRTICCIGAGYVGGPTMAVIADRCPQIQVTLVDLNAERIAAWNDADLGRLPVYEPGLADVVARCRGRNLHFTTEVDGAIAAADMVFLSVNTPTKRRGLGAGQASDLRWIEASARQVAAQARGHTIVVEKSTLPVRTAETIQAILSAAQEGTEGEAKSFSVLSNPEFLAEGTAISDLENPDRVLIGGDDPGSIDALAEIYSHWVNPERILRTNLWSSELSKLTANAFLAQRISSINAIGALCEATGADVKEVARAIGSDSRLGSKFLSAGPGFGGSCFRKDILNLVYLCRHYGLEPAAQYWEQVVELNSWQQRRIARLVVSRLFGTVSGKRLAVLGFAFKADTNDTRESPAISICRDLLEEGAHLAIHDPKVGVDQITSDLGQGASDPGLGLADEGSWQPAAGVLEAVEGADAVIVLTEWGQFAQLDWPAIAARMRRPAWLFDVRAVTDAEAARMAGLRVWLVGEG

SEQ ID NO: 2965 - protein, 504 aa, Sinorhizobium meliloti 1021
MLSNFIAPDSNDPRLRIKSRYQMLVDGKSVDAASGSTIDRVSPGHAGEVVGTWPEASADDVRKAVAAARKAFDAGPWPRMSGAERSRLMFKVADLILARQEELALIESLEVGKPIAQARGEIGFCADLWSYAAGQARALEGQTHNNIGDDRLGLVLREPVGVVGIITPWNFPFIIASERVPWAIGSGCTVVLKPSEFTSGTSIRLAELAREAGIPDGVFNVVTGYGDPAGQVLAEDPNVDMVAFTGSVRVGTKLGEIAARTVKRVGLELGGKGPQIVFADADLDAAADGIAYGVYHNAGQCCISGSRLLVQEGIRDALMERLLDISRKVAFGDPLNERTKIGAMISEAHAEKVHSYVTAGITSGAELLLGGERIGREAGLYYAPTVFAGVTPDMSIAREEIFGPVLSTLTFKTADEAVALANATEFGLSASVWSTNLETALQTIRRIRAGRCWINSVIDGTPELPIGGYKKSGLGRELGRYGFDEYSQFKGVHVTLGRPAPWFT

SEQ ID NO: 2966 - protein, 339 aa, Synechococcus sp. WH 5701
MLVTGAAGFVGAAVTEALLRRGERVVGLDNLNAYYDPALKRARLSRLQCMPAPDQGGGFRFRQLDLEDGSAMAELFESERPRAVIHLAAQAGVRYSIENPSAYIHSNLVGFGNILEGCRHHGVEHLVYASSSSVYGGNRRMPFSEQHPVNHPVSLYAATKKANELMAHTYSHLYGLPATGLRFFTVYGPWGRPDMAPMLFAKAILAGEPIRVFNHGRMERDFTYIDDIVEGVIRCLDKPATPDPSFDPLDPNPATAAAPHRLFNIGNSQPTPLLRFIEVLEDALGVKAIPQFEPMQPGDVAATAADTSALEAWVGFAPHTPLEVGIGHFARWYRDYYGV

SEQ ID NO: 2967 - protein, 191 aa, Magnetospirillum magnetotacticum MS-1
MGFKCGIVGLPNVGKSTLFNALTQTAAAQAANYPFCTIEPNVGEVAVPDPRLDDLARIAGSKEIIPTRLTFVDIAGLVRGASKGEGLGNQFLANIREVDAIAHVVRCFEDGDVTHVDGKVDPIADIETIETELMLADLDSLEKRVVALEKRAKGSDKEARVLDLSTAPPVCGRQARPAVERKPERRCSTAR

SEQ ID NO: 2968 - protein, 471 aa, Oryza sativa
MDKKQGFFSALREEVARGLSPARARRRSQAAAAAEVAAALRYAGGGGGGEMLAPLMEGPDPESGDGGRSSSSAAAARREGWGRWVRGQLSRAPSTAGAAVVAAGGGGGAARRNDLRLLLGVMGAPLAPVHVAAGEALPHLSIKDTPIETSSAQYILQQYLAASGGQKLLSSVRNSYAMGKVRMVATEFETGGRVVRNRMAARATESGRFVLWQMAPEMWYIELAVGGSKVHAGCNGKLVWRHTPWLGAHSAKGPVRPLRRALQGLDPLTAASMFAGARCIGERKVNGEDCFILKLCADPETLRARSEGLAEIIRHVLFGYFSQKTGLLVHLEDSHLTRIQSTTGGDAVYWETTINSFIEDYRPVEGIMVAHAGRSAVTLFRFGEVAMSHTKTRMEEAWSIEEVAFNVPGLSIDCFIPPTDIKSGSISETVELPHGEKSKVGLLQCHSAKVAALEKADDNVAWSGALQRDFK

SEQ ID NO: 2969 - protein, 448 aa, Sinorhizobium meliloti 1021
MNVDEKLEPILAEVLRRNGGEHEFHQAVREVLESLGRVIAKHPRYAENALIERICEPERQIIFRVPWVDDKGQVQINRGFRVQFNSALGPYKGGIRFHPSVNIGIIKFLGFEQTFKNALTGMPIGGGKGGSDFNPRGRSDGEIMRFCQSLMTELHRHLGEYTDVPAGDIGVGGREIGYMFGQYKRLTNRYEAGVLTGKALFYGGSRARKEATGYGATYFVQRMIATKGLDFEGKRVTVSGSGNVAIYTMEKVIEFGGKIVACSDSNGYVVDEDGIDLELVKEIKEVRRERISEYARLKGAGTHYIEAGSVWDVPCDVAMPSATQNELTGKDARTLVKNGVLAVGEGANMPCTPEAVRIFQEAGVLFAPGKAANAGGVATSALEMQQNASRDSWTFEQTEARLATIMQAIHDRCAETAEEYGTPGDYVLGANIAGFVRVAEAMDALGVI

SEQ ID NO: 2970 - protein, 327 aa, Physcomitrella patens subsp. patens
MSRDDEGIQWGQQHVRVRDHETRQRTSLSPNPPPKFQQDDVYIPVKACYISRSVDLKRLSEEPFLEITPSRNNLIIRFTNRPANAKPTSNRPGFAEISRSQDRYMVAFQYGSIVFFNFCDDEEEEALSALSKFCTDKFRETRKDDYGVLVRPTLRQWSEGGQDRIMLRMLDTDNIRVISSILGQSIALDHYAKKVDEMVNTFSELNRGMENTGTFTMTRKSLFQLVAAANTTLADVILRLGLLERSDAAWKDANYAQIWEYLRDDFELDERFESLDFKLNIIQHNVRFFLEILQNRKSDTLEWIIILLITGEICVGVYQILLETNVV

SEQ ID NO: 2971 - protein, 355 aa, Aggregatibacter actinomycetemcomitans
MLKTILVTGGAGFIGSAVVRYIIENTQDSVVNVDKLTYAGNLESLEAVKNNPRYTFEQVDICDAKALARIFQQHRPDAVMHLAAESHVDRSIDGPAAFIETNIVGTYILLEAARAYWNSLNDEKKAVFRFHHISTDEVYGDLDGTNNLFIETTPYSPSSPYSASKASSDHLVRAWLRTYSLPTIVTNCSNNYGPFHFPEKLIPLIILNALDGKPLPVYGNGQQIRDWLFVEDHARALYKVVAEGKIGETYNIGGHNEKANIDVVRTICALLEELVPNKPAGVTKYEDLITYVKDRPGHDVRYAIDATKISRELGWKPQETFESGIRKTVEWYLNNRKWWSRVLDGSYNRERLGSQ

SEQ ID NO: 2972 - protein, 297 aa, Nitrosomonas europaea ATCC 19718
MHPDFQSWASEQLALVETCLEKHLPETNCAPARLHDAMRYSVLGGGKRVRPLLSFAAGELSGADKTHATIAGAAVELIHVYSLVHDDLPCMDNDTLRRGKPTCHVRYDEPTALLVGDSLQSLAFQLLTETNLTEDPHVQLEMVRHLAFAAGSRGMAGGQAIDLDSVGKTLSLPELEFMHIHKTGALIRAAVILGARCGNRLDETQFKLLDHFAKCMGLAFQVIDDILDTEATTAALGKTAGKDAENNKPTYVSILGIKQARELAHELRQEATGVLNQFGSEALRLQQVTDFIVQREF

SEQ ID NO: 2973 - protein, 614 aa, Nitrosomonas europaea ATCC 19718
MYPLLDRIEIPAQLRTLKRNQLPQLADELRNFLVESVAGTGGHLSSNLGTVELTIALHYVFDTPFDRLIWDVGHQTYAHKILTGRRTGMARLRMQGGIAGFPRRDESEYDAFGTAHSSTSISAALGMAVAARLKGVKQHAIAVIGDGAMSAGMAFEALNNAGVMDANLLVILNDNDMSISPPVGALNNYLAKLMSGRFYATARRAGEKMLGVVPPVLELAKRAEEHVKGMVTPSTLFEEFGFNYIGPIDGHDLDILLTTLNNIKQLDGPQFLHVVTRKGKGYKQAEEDPILYHGVGKFQPDQGIVSKPSAKLAYTQIFGDWLCDMAAKDSRLIGITPAMREGSGLVRFSKEYPDRYFDVGIAEQHAVTFAAGAACEGLKPVVAIYSTFLQRAYDQLIHDVAIQNLPVVFAIDRAGLVGADGPTHAGSFDLSYLRCIPNITVMTPADENECRQMLYTAFQLDTPAAVRYPRGSGPGVQIQQEMQTIPLGKGEIRRQGKQIALLAFGSMLTPCLEAGDELDATVVNMRFVKPLDQELVATLAAEHELLVTIEENTIMGGAGSAVMESLSSLDKNVRLLQLGLPDSFIDQGDPAHMLSDCGLDKAGIIQSIKERFSL

SEQ ID NO: 2974 - protein, 231 aa, Burkholderia sp. 383
MTQDELKRLVGQAAADYVIQNVPEGAVIGVGTGSTANCFIDALAVVKARYRGAVSSSVATTERLKSHGIKVFDLNEVDSLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAERGANLCLLGTENGVETIVYSAN

SEQ ID NO: 2975 - protein, 161 aa, Gossypium hirsutum
RIIVQYIDEVWPSAPILPSDPHERATARFWAAYLDDKWFPSLRAIGMAEGEDARKAAIGQVEEGLMLLEEAFGKCSQGQAFFGKDQIGYLDITFGCSLGWLRVTEKMSGIKLLNEINTPALLKWANRFCNDAAVKDVMPETEKLAEFAKMLRGRVRATPTS

SEQ ID NO: 2976 - protein, 139 aa, Brassica napus
MTVSDAYRPPLFSIAPMMGWTDNHYRTLARLISKHAWLYTEMLAAETIVYQEDNLDSFLAYSPDQHPIVLQIGGRNLDNLAKATKLANAYGYDEINFNCGCPSPKVSGRGCFGAVHMLNPKFVGEAMTVIAANTNASVT

SEQ ID NO: 2977 - protein, 266 aa, Picea glauca
MAIGSYDRQALEYVNGRPQYPPQLFSFIAKHSPHRRLAWDVGTGSGQAALALSEMFERVIATDVSEQQISYAPRRPNITYAVTPRAMSLQELESTVGEEGSVDLVTVAQALHWLDLDTFYGHVKHVLRKPGGVFAALCYREPVVNPSVDCVFEEVFRASVAFGDPPRKMVDEGYATVCFPFRSVVQEGSEEGESTTAPIKFWPKKEMGLEPYLNYMRSWHAYQKAKATGVDLLDEQTVARFKDAWAESENDAKTVSFPVFLRIGVV

SEQ ID NO: 2978 - protein, 356 aa, Robiginitalea biformata HTCC2501
MSADRYDRQTRLEDFGPEGQRALSEAAVLIIGAGGLGVPAATYLNAMGIGRLGLVDGDVVETSNLHRQPAYGPASVGMAKVRELEKVLRAQNPDTQLDIRDTFLNPTNALELIGNYDLVVDATDNLPTRFLVDDACLMLGIPWVYGALHGFEGQVSVFNYRGGPTYRCLFPVPPPAGEIPDCDTLGTLGVLPGLIGTMQALEAVKAICGQEGVCAGKLLLYDARKQQTLHIAIQKDANRTVPDDLSATYQLSCEGKPDAVSGSEYLRLRKEGAAHLLVDVREPGEFESHHLDGARNIPMKRIASDAPDFSSGNPVYLICETGPRSRRACRELQSRWPSTPFFWISGGMRQLKVESQ

SEQ ID NO: 2979 - protein, 522 aa, Beta vulgaris
MDASAAAINVNAHLTEVGKKRFLGERISQSLKGKDLRALFSRTESKGRNVNKPGVAFSVLTSDFNQSVKESLKYEPALFESPKADPKNVAAIVLGGGAGTRLFPLTSRRAKPAVPIGGCYRLIDVPMSNCINSGIRKIFILTQFNSFSLNRHLARTYNFGDGVNFGDGFVEVFAATQTPGESGKKWFQGTADAVRQFFWAFEDSKSKDVEHIVILSGDHLYRMDYMSFWQKHIDTNADITVSCIPMDDSRASDYGLMKIDHTGRIVHFAEKPKGSDLTAMQVDTTVLGLSDLEAMSNPYIASMGVYVFRTDVLMELLNRKYPSSNDFGSEIIPSAVGESNVQAYLFNDYWEDIGTIKSFFDSNLALTQQPPKFEFYDPKTPFYTSARFLPPTKVDRCKIVDSIVSHGCFLQESSIQHSIVGVRSRLESGVEFQDTMMMGADYYQTESEIASLLAEGKVPVGVGQNTKIKNCIIDKNAKIGKDVVIANTDGVEEADRPNEGFYIRSGITIILKNATIQDGLVI

SEQ ID NO: 2980 - protein, 523 aa, Hordeum vulgare
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2981 - protein, 91 aa, Picea glauca
MEQHQDRRELDAKARVGEPVVPGGTGGKSLDAQERLAEGRSRGAQTRKEQIASEGYQEMAPKGGLSSAGGPGGERASEEGRPIDESKYRHP

SEQ ID NO: 2982 - protein, 516 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 2983 - protein, 88 aa, Zea mays
MSALTLGEDDLNGKKVFVLADVNVPLDDAQKITDDTLIRAFVPTIKLLLEKGAKVILVRHLGPRKGVTPKYRLTPLVPRLSELLGVSV

SEQ ID NO: 2984 - protein, 262 aa, Zea mays
MAKAFYAVGFWIRETGQALDRLGCRLQGNYFFHEQISGHRTLMNIFDKAPHVHKEAFVAPSASLIGDVEVGQGSSIWYGCVLRGDANNVQVGSGTNIQDNSVVHVAKSNLTGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPLEKIDFEKVLRKKFTHHDEEHDSMLSGTREVPPELAPPSPTPAQ

SEQ ID NO: 2985 - protein, 444 aa, Streptomyces coelicolor A3(2)
MTALPQERRVVTAIPGPKSQELQARRTAVVAQGVGSTLPVFVARAGGGVIEDVDGNRLIDFGSGIAVTSVGASAEAVVRKASAQLADFTHTCFMVTPYEGYVAVAEALAELTPGDHAKKSALFNSGAEAVENAVKIARAYTKRQAVVVFDHGYHGRTNLTMALTAKNMPYKHGFGPFAPEVYRVPVAYGYRWPTGAENAGPEAAAQAIDQISKQVGAENVAAVIIEPVLGEGGFIEPAKGFLPAIREFASDNGIVFVADEIQSGFCRTGQWFACEDEGIVPDLITTAKGIAGGLPLSAVTGRAEIMDAAHSGGLGGTYGGNPVACAGALGAIETMKELDLNARAKDIEAVMKSRLAAMAEKFDVIGDVRGRGAMIAIELVKDRETKEPNPAATAALAKACHQEGLLVLTCGTYGNVLRFLPPLVIGEDLLNEGLDIIEQAFTRV

SEQ ID NO: 2986 - protein, 519 aa, Solanum tuberosum
MDALCASMKGTAQLVAICNQESAFWGEKISGRRLINKGFGVRSCKSFTTQQRGRNVTPAVLTRDINKEMLPFEESMFEEQPTADPKAVASVILGGGVGTRLFPLTSRRAKPAVPIGGCYRLIDVPMSNCINSGIRKIFILTQFNSFSLNRHLATYNFGNGVGFGDGFVEVLAGTQTPGDGRKMWFQAADAVREFIWVFENQKNKNVEHIIILSGDHLYRMNYMDFVQKHIDTNADITVSCVPMDDGRASDFGLMKIDETGAIIQFAEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTECEIASLLAEGKVPIGVGPNTKIQNCIIDKNAKIGKDVVILNKEGVEEADRSAEGFYIRSGITVIMKNATIKDGTVI

SEQ ID NO: 2987 - protein, 470 aa, Mycobacterium sp. MCS
MTHPDTVREQPELRRVMGPGLLLLFVVGDILGTGVYALTGDVAAEVGGAAWLPFLVAFLIATITAFSYLELVTKYPQAAGAALYAHKAFGLQFVTFLVAFVVMCSGITSASTASRFFGANLIEGFGLEWGTAGVAAVALGFMALLAAVNFRGVGESIKLNVVLTIIEATGLMLVLFVGLWAFTRGGDVDFSRVVAFDTAGDKNAFMAVTAATSLAFFAMVGFEDSVNMAEETKDPVKTFPKVLLSGLTIAGIVYMLVAVVAVALVPVGRLEESDTPLVEVVKAGAPNLPIDTLFPFISMFAVSNTALINMLMASRLIYGMARQHVLPPVFGTVHPRRLTPWVAIVFTTLIAFGLIFYVSVFASSSAISVLGGTTSLLLLAVFAVVNVAVLRLRRDVQAGGAHFKTPTVMPVVGFIASLYLVLPFSGRPAQQYYVALILVAIGIVLFFINRLINRRLGVRDTEITDPTHLA

SEQ ID NO: 2988 - protein, 542 aa, Zea mays
MAASARTTSSLPYLVAVSSPAAHRHGASHPIRASVGEATMDVVSEAELREKGFLGMRKTKLVCTVGPACVEALPALARGGMGVARINLCHGGREWHRAAMRSVRRLNEEGGFCVTLMVDTEGSQLLVADHGGATSVKAEDGSEWIFTNKKADEAHQFTMHVNFDKFSEGILVGDELVIDGGMATFEVTEKIGNDLRCKCTDPGLLLPRAKLSFWRNGKIVQRNFGLPTLSTKDWADIEFGIAEGVDCIALSFVNDANDIKQLKAYLSRRSLEHIKVFAKIESLESLKNLKDIIEASDGVMVARGDLGVQIPLEQIPAIQESIVKLCRHLNKPVIVASQLLESMVEYPTPTRAEVADVSEAVRQYADAVMLSAESAIGAYPQKALSVLRAASERMESWSREENMQKLLPRHQLAIALPDRISEQICSCAVEMANNLAVDAIFVYTKHGHMASLLSRNRPNPPIFAFTDNANSRKSMNLYWGVIPLHLPLSNSMEDNFNKTISLMRSKGSVKPGDTVLVVSDSDLNQPCAATSVFQSIQVRLVE

SEQ ID NO: 2989 - protein, 204 aa, Picea mariana
MSIFEYNGSALVAMVGKNCFAIASDRRLGVQLQTIATDFQRIFKIHDKLYVGLSGLATDVQTLYQRFAFRHKLYQLREERNMRPETFASLVSALLYEKRFGPYFCQPVIAGLGEDDKPFICTMDSIGAKELAKDFVVAGTAAESLYGACESMYKPDMEPEELFETISQALLSSIDRDCLSGWGGHVYVVSPNQVIERTLKGRMD

SEQ ID NO: 2990 - protein, 223 aa, Petunia x hybrida
MTKQQANWSPYDNNGGTCVAVAGADYCVIAADTRMSTGYNILTRDYSKIIKLADKCVMASSGFQADVRALQKVLASRHLIYQHQHNKQMSCPAMGQLLSNTLYYKRFFPYYSFNVLGGLDSEGKGCVFTYDAVGSYERVGYSSQGSGSTLIMPFLDNQLKSPSPLLLPAQDAVTPLSEAEAIDLVKTCFASATERDIYTGDRLEIVILNASGIRREEMELRKD

SEQ ID NO: 2991 - protein, 375 aa, Nocardia farcinica IFM 10152
MDKVVLDALADRSAALVGAPVAARYPHSLIGNTPVLWVGAPLAPQGRGFWAKLEGFNPGGMKDRPALHMVRKAEQRGDLAPGARIIESTSGTLGLGLALAGIATHHPVTVVTDPGLEPIVARMLTAYGTQVDVVTEAHPTGGWQQARRDRVAELLAGEPDAWCPDQYSNPDNVDSYESLALELVEQLGEVDVLVCAVGTGGHSAGVARVLRRFNPGMKLIGVDTVASTIFGQPAGLRLMRGLGSSIYPINVDYDAFDEVHWVAPSEAVWACRTLAATHHATGGWSVGAVGLVAGWAARTHDADTRIAAVFPDGPHRYFDTVYNDTYCEEHGLLDADPPVEPDTIAHPAERVVRSWTRCTTVVDPRQFIHDREPAS

SEQ ID NO: 2992 - protein, 262 aa, Cryptococcus neoformans var. neoformans JEC21
MAASRVDILNDGGLRQDARRPYELRSTSFQLSTHSSSDGSSTATQGLTTVEVSVFGPREPRNRGLASHDRAVVSVEVGVVPWAAGAGARRTRGDKRLQEIGAAIRQTFEPVIMTHLYPRSEIAIHVQVLSADGGILPTSINATTLALIDAGIALLDYVSSISIGLHLLQPLLDLSQPEESDLPSLVIASLPSSGKITLAQMETRLHVDRFEEMLTLGVEACKVLKEEMDGVVKDRTERIVERRGIKIGGQGTGQEGEMVIDD

SEQ ID NO: 2993 - protein, 489 aa, Clostridium perfringens ATCC 13124
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKSGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 2994 - protein, 425 aa, Shewanella sp. MR-4
MSTTNDSLMARRQAAVAGGVGQIHPVFTARAENATVWDVEGREFIDFAGGIAVLNTGHLHPKVKAAVAAQLEDFSHTCFMVLGYESYIQVCEKLNQLVPGDFAKKTALFTSGSEAVENAVKVARAYTKRAGVIAFTSGYHGRTMAALALTGKVAPYSKGMGLMSANVFRAEFPCALHGVSDDDAMASIERIFKNDAEPSDIAAIILEPVQGEGGFYAASPAFMQRLRALCDREGIMLIADEVQTGAGRTGTFFAMEQMGVSADITTFAKSIAGGFPLSGITGKAEVMDAIGPGGLGGTYGGNPLACAAALAVLEVFEEEKLLERANAIGERIKSALNTMQVEHPQIADVRGLGAMIAIELMEDGKPAPQYCAQILAEARNRGLILLSCGTYGNVLRILVPLTVPDEQLGAGLGILKACFDAVLKG

SEQ ID NO: 2995 - protein, 378 aa, Shewanella oneidensis MR-1
MMLPAPHFSAFNPPRRILMGPGPSDVYPEVLAAQARPTVGHLDPLFVSMMDELKSLIQYAFQTKNEMTMAVSAPGSAGMETCFVNLVEPGEKVIVCRNGVFGERMRQNVERVGAIAVLVDNEWGTPVDPVAVEAALKAHPDAKFLAFVHAETSTGALSDAKTLCALAKQYGCLSIVDAVTSLGGVELRVDEWGIDAIYSGSQKCLSCVPGLSPVSFSPAAVEKLKNRKTPVQSWFLDQSLVMAYWTSAGGKRSYHHTAPVNALYAMHESLRILAAEGLENAWKRHQDMHLVLRAGLEKLGLKFVVAEASRLPQLNAIYIPEGVDDAAVRARLLKDYNLEIGAGLGALAGKAWRIGLMGFGARRENVALCLRALEEVLN

SEQ ID NO: 2996 - protein, 545 aa, Shewanella oneidensis MR-1
MLSLASSQTEQAESQPAQASPASVEKSQLAQHYLQKILLSSVYDVAKVTPLSSLNKLSARLGCQVFLKREDMQPVHSFKLRGAYNRIAQLSQAECQRGVVCASAGNHAQGVAMSAASRGVDAVIVMPETTPDIKVDAVRRLGGNVVLHGQAFDQANGFAMTMAQQEGRVYIAPFDDEAVIAGQGTIAQEMLQQQRDLEVIFVPVGGGGLIAGIAAYYKAVMPQVKIVGVEPEDAACLKAAMEAGEPVTLSQVGLFADGVAVKRIGTEPFRVAKLCVDAVVTVTSDEICAAVKDIFEDTRAIAEPAGALSLAGLKKYVSTNATGESGRGEKVAAILSGANVNFHSLRYVSERCELGEQKEAVLAVKVPERPGSFLRFCELLEKRVMTEFNYRFSSRDMAVVFAGIRLTKGHGELEQIINTLEDNGFEVQDLSGDETAKLHVRYMVGGHPPEPLEERLFSFEFPEHPGALLKFLTTLQSKWNISLFHYRNHGAAFGRVLAGFEVPASDALPFQQFLTELGFVYQEETQSPAYQLFLNAGKGKNNLPV

SEQ ID NO: 2997 - protein, 482 aa, Shewanella sp. MR-4
MLLKDPSLLRQQCYINGQWCDAQSKETVAIANPATGVVIASVPVMGQAETQAAIAAAEVALPAWRALTAKERGAKLRRWFELLNENSDDLALMMTSEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPTVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGITEGVTTGPLINRAAVEKVQSHLEDALSKGASVVAGGKPHSLGGNFFEPTVLTHVDSSMRVAREETFGPLAPLFKFTDVDDVIKQANDTEFGLAAYFYGRDISLVWKVAEALEYGMVGVNTGLISTEVAPFGGMKSSGLGREGSKFGIEEYLEIKYICMSV

SEQ ID NO: 2998 - protein, 43 aa, Brassica napus
REEKDIDSINDRNEHFNKKIERAFGKYTLEIKNNLERGTALTD

SEQ ID NO: 2999 - protein, 415 aa, Clostridium difficile 630
MYKTKILENGLTIIGEEIPYLKSITLGIWINAGSRIEEAQVSGTSHFIEHMMFKGTKNRTSKEIASSIDNLGGQINAFTSKECTCYYVKLIDEHIDTGIDVLSDMILNSKFDKNDIDKERLIILEELKMYEDSPDDLSYDLLVENIYANDGLGMNIIGTKESLYNITRESMLEYLNKYYIPNNAVISIAGNFNFDDMVEKIKSKFGHWEKKNLSIDISEAKFNPCFISKNKDTEQVNLAMCLKGIPFENDEEVYSMAVVNNIFGGSISSRLFQKIREEKGLVYSIYSSQTLYRKCGELGIFASMSTENLQDVYNLIKKEIENIRENYLTEKEISESKEQLKGNYILDLESTSSRMMSTGKSMLLSKKVKTTDEILECINNVNINSIKKVVDKVFNIENIGTCIVGRDVEKILHLD

SEQ ID NO: 3000 - protein, 269 aa, Clostridium perfringens ATCC 13124
MLYSLILAGGKGTRLYPLSRSSNPKQFLSIHNNGKSFLSNTVDRIRPIIHKDNIYVVTNQEYEDKIRDELKDIREENIFTEPANKETATCIGLSAAKLLKKDKDAVMIVLPSDHYIEGDKSYLQTLEQAVEIADKKRAIVTIGIEPTRPETGYGYIEMGDRVNGHIPTFKIARFTEKPNLEVAKDFLLKGTYLWNSGMFIFRADALITKMRCRSKFFRIVCIHVYPPRLNKLVVLATSYFFIMFLYILVSVITLNNKEISITITENKNI

SEQ ID NO: 3001 - protein, 166 aa, Oryza sativa
  misc_feature (114)..(114): Xaa can be any naturally occurring amino acid
PPLKLKRTRPPGGVCGGWVGSEKKTPAGPPPPPPPPPPPFSPPKNLFYLLNYNTIQGKACDAARFAAKHGCAYHRALMEKNQKYVADPPTIERCQELSKQLFYTRLASDTFLAXLPGRYEAFWKEADQVKNLWRNRKDLNVEHAGVAALGGGKKEHGGSGMVKIVG

SEQ ID NO: 3002 - protein, 309 aa, Bacillus cereus ATCC 14579
MYFNHDGGVDDLISLFLLLQMENVELTGVSVIPADCYLEPAMSASRKIIDRFGKGNIAVAASNSRGQNPFPKDWRMHAFYVDALPILNESGKVVTPVVAKPAHHHLIETLLQTEGKTTLLFTGPLTDLARALYETPIIEDKIERLVWMGGTFLTAGNVHEPEHDGTAEWNSFWDPEAVARVWDAKIKIDLVTLESTNQVPLTIDIREQWAKERKYIGMDFLGQCYAMVPPLVHFSTNSTYYLWDVLTTALVGNTNLAKTETINSIVHTYGPSQGRTEETADGRPVNVVYDVKRDVFFEYITELAKKAST

SEQ ID NO: 3003 - protein, 181 aa, Arabidopsis thaliana
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 3004 - protein, 181 aa, Arabidopsis thaliana
MASSMLSSAAVVTSPAQATMVAPFTGLKSSAAFPVTRKTNKDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 3005 - protein, 438 aa, Thermotoga sp. RQ2
MKDILKELKKKLIEEDFNKFNGRVTRVVGLTVESKGPDAFLGEMCKISLQNGKNALAEVVGFREESVILMPYEDVSGLKMGCEVIRTNKVLEVGVSRKMIGRVFDGLGRPIDGKPFVPEDRYPLTNTPPNPLKRRRIKDPLPVGIRSIDGFITVGKGQRIGIFAGSGVGKSTLLGMIARNTTADINVLALIGERGREVREFIERDLGEEGLKRSILVVSTSDQPALARVKSLLTATSIAEFFRDLGYDVLLMVDSLTRWAMAQREVGLAVGEPPTTRGYPPSVFAGLPKILERAGNSDKGSITAIYTVLVEADDFNEPISDTVRSIVDGHIILSRRLAESNHYPAVDVLASVSRLMNDIVTEEHREAANRLRSLMSAYESAKDLIEIGAYKSGTNPLVDKAVEMKDEIDSFLKQGVFEKASFEETLQKLLDLYLRSLD

SEQ ID NO: 3006 - protein, 383 aa, Magnaporthe grisea 70-15
MDDVPAAPGVGKANGNGAAPPEMPAAAIGHELPYVAPSSYLRPKPQSRIAMPESQPFGLLDRDQMQGLNGIREFLKIRTSYDVLPLSFRLIILDQDLLIKKSLNILIQNSIVSAPLWDSKNSTFAGLLTSTDYINVIQYYCQYPSRLDEVDQFRLSSLRKIEKAIGVIPPETISIHPMRPLYEACVRMNATRARRIPLIDVDDETGRETVVSVITQYRILKFIAVNNENYSQLLRKPVRECGLGTYDNIFTARMSHSVLDVINLMVSYSISSVPIVDKDNRVINVFEAVDVIPCIKGGVYDELTATVGEALARRSDDFPGIYTCFEDDRLSSIFDTLRKSRVHRFIVIDDQSHLKGIISLSDILKYVLGDEAEETDGSKDGRK

SEQ ID NO: 3007 - protein, 182 aa, Saccharomyces cerevisiae
MFKRSIIQQSRLFSNSASRLGKKVFFDPAVNGTKIGRIEFELYDNVVPKTAENFRALCTGEKGWGYKGVPFHRIIPDFMIQGGDTDLTNGFGGKSIYGSKFADENFVKKHDKAGLLSMANAGPNTNGSQFFITTVPCPWLDGKHVVFGEVTKGMDIVKAIESYGTASGKPRAEIVIEEAGEL

SEQ ID NO: 3008 - protein, 483 aa, Solanum tuberosum
MGKKLKYTKFQLRSNVVKPNICMSLTTDIAGEAKLKDLERQKKGDARTVVAIILGGGAGTRLFPLTKRRAKPAVPMGGAYRLIDVPMSNCINSGINKVYILTQFNSASLNRHIARAYNFGNGVTFESGYVEVLAATQTPGELGKRWFQGTAHAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASIGKVYVFKKDILLNLLRWRFPTANDFGSEIIPASTKEFCVKAYLFNDYWEDIGTIRSFFRANLALTEHPPRFSFYDATKPIYTSRRNLPPSAIDNSKIVDSIVSHGIFLTNCFVEHSVVGIRSRIGTNVHLKDTVMLGADYYETDAEIRSQLAEGKVPLGIGENTRIKDCIIDKNARIGKNVVIANSEGVQEADRSSEGFYMASGITVISKNSTIPDGTVI

SEQ ID NO: 3009 - protein, 158 aa, Picea glauca
METTFYSILGVNKDSSSAEIRSAYRKLAMKWHPDKWSTDPSSSETAKLRFQQIQEAYSVLSDDTKRALYDAGMYEPSEDMDAFCDFLDELSSLIATVKVQSNKDDELLQLQEMFTKMLEEDWFSTDNFEAFKEISSQHSDDKPENGQDHEPYGSVDDL

SEQ ID NO: 3010 - protein, 295 aa, Synechococcus sp. WH 5701
MRITIVGCGYVGSALASHWHQQARHWLRVTTTREERLGELAPLADAVQLLDAADPDQLHKALENTEAAVFCLAPGGSRQVDADGYEATYLRTMEAVAAVVPQLPELQQLVYTSSCSVYGEAKGLVEEDTPPQPREPHAQILRDAEALLLACRGSHRRVAIARLGAIYGPGRELEPRFRSLAGSRREGDGSSLISWIHRDDVVTALAWAVEQGFDGLINLVDDEPISVRELIDRSCHAAGLEPVIWDGDNGTSANPAAERRISNRRLRELGLGLQHPCLPILAATPGPGAEQKPAA

SEQ ID NO: 3011 - protein, 487 aa, Sinorhizobium meliloti 1021
MTFHAKFSGYADPALHAAGLYIGGKWQSGSGITVLDPSTGNLLAEVADASIEDAQRAVDAADAAAAGWRATPARQRSEILRRWYQLMTQHAEELATLIALENGKALADARGEVAYAAEFFRWYAEEATRIPGEFRHTPSGSHNILVDHEPIGIAVLITPWNFPAAMATRKIGPALAAGCTVILKPASETPLTAYAMARLGEEAGVPPGVVNVLTTSNPGGITNAMLADPRVRKLSFTGSTGVGRVLLAEAAKSVVSCSMELGGNAPFIVFDDADLEVALDGAMIAKMRNAGEACTAANRFYVQAGIHDAFVAGLTARMKSLKLGPGYDPETQCGPMITQNAVRKIDRLVSEALAAGARATTGGKPLTENGYFYPPTVLENVPVNASIAREEIFGPVAPVYKFESDDEAIRLANNTEYGLAAYIYSRDLKRAMKVGKRIETGMLGINRGLMSDPAAPFGGVKQSGLGREGGVTGILEFMEPKYFAVDY

SEQ ID NO: 3012 - protein, 806 aa, Arabidopsis thaliana
MICFILFVFSFLVSVSATAPYKPDDVFLINCGETDVPFDNHGRTWTQEEKNILPKNSDNASFSSVVSYKEESGIPQVPYMTARIFRSDFTYSFPVSPGWKFLRLYFYPTSYKSGFDAVNSFVSVTVNDFTLLQNFSADLTVKASIPESKSLIKEFIVPVYLTLNLTFRPSNNSLAFVNGIEIVSMPDRFYSKGGFDDLITNVGSLIDFEIDNSTASETVHRLNVGGHMVDEVNDSGMFRRWLSDDYEFLIGGVSPYMPDVNISYTEKTPAYVAPAYVYSTCRMMGNAQDTYLNLNFNLTWLFTVDAGFSYLVRLHFFEKYLNKANQRVFSIFLGNQMAREEMDVIRLSGGPRIPIYLDFRIYVGSESGPRPDLRLDLHPLVKDNPEYYEAILNGVEILKLNNSGNLAIIQDNELKPNPPLSSNLTPNHVTQQIKGKSSHLLVKIFIAVGPGTGLATFVVVLMLWMRQMKRKNRKEERVVMFKKLLNMYTYAELKKITKSFSYIIGKGGFGTVYGGNLSNGRKVAVKVLKDLKGSAEDFINEVASMSQTSHVNIVSLLGFCFEGSKRAIVYEFLENGSLDQFMSRNKSLTQDVTTLYGIALGIARGLEYLHYGCKTRIVHFDIKPQNILLDGNLCPKVSDFGLAKLCEKRESVLSLMDTRGTIGYIAPEVFSRMYGRVSHKSDVYSFGMLVIDMIGARSKEIVETVDSAASSTYFPDWIYKDLEDGEQTWIFGDEITKEEKEIAKKMIVVGLWCIQPCPSDRPSMNRVVEMMEGSLDALEIPPKPSMHISTEVITESSSLSDGGEDV

SEQ ID NO: 3013 - protein, 489 aa, Beta vulgaris
ITVPSTSSKNLQNSLAFSSSSLSGDKIQTTSFLNRRYCRISSRAPIVVSPKAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYERFVQAHRETDADITVAALPMDEKRATAFGLMKIDEEGRIIEFAEKPKGEQLKAMKVDTTILGLDDERAKEMPFIASMGIYVISKDVMLNLLREQFPGANDFGSEVIPGATSIGLRVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKFLAAKGSVPIGIGNARIGDDVKIINSDNVQEAARETDGYFIKSGIVTIIKDAMIPSGTVI

SEQ ID NO: 3014 - protein, 334 aa, Coccidioides immitis RS
MRGTVHLRVSLGALRAGRSSLPPQQRSLTVSYFLPFHCRRQLSFSSFADSGRVSLCAKALKTTTWGCGDSMSGSVSGFRSGTGLSCRGLLHWRRSMSSERTSEKKNDDTQKASDSKPSLASRLPIPGREDIYTIPNILTFTRLVAAPMVGYFILNSNHVMALSLFAYASITDLVDGYIARRFGQQTVVGTIIDPMADKILMTVGVICLAMKSAIPVWLAGLILARDVGLAISAIYYRWISLPPPKTMARYWDFSLPSAVVKPTRISKVNTALQLLLIGGAMAMPVIPEAILSAWNLHEGMIGLQYIVALTTCWSGLGYIYSKDAVRILSRDKSR

SEQ ID NO: 3015 - protein, 429 aa, Arabidopsis thaliana
MDCKSSDSSGTDDDLPPSHRVPRGGGGGRGGRVAGNGRPLNLPPSYPKMYDDLAADMEAQIHQIEKEAYISVLRAFKAQGDAISWEKESVITELRKELSLSNEEHRELLGRVNSDDTIRRIREWRQSGGMQPSMRNAAQVVHDTLPSPSVSASMKTHKPNQPIPSQPFASSSPSFHPQADPTHPFASSTAKRGPVPIVKGKKHKPVFPGSSSTKHAPYHPSDQPPRGQVMNRLPSVPASSSEPTNGIDPESFLGRRVRTKWPEDNTFYDAIITQYNPVEGRHALVYDIATPSETWEWVRLSEISPGDIEWIGEDPGLGNRYNGQGHGLNRTTGPNCVPQRGSGLEKNTIRKGFRTSQNGTGKKKHLDIQIRQTDVLIREVERVLRSHNPDPYEVERAKRVLEEHEHALVGAIAKLGDISDGENEGAFRR

SEQ ID NO: 3016 - protein, 451 aa, Mycobacterium sp. MCS
MTTAVVPRVSGGEEEHGHLEEFRTDPIGLMKRVRDECGDVGWFQLVDKHVILLSGAEANEFFFRSADEDLDQAEAYPFMTPIFGKGVVFDASPERRKEMLHNSALRGEHMKSHAATIEGEVKKMIAGWGEEGEIELLDFFAELTIYTSTACLIGLKFREQLDHRFAEYYHELERGTDPLCYVDPYLPIESFQRRDEARVKLVALVQEIMNQRVADPPKDKADRDMLDVLVSIKDEEGNPRFSADEVTGMFISLMFAGHHTSSGTSSWTLIELIRHPEVYAAVQQELDELYADGQEVSFHALRQIPLLDNVVKETLRLHPPLIILMRVAQGEFEVAGFPIHKGDFVAASPAISNRIPEDFPDPDAFKPDRYDKPEQADVVNRWTWIPFGAGRHRCVGAAFATMQIKAIFSVLLREYEFEMAQPPETYRNDHSKMVVQLERPAKVRYRRRVKA

SEQ ID NO: 3017 - protein, 375 aa, Mycobacterium sp. MCS
MKTKGALIWEFNQPWSIEEIEIGDPVKDEVKIRMEASGMCHSDHHLVTGGIPMAGFPVLGGHEGAGVVTEVGPGVEDLAPGDHVVLSFIPSCGRCPSCQAGLRNLCDLGAGLLGGTAVSDGTHRIHAKGQPVFPMTLLGTFSPYMVVHKSSVVKIDPSVPFEVACLVGCGVTTGYGSAVRAGDIRPGDDVAVVGVGGVGMSALQGAVNAGARNIFVIEPVEWKRDAALKFGGTHAYPDLESAFAGIAEVTQGLMAKKVIVTVGELHGNDVDNYVNLTSKGGTCVLTAIGSMLDTQVTLNLAMLTLLQKNLQGTIFGGGNPHFDIPQLLSMYKAGKLNLDDMITRQYKLEQINEGYSDMLEGKNIRGVIRYTDNDW

SEQ ID NO: 3018 - protein, 407 aa, Clostridium difficile 630
MSILVQKFGGTSVESYEKMNEVCKIVKAYKKNDEELQLVLVVSAMGRKGAPYATDTLINLCSAVNDEPSKRELDLIMSCGEIISGTILANLLNAQGIDSVFFTGQQAGIITSDEYSNAKIKYINPKKVKRALDDGKVVVIAGFQGVTDDGEITTLGRGGSDTSAVAIGKALECETVEIYTDVDGIMTADPRVEPNAKVLSFIDYEEVFQMADKGAKVIHPRAVQLAKSGNITLAIKNTMNPTFEGTKIGSLCRHLEDNIEYEQERDFKVAVANKDSVAQVKIKSAEEVFTEVLNEIEKKLITIDMINFFISEKAFVVEDADIKSLKEILDKFELDYEVNRDCAKVTLICSRIADEMSGIMSKVVRGLSKAGVSLLQTSDSNMTISCLVSEEDMHTAVHAIHQQFYLK

SEQ ID NO: 3019 - protein, 451 aa, Shewanella sp. MR-4
MNKLIAFLKERKITEVECVISDMTGIARGKIAPVDKFLDEKGMRLPESVLLQTVTGDFVDDDIYYSLLDDADIDFVCVPDENAVFMLPWTIEATAQVIHDCYDRMGNPIELSPRNVLKKVLSLYEQKGWEPVIAPEMEFYLTSRSDDHDLPLKPPIGRSGRPEAGRQSFSIDAANEYDPLFEDMYDWCELQGLDIDTLIHEDGPAQMEINFSHGNPLSLADQVFVFKRTLREAALKHNVCATFMAKPVTDEPGSAMHIHQSVINKETGKNIFTNEDGTQSPLFLSYIAGLQKFIPELLPLMAPNANSFRRFLPGTSAPVNLEWGVENRTCGLRIPESSPQNRRIENRIPGADANCYLAIAASLLCGYIGMVEGLKPSTPVQGKSNESRSNNPHCLPLTLEEALAAMEESDACKEYLGEAFTTGFVAVKQAELENFRRVVSSWEREFLLLSV

SEQ ID NO: 3020 - protein, 280 aa, Triticum aestivum
MPYRWPLLGGQRCGFLVYPSCGRGLLQAIKWVTPGFPVPTVKTTGSDCNTTHYRAIGADVACSRPPPGISVVAEQSSRAPRDSQSPHASSSGPAAASPQALQLFKMEHKEAGCQQPEGPILCVNNCGFFGSAATMNMCSKCHKEMVMKEEQAKLAASSFDSIVNGGDGGKAPVVAAVAASAEVAVAQVDVKALVVQPAADVAGTSEAVAVSPKRKEGPNRCSTCRKRVGLTGFNCRCGNMYCSLHRYSDKHDCQFDYRTAARDAIAKANPVVKAEKLDKI

SEQ ID NO: 3021 - protein, 210 aa, Oceanobacillus iheyensis HTE831
MTKQKPVVIGVAGGSGSGKTSVTRSICQRFTETSILVIEQDYYYKDQSHLPFEERLNTNYDHPLAFDNDLLIEHLQQLMHNEPIEKPVYDYKIHTRSKDVIHVEPKEVIIVEGILILEDPRLVDLMDIKVYVDTDADLRIIRRLMRDIKERGRTLDSVIDQYIQNVRPSHLQFIEPTKRYADIIIPEGGQNHVAIDIMASKIEKILSRGL

SEQ ID NO: 3022 - protein, 180 aa, Clostridium difficile 630
MNLPNKLTLFRIFLIPVFVLIMLLNVPNKFLIACIIFIIASITDALDGKIARKYNLVTDFGKFMDPLADKLLVISALTCMIEDHLVSSWMVIIIVARELTVSILRAIAAADGKVIAAGNSGKLKTITQMVSIVFLLLGAQFENVLILNIGEILILIATLLTLYSGWEYLYKNKELFMSSK

SEQ ID NO: 3023 - protein, 650 aa, Brassica oleracea var. acephala
MCKRALQYPQVETPPPQPFLKSLKNTLNEILFADDPFGKIRNESKTSKKIELGLRHVFPILEWARGYNLDYLKSDVISGITIASLAIPQGISYAQLANLPPILGLYSSFVPPMVYAIMGSSKDLAVGTVAVASLLTAAMLGKEVSAVENPKLYLHLAFTSTFFAGLMQTCLGLLRLGFLVEILSHAAIIGFMAGAATVVCLQQLKGLLGLSHFTHSTDVVSVLRSIFSQSPVWRWESGLLGCCFLFFLPITKYISKKRPKLFWISAMAPLVSVIFGSLFVYFLHAQFHGIQIIGELEKGINPPSITHLVFTSPYVMLALKTGIITGVLALAEGIAVGRSFAMYKNYNIDGNKEMIAFGMMNIFGSFSSCYLTTGPFSRSAVNYNASCKTAVSNVVMAVAVAVTLLFLTPLFFYTPLVVLSSIIIAAMLGLVDYEAAMNLWRLDKFDFFVCLSAFLGVVFGTIEIGLILSVGISVLRLLLFVGRPKIYVMGNIQNTEPYRNIEQYPQATTLSSIIILHIDGPIYFANSSYLRDRIGRWIDEEEEKLRKSEENSLQYIILDLSAVGNIDTSGIRMLEEVNKILGRRDLKLVIANPGAELMKKLSKSKFPETIGKDWIHLTVAEAVSACDFVLHTAKPDSPEKISREPEFNNV

SEQ ID NO: 3024 - protein, 367 aa, Oryza sativa
MSAAISGASLVLSSPPAPGARPQPRPARVSVAAAAPAARRGVVAAAAVSSPAVSSSAGKDAKQIPKDFLHIDDFDKDTIMKILNRAIEVKAMIKSGDRSFQPFKGKSMAMIFAKPSMRTRVSFETGFFLLGGHAIYLGPDDIQMGKREETRDVARVLSGYNDIIMARVFAHQDILDLAKYAAGPVINGLTDYNHPCQIMADALTMLEHIGRIENTKVVYVGDGNNIVHSWLRLAALFPLHFVCACPKGFEPDAKTVEIARSAGSKIEITDDPMEAVKGADVVYTDVWASMGQKEEAEYRKKVFQGFTVDEAMMEMAGPNAFLMHCLPAERGIEVTDGAIEAPNSIVFPQAENRMHAQNAIMLHVLGA

SEQ ID NO: 3025 - protein, 344 aa, Burkholderia sp. 383
MSVPSSLPPRRVSVAPMLDWTDRHCRSFHRTLTRDTWLYTEMITTGALLFGDAQRHLAFTPNESPVALQLGGSERDDLARAAKLGEQWGYDEINLNCGCPSERVQRGAFGACLMNEPSLVADCVKAMRDAVSVPVTVKHRIGVDAVEDYAFVRDFVGTVAEAGCETFVVHARNAILKGLSPKENREIPPLKYDYAYQLKRDFPSLEIVINGGITTLDEVAQHLEHVDGVMLGREAYHNPYVLAEVDARFYGSTEAVPTREEAEAKLIEYCAAELKRGTYLGAIVRHALGLYRGMPGARGWRRVLSDNKKLARADLAVFDEARAHLNEAEEVFAKKALQDSKVFV

SEQ ID NO: 3026 - protein, 400 aa, Clostridium perfringens ATCC 13124
MIGVIGVKRNVDIAIREKLALYPKKHKKYVGELLNSFKEVVILNTCNRTEIYFNCTEEISEDEIFDKIFNVFNWNDDLKKYMFLSKEKRAVTHLMEVICGFHSRILGEDQILGQIKGAYKTAISDNSISSELQKMFEIAIACGKKFKTECKMFEVPVSSVSISINSALLKGCRKFMVLGYGEIGKLAIKHLLSHKVECIYLIVRDKSKASDLEGEIVEVLDFNEKNQVINEIDCIVSCTAAPHTVVRNEDIKTEGETIHIYDLAVPRDVDKELSEKERVILKDIDEISKIDDKNKKIRKERMEEYKHIVEESIDEFLNWLKIREVSSKIRNIKIRENEICSERIKTFSNKGNGENAKLAERMIKSTADAYVNRAIELLKSEALKGSDSYCAEIIEKIFLT

SEQ ID NO: 3027 - protein, 451 aa, Vibrio fischeri ES114
MTTHFDYICIGGGSGGIASANRASMYGAKVALIEAQDLGGTCVNVGCVPKKVMWHGAQVAEAINLYAEDYGFDVELKEFKWNKMIESRQAYIGRIHESYDRVLGNNKVNVIKGFAKFVDAKTVEVNGEHYTADHILIAVGGRPTIPNIPGAEYGIDSNGFFELTEQPKRVAVIGAGYIAVEIAGVLHSLGTETHLFCRKESPLRSFDPMIIDTLVEVMNTEGPTLHTHSVPKEVVKEADGSLTLHLENGNTQNVDTLIWAIGRHPATDAINLDKTGVATNDRGYIKVDEYQETNVKGIYCVGDIMEGGIELTPVAVKAGRQLSERLFNGKTNAKMDYDLVPTVVFSHPPIGTIGLTEQEADEQYGKENVKVYTSGFTAMYTAVTKHRQPCKMKLVCAGEDEKVVGLHGIGFTVDEMIQGFAVAMKMGATKADFDAVVAIHPTGSEEFVTMR

SEQ ID NO: 3028 - protein, 348 aa, Pyrococcus horikoshii
  misc_feature (1)..(1): Xaa can be any naturally occurring amino acid
  misc_feature (5)..(5): Xaa can be any naturally occurring amino acid
  misc_feature (9)..(9): Xaa can be any naturally occurring amino acid
  misc_feature (65)..(65): Xaa can be any naturally occurring amino acid
  misc_feature (229)..(229): Xaa can be any naturally occurring amino acid
  misc_feature (335)..(335): Xaa can be any naturally occurring amino acid
  misc_feature (346)..(346): Xaa can be any naturally occurring amino acid
XSEKXVAIXKTKPGYGAELVEVDVPKPGPGEVLIKVLATSICGTDLHIYEWNEWAQSRIKPPQIXGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVXDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELXRAGKTGKVVFXLK

SEQ ID NO: 3029 - protein, 294 aa, Citrullus lanatus
MPVGELRFSSQSSTTVVESTTNNDETWLWGQIKAEARRDAESEPALASYLYSTILSHSSLERSLSFHLGNKLCSSTLLSTLLYDLFLNAFSTDYCLRSAVVADLQAARERDPACVSFSHCLLNYKGFLACQAHRVAHKLWNQSRRPLALALQSRIADVFAVDIHPAARIGKGILFDHATGVVVGETAVIGNNVSILHHVTLGGTGKMCGDRHPKIGDGVLIGAGATILGNVKIGEGAKIGAGSVVLIDVPPRTTAVGNPARLVGGKEKPSQLEDIPGESMDHTSFISEWSDYII

SEQ ID NO: 3030 - protein, 160 aa, Chlamydomonas reinhardtii
MAQATRLSTVAQRRIQSELNEWMRSPPEGCCLESCEPMTSWVVIMQGAGGVRLYSDEVFRVRIDFGEQYPLDPPDVIFLAPAPIHPHIYSNGHICLDILYSGRNGGWSPALTMSKVVLSLRSMLASNTDKRKPPGDAEYCARVGNRSPKLSNWVFEDDKV

SEQ ID NO: 3031 - protein, 209 aa, Clavispora lusitaniae
EVSTEKLSLKDWNFDGNGPNEKDRIVLVEFHHILTEFHKLRPEYQDIVKKITKKMGNGMADYILDENFNTNGLETVKDFDLYCHYVAGLVGEGLSDLLVLARFADNQVQAENYRLSESMGLFLQKTNIIRDYHEDLEDGRSFYPREIWSKYTDSLPNFFKKPEEREKGVECINDLVLNALNHVIDVLTYLSLIRESTSFNFCAIPQVMA

SEQ ID NO: 3032 - protein, 466 aa, Thermotoga sp. RQ2
MRSTKIVCTVGPRTDSYEMIEKMIDLGVNVFRINTSHGDWNEQEQKILKIKDLREKKKKPVAILIDLAGPKIRTGYLEKEFVELKEGQIFTLTTKEILGNEHIVSVNLSSLPKDVKKGDTILLSDGEIVLEVIETTDTEVKTVVKVGGKITHRRGVNVPTADLSVESITDRDREFIKLGTLHDVEFFALSFVRKPEDVLKAKEEIRKHGKEIPVISKIETKKALERLEEIIKVSDGIMVARGDLGVEIPIEEVPIVQKEIIKLSKYYSKPVIVATQILESMIENPFPTRAEVTDIANAIFDGADALLLTAETAVGKHPLEAIKVLSKVAKEAEKKLEFFRTIEYDTSDISEAISHACWQLSESLNAKLIITPTISGSTAVRVSKYNVSQPIVALTPEERTYYRLSLVRKVIPVLAEKCSQELEFIEKGLKKVEEMGLAEKGDLVVLTSGVPGKVGTTNTIRVLKVD

SEQ ID NO: 3033 - protein, 304 aa, Rickettsiella grylli
MIKKDIISIRDLSLNEINVILNLAKKIKKNSPKKYLIGKIIAHCFFEPSTRTRLSFETATLQLGGHVIGFSDSECLSIKKGEDLQDTIKTISCYADLIILRHSFEGAARLAAEISDKPIINAGDGANQHPTQALTDLFTLKEAQGNLEGLSIALVGDLKYGRTIHSLVQLCGLFNMRLFLISPGLLPLPETIANELKYKGIRFSFHTHLEEVISKVDVLYMTRLQHERFTSSENQLYINQCTLTEDKLKKAKPNLNILHPLPRGKEMDKSIDETHFALYFKQVANAVYVRQAILALILDKKFKF

SEQ ID NO: 3034 - protein, 513 aa, Hordeum vulgare
MAMAAAASPSKILIPPHRASAVTAAASTSCDSLRLLCAPRGRPGPRGLVARPVPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 3035 - protein, 384 aa, Staphylococcus aureus subsp. aureus MW2
MISNKLANIPDSYFGKTMGRKIEHGPLPLINMAVGIPDGPTPQGIIDHFQQALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 3036 - protein, 518 aa, Arabidopsis thaliana
MATIVVDFQKIHFHPQILLSIFTVICIFVFFFKKPKGSRGCDLPPSPPSLPIIGHLHLLLFDLPHKAFQKLSSKYGPLLCLRIFNVPIVLVSSASVAYEIFKTHDVNISSHGHPPIDECLFFGSSSFVMAPYGDYWKFMKKLMVTKLFGPQALEQSRGARADELERFHANLLSKEMKSETVEIAKEAIKLTNNSICKMIMGRGCLEENGEAERVRGLVTETFALFKKLFLTQVLRRLFEILRISPFKKETLDVSRKFDELLERIIVEHEEKTDYDHGMDLMDVLLAVYRDGKAEYKITRDHLKSLFVELILGGTDTSAQTIEWTMAKIIKKPNILERLRKEIDSVVGKTRLIQEKDLPNLPYLQAVIKEGLRLHPPAPLLGRKVTDGCTIGGCYVPKNTTLVVNAYAVMRDPDSWEDPDEFKPERFLASSRGKEEEREQELKYIPFGSGRRGCPGVNLGYIFVGTAIGMMVHCFDWRTNGDKVNMEETVAGITLNMAHPLRCTPVSRMQLQKSQFVSS

SEQ ID NO: 3037 - protein, 508 aa, Vicia faba
MSSIVTSGVINVPRSSSSSKNLSFSSSSQLSGNKILTVSGNGAPRGRCTLKHVFLTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVL

SEQ ID NO: 3038 - protein, 562 aa, Synechococcus sp. WH 5701
MTAVLLPVGIAYAVASGVPAICGLYATIFGLFAYALFGPSRMLVLGPDSSLVALILGIVLPLSGGDSQRAMALAGMLALVSGSLCVLAGTARLGFITELLSKPIRYGYMNGIALTVLVSQLPALCGFTVKGDGLLIEARSFVAAVLAGSTNRASLALGVGTLLMIGLLRRSRRFPGVLLAVVAATVIVSVLNLESRFGVTVLGPLPRGLPALSIPSISTGDLVPVLLGGCAIALVSFADTSVLSRTYAARLGDTIDANQEMVGLGAANLVAGLFQGLPISASTSRTPVAEAAGAKTQLTGVVGAVTVAALLLAAPNLLRNLPTAALAGVVIASAITLIEVADLWRIYRMQRWEFWLSMVCLAGVAVFGAIPGIGLAIVIAVIEFLWDGWRPHSAVLGRVDGVKGYHDIGRYPESRLVPGLVLFRWDAPLFFANAEFFRDRVMTALESSPTQVNWLVVEAEPVTSIDVTSADTLDELDHTLAKAGIMLGFAEMKDPVKDKLKRFGLFSQFGEERFFATVGEAVSCYLKAHCVDWVDWEDQAKASADASCDQGTSDGGFRPVGG

SEQ ID NO: 3039 - protein, 512 aa, Vicia faba
MAAIGVLKVPPSSSSSSSSSSSKAIARNLSFTSSHLSGDKIFTLSGRTRRTSGRNPFIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLVLAGDHLYRMDYERFIQAHRESDADITVAALPMDEARATAFGLMKIDEEGRIIEFSENPKGEQLKAMKVDTTILGLDDDRAKEMPYIASMGIYVVSKHVMLDLLRDKFPGANDFGSEVIPGATELGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGGVPIGIGKNSHIRRAIIDKNARIGDDVKIINSDNVQEAARETEGYFIKSGIVTVIKDALIPSGTVI

SEQ ID NO: 3040 - protein, 295 aa, Listeria seeligeri
EIAKEVGIELGKSSVTHFSDGEIQINIEESIRGCHVYVIQSTSNPVNQNLMELLIMIDALKRASAATINIVMPYYGYARQDRKARSREPITAKLVANLIETAGATRMITLDMHAPQIQGFFDIPIDHLNAVRLLSDYFGERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEESPIEKLVVTNSIALPEDKWIDKMEQLSVAPLLGEAIVRVHENASVSSLFE

SEQ ID NO: 3041 - protein, 102 aa, Glycine max
  misc_feature (30)..(30): Xaa can be any naturally occurring amino acid
MQRQGVEEVSIQELASNPSLEKDQLNHLRXHVNDDPANSDYVDMDRELSEVIALTDELLATANQNEIAAPPNNAAASPVLAIHNENQLRDTTSDHHEKLPVG

SEQ ID NO: 3042 - protein, 540 aa, Synechococcus sp. WH 5701
MDSLRPDPQASGDGHDHRPRQVFSGHYVPVAPTPIPAPEYVAHSRSLFQDLGLSEALAHDDQFQRLFSGDISVARQPMRPVGWATGYALSIYGSEYIQQCPFGTGNGYGDGRAISVFEGVFNGRRWEMQLKGGGPTPYCRGADGRAVLRSSVREFLAQEFMHALGVPTSRSLTLYMSRAETVRRPWYSPNSRSFDPDILVDNPAAITTRVAPSFLRVGQLELFARRARSQAHPEALNELRMIVAHLIERNYRQEIDPALEFSDQVVELARLFRGRLTSLVANWMRVGYCQGNFNSDNCAAGGYTLDYGPFGFCELFDPRFQPWTGGGEHFSFFNQPVAAEANYQMFWASLRLLLEGNTEALARLDAIRDGFAAAMQQALEAMWARKLGLISYDAALVDELLELMVLSKADYTIFFRKLSGLPEQLSTLKESFYMPSSEQLDAQWTHWLQRWRDRLEAAGELNATSAAMKRINPRYTWREWLVAPAYEQAAQGDTSLIQDLQEVFSHPYDEQSAEVAATYDRLKPREFFNAGGVSHYSCSS

SEQ ID NO: 3043 - protein, 141 aa, Staphylococcus epidermidis RP62A
IGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQE

SEQ ID NO: 3044 - protein, 284 aa, Arabidopsis thaliana
MAERGGEGGTERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLSTKAVSATKVITEGEDQA

SEQ ID NO: 3045 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQD

SEQ ID NO: 3046 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANKILGNQVKKAVEGLSDDQLKEVVIAYEPIWAIGTGKSSTSEDANEMCAHVRQTLADLSSQE

SEQ ID NO: 3047 - protein, 447 aa, Arabidopsis thaliana
MVKFENGYSVETVFDGSKLGIEPYSIEVLPNGELLILDSENSNIYKISSSLSLYSRPRLVTGSPEGYPGHVDGRLRDAKLNHPKGLTVDDRGNIYVADTVNNAIRKISEGGVTTIAGGKTVRNGGHVDGPSEDAKFSNDFDVVYVGSSCSLLVIDRGNKAIREIQLHFDDCAYQYGSGFPLGIAVLVAAGFFGYMLALLQRRVGSIVSSHNDQEMFEADPDQKPMKHSRPSLIPAGDEQLEKQEETFVVSLGKLVSNAWESVMEILRKKQTGTSFQQYHGTTKQSAAFSTSTPWPIQESFVIRDEDGPPPVEPRNPTPRKTYAFMSKDAEKMQQLRQSRAFYSSWDAEFPNQQQQQQKQHQKHQHQQQQQQQHRRHYSSIPHTYYEQDSEKSNEIVFGAVQEQSSKRVAKPKPKPIESGDQMNNNTQQNLHYRSHSVSYPYGYYPNT

SEQ ID NO: 3048 - protein, 498 aa, Shewanella sp. MR-4
MSTPKKRSDWESLAASLAINGKAYINGEYRDAAAGSTFDCVSPIDGRVLAKVASCDLMDANIAVANAREVFESGVWSKTAPVKRKQVMIRFAELLEENANELALLETLDMGKPIRFSKAVDIAGAARAIRWSGEAVDKLYDELAPTAHNEIGMITREPVGVVAAIVPWNFPLLMACWKLGPALATGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIAFNQGEVCTAGSRLLVESGVKEQLIALIAEELASWQPGHPLDPATVSGAVVDKQQLDTILSYIKAGQDEGASLVHGGQQVLAETGGVYVQPTIFSQVHNKMKIASEEIFGPVLSVIEFNGMDEAIAIANDTIYGLAAGVWTADISKAHKTAKALRSGMVWINHYDGGDMTAPFGGYKQSGNGRDKSMHSFDKYTEIKATWIVL

SEQ ID NO: 3049 - protein, 223 aa, Arabidopsis thaliana
MVLEDEMKKGEASGETSEKMGLSRKNSGSSLSPTEDDEEDEDKKLELGPMIALKEQLERDKDDESLRRWKEQLLGVVDLEDVGETPDPVVKILDLTIRSPDREEMVLTIPEDGLPNPKGPWFTIKEGSKYTLVFNFRVTNNIVSGLRYNNTVWKTGVKVDSTKAMLGTFSPQAESYQHVMPEEMTPSGMFARGSYSARTKFIDDDNKCYLEINYTFDIRKSWQ

SEQ ID NO: 3050 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQE

SEQ ID NO: 3051 - protein, 446 aa, Shewanella sp. MR-4
MADSPYNTTHEHPSLEHYWMPFTANRQFKASPRLLAQAEGMYYTDINGNKVLDSTAGLWCCNAGHGRREISEAVSKQIREMDYAPSFQMGHPLAFELAERLTELSPEGLNKVFFTNSGSESVDTALKMALCYHRANGQASRTRFIGRELGYHGVGFGGISVGGLSNNRKAFSGQLLQGVDHLPHTLDIQNSAFSRGLPSLGAEKAEVLEQLVTLHGAENIAAVIVEPMSGSAGVILPPQGYLKRLREITQKHGILLIFDEVITAFGRVGAAFASQRWGVIPDIITTAKAINNGAIPMGAVFVQDFIHDTCMQGPTELIEFFHGYTYSGHPVAAAAALATLSIYENEQLFERSFELERYFEDAVHSLKGLPNVIDIRNTGLVAGFQLAPNSQGVGKRGYSVFEHCFHQGTLVRATGDIIAISPPLIVDKHQIDQIVNSLSDAIRAVG

SEQ ID NO: 3052 - protein, 496 aa, Shewanella sp. MR-4
MLTMTHYVNGEHSAASTRSQEIFEPATGECRGQVSLASRDEVSAAIAIAKSAFDTWSQVTPLNRARVLFKFKALVEQHMDELARLITLEHGKVLDDARGELIRGLEVVEFACGIPHLLKGEHTEQVGGGVDAWSVNQALGVVAGIAPFNFPVMVPMWMFPIAIACGNTFIMKPSEKDPSAIMRIAELLTEAGLPAGVFNVVNGDKEAVDTLLSHEDIQAVSFVGSTPIAEYIYSTASKHGKRVQALGGAKNHMLLMPDADLDQAVSALMGAAYGSAGERCMAISVVLAVGDVGDKLVDRLLPQIQQLKVGNGLTPEMEMGPLISRQHLAKVTEFVDAGVQEGATLVVDGRQLSVADHQQGYFLGACLFDNVTPEMRIYREEIFGPVLSIVRVKDYASALALINQHEFGNGTAIFTQSGEAARHFCHHVQVGMVGVNVPIPVPMAFHSFGGWKRSLFGPLHMHGPDGVRFYTKRKAITARWPVGKQTQAEFVMPTMK

SEQ ID NO: 3053 - protein, 501 aa, Rhodococcus sp. RHA1
MTSTINPTAGLSPTVADFLSRPIEHLIDGSNVASATGETFATVNPSTGAALTQVTRGSAEDVDRAVAAARQALDGPWGRLTASARSKILWRVADLIEDKLEEFAILEAIDSGKPVTYAQLVDVPLAIDWFRYFAGWPTKLEGTTIPVSAVATPGDYFAYTVREPVGVVGAIIAWNFPLLLAAWKLAPALAAGNTVVLKPAEQTPLSAALLGDVLREAGVPEGVVNIVHGYGDQVGAALAAHPGVDKISFTGSTEVGRQIIAAARGNLKKVTLELGGKSPNLIFADADIDAAIAGAANAIFFNQGEACEAGSRLFVQSSVYDRVVAGIAEAATQIKVGDSLAADTQLGPLVSQQQLDRVLGYLVSGRAEGATAVAGGTRKGDTGYFVEPTVLVDTKPNMRVVKEEIFGPVVTVAPFDDVDDVVRSANDTDYGLAAAVWTSDVAKAHNLAAKFRAGTVWINSYHILDPALPFGGYKQSGWGREHGSSALDGYTETKTVILKKG

SEQ ID NO: 3054 - protein, 388 aa, Oryza sativa
  misc_feature (244)..(244): Xaa can be any naturally occurring amino acid
MGDNLMDKVNALGERLKVSGAEVSRKMSAGVSNMSFKMKEFFQGQNMADKIVDEATLETMDAPDWATNLEICDMVNTGNVNSIELIRAIKRRIMLKNPRVQYLALVLLETVVKNCEKAFSEIAAERVLDEMVKLIDDPQTVVNNRNKALMLIEAWGESGDELRYLPVYEETYKSLRSRGIRFPGRDDESLAPIFTPPRSAPSAEPYSAAAQEGYQEIPDESFAPVHVVPAVQVNEAFEVARNSXVELLSTVLSSSPQKEALKDDLTTTLVQQCQQCQRTIQRIIETAGDNEAQLFEALSVHDELEKVLSKYKELKEPVVAEPEAEPAMIPVTVEPENSPRTKDGTVGKRAGSGADELLQDLDDMIFGKKGGTSSQQDRKEQKDDFISF

SEQ ID NO: 3055 - protein, 398 aa, Clostridium difficile 630
MNYSNRVSAMQASPIRKLVPFAQAAKDKGIKVYHLNIGQPDIKTPKGFFDAVKNFDSEVLEYATSEGIPELLEALQNYYKTYDMNFEKDELLVTNGGSEALLFTMMAVCDPGDNLLVPEPFYTNYNGFGQSVNVEVNAVTTKAENGFHLPSKEEILSKVDDKTKAIILSNPGNPTGAIYTKEELNILAEIAKEKDLWIIADEVYREFVYDGLEYTSCGNLEGVQDRVIIIDSVSKRYSACGARIGSIACKNKGLIAQILKLCQGRLCVPTLEQIGAVELYKTPVSYFKEVNEEYKKRRDVLYNELMKVEGVICKKPTGAFYIVAKLPVENAEDFTIWMLKEFNKDNETVMVCPAEGFYATPGLGRDEIRLAYILNEKDLHRAATLLKEGLEQYVALQK

SEQ ID NO: 3056 - protein, 111 aa, Clavispora lusitaniae
EDTWHYWFHRGLHHGVFYKYIHKQHHRYAAPFGLTAEYAHPVEVALLGMGTVGIPLVWCYFTRDLHLFTISLWICLRLFQAVDAHSGYEFPWSLHHFLPFWAGADHHHEDH

SEQ ID NO: 3057 - protein, 491 aa, Ustilago maydis 521
MAQPLSQPYHNSFASMTSHASHASSGSNVVGVHYRVGKKIGEGSFGVIFEGTNLLNSQTVAIKFEPRKSDAPQLRDEYRTYKILSGCPGIPQVYYFGQEGLHNILVIDLLGPSLEDLFDMCGRKFSIKTVVMTAKQMITRVQTIHEKNLIYRDIKPDNFLIGRPMTKGANLVHVVDFGMAKQYRDPKTKQHIPYRERKSLSGTARYMSINTHLGREQSRRDDLEALGHVFMYFLRGGLPWQGLKAATNKQKYEKIGEKKQSTPIKELCEGFPEEFGIYLNYVRKLGFEETPDYDFLRELFTKVLKSSGEQEDGVFDWMLLNNGKGWEAGTSRDRRDERERERQRETRASAAPQASAAAAQQPAALARNGSKGGRKSGGAQQHLQSDRSQAGQLRASHGDYTQSGSGYGGVGHASNVAVHDATVVGIPNQNGTREHSHVGHMTPTAMSSGNGLDRRGDTRQAVGISNGDDHHPAERKTVGQKLMDVLTCRCG

SEQ ID NO: 3058 - protein, 264 aa, Robiginitalea biformata HTCC2501
MDKNEIIRSIEAHKDNPALKFRLKRRSEEFTDRLFLTLFDQETPVKENLEQLEQSFEELVELACWEKDKPCSEVWAQYVGLLPEILEKLNLDARAISACDPASLSLEEVYMAYPGFYAIAIYRLAHELYRMGFPLVPRLMTEYAHSRTGVDINPGAQIGRSFFIDHATGVVIGETAVIRDHVKIYQGVTLGALYVAKNLQQTKRHPTIEDHVTIYANATILGGDTVIGANSVIGGNAWLTESVPANSTVFHTPEIRIKTEKHAG

SEQ ID NO: 3059 - protein, 294 aa, Robiginitalea biformata HTCC2501
MPGSLEDLIGNTPLVRSRKLVENPDVALYFKLEGQNPGGSVKDRAALNMIRSMLSRGEIGPETRLIEATSGNTGIALAMIARLYNLDLELVMPANATAERVQTMRAYGAKVTLTPQDVGIEGARDYAEEKVRDAGYKMFDQFANPDNWKAHYQTTGPEIWRDTRGAITHFVSSMGTTGTIMGTSAYLKEKNPDIQIVGVQPDDQASIPGIRKWPQAYLPKIYRPERVDHILEVTEKEARDMARRLASEEGIFAGMSSGGAAAAAVRLASELDSGHIVSIVCDRGDRYLSSDLFE

SEQ ID NO: 3060 - protein, 308 aa, Chlamydomonas reinhardtii
MWGWGAGWGAATTATPSATAADNYTDKDAFWYLTPSEEQKAALSKLREQLTAENLIVPDHDADITLLRFLMARDFNVDKVYPHFTFNTDKFGRPVYVEMLGRTDAAKLFEVISVERLIRYHCWTWERYLRCYLPACSAAAGRPICTTTVIIDLAGLSLAHFNAATQRLLNTFSKIDQDYYPEHLGTMFIINTPLIFRGMWAAVQPLLQERTRKKIIMLGADYLPELTKLVPAERLPDLLGGGGRMQRGYKSVGPWRSPDPAQQREEGPAEVQAQAEAGQQDEDGARQGAQQLQEAPQGSDCRSLVVGR

SEQ ID NO: 3061 - protein, 520 aa, Nostoc sp. PCC 7120
MVLESAISEEVIATNLKQFLLVLSVSLGVATLPQVFSWFRQIPYTLLLVIVGLGLAVVDVRLVVLSPALILSIFLPPLLFEAAWNLKWSDLQRDFVPICLYAVFGVIISIAGVAIGLNQLAGISLTTALLIGASLSATDPVSVTALFRELGVGTRLVTLMEGESLFNDGMAVVAFGFLVALPFGNAELGFQPILLQLIQVVGIGVAVGCLIGFAISYLTQRFDLPMVEQSLTLVSAYGTYLITEDLGGSGVIGVVTTGLILGNFGSRIGMNPRTRIIVSEFWEFLAFFVNSIVFLLIGDQIRFASLGENLQIIAITVGAMILMRAVALFILSKLSVMMTQSQVSLPEQTILWWGGLRGSVSIALALSVPNVLPGREKIIATVFGVVLFTLLVQGLTIKPLLQKLNLLGDAPLREQYLQLVARSVALERVLQYLQTEKRPGIDPEFIRYQEKLVTGEIAELQTKIDKLHNEYPNLQNFTTEQFRDELLAIEADTYAEFVKSGRLNKELAPMLEDVLGHQRD

SEQ ID NO: 3062 - protein, 240 aa, Zea mays
IGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKE

SEQ ID NO: 3063 - protein, 311 aa, Rickettsiella grylli
MSKMKHIGAIGEAMLELSHQTPTLLSLSYAGDTLNFSIYLCRLLQNQAYKVHYITALGQDFYSEAMLLDWKKKGLQTNLICRIENKLPGLYLIRTDNNGERTFYFYRSNSAARDLFKGNNRNDLSRQLIEMDYLYFSGISLAILDEMSRKYLLCIVEKAKQRGATIIFDSNYRPSLWTNPESAKKVTQDFLKFVDIALTTFIDEQLIFGDTNPEACVQRLLKYGITEIVIKCGSDPALVATTEGQQRVPACPVSRIVDTTAAGDSFNSAYLASRFLGFDPIHASLYGHQLAARVITHPGAIIPQSLMPSLF

SEQ ID NO: 3064 - protein, 326 aa, Dunaliella salina
MAFALRTGVAPSVLPRGQSRRQMVCRAGKFDEELMKTARTIASPGRGILAMDESNATVGKRLDSIGLENSEANRQAYREMLVSTKGLGQYISGAILFEETLYQSGSNGKRMTDILVENGIVPGIKVDKGLAPLANSNNEQWAMGLDGLDTRCAEYYKTGARFAKWRSVVSIPNGPSPIAVRETAYGLARYAAICQNNGLVPIVEPEILLDGDHDINRCLAVFEDVWAETFKYLADNKVLFEGILLKPSMVTPGAESPARATPQQVAEMTLIGLKRRVPPAVPGIMFLSGGQSELEATLNLQEMNPPNPTLGQVSFLLTPVPCRTPC

SEQ ID NO: 3065 - protein, 417 aa, Glycine max
  misc_feature (64)..(64): Xaa can be any naturally occurring amino acid
WPQSQSRVPHTPGSKPHPYSNPTRAPAARPSGGFSRGVRWVVVVPRRVSPAPLLSSAADSGSGXHRRQGKFSLLSFGGDDDGSAVGGEARERDLSQLLSALLPVVVAATAVAALAKPSTFTWVSKELYAPALGGIMLSIGIRLSVDDFALAFKRPLPLTIGLIAQYVLKPVLGILVAKAFGLSRMFYAGFVLTACVSGAQLSSYANFLSKGDVALGILLTSYTTIASVIVTPLLTGLLIGSVVPVDAVAMSKSILQVVLVPVTLGLLLNTYAKSVVSVLQPVMPFVAMICTSLCIGSPLALNRSQILTGEGLRLVFPVLTFHVVAFTLGYWFSKIPSLRQEEQVSRTISLCTGMQSSTLAGLLATQFLDSSQAVPPACSVIAMAIMGLCLASFWGSGFVIRNLLPLPPLRTNSAVKT

SEQ ID NO: 3066 - protein, 182 aa, Nostoc sp. PCC 7120
MLSEPVLAKMKHTLSVLVEDEAGVLSRIASLFARRGFNIESLAVGSGEEGGVSRITMVVPGDDRVIEQLTKQLYKLVNVLKVQDITETPCVERELMLLKVNATSSNRSEVIELAQIFRARVVDVAEDSLTLEVVGDPGKMVAIVQVLQKFGIREIARTGKIALTRESGVNTELLKSLEAKVS

SEQ ID NO: 3067 - protein, 612 aa, Methanosarcina barkeri str. Fusaro
MIEPIFLMEIIVALLVLSMLAQVLTHYFQIPFIIFLFIEGIIVGPEVLNLLNPALYSDVLSAIVSICVSVIVFDGGFQIDWKHMRGVKKSVIKLSTLGVFITFIGITILTHLLINISLPIAALFGALVTATGPSVVGPIIRNIGICHRVAKILEFESVLNDAVSVILTALVFEWITAEMSGTGAVIFMLQRVGMGLIIGSLCGFILRWFFTRGISISKQPARLFTLTFIFACYVLSETIGNESGILAVAVFGIIMGSTEFPQKKMIEEFNNNLAVLMISLIFILLAAMLKFWYIMEIGLKGIALVLLIALFVRPVAVFISMRSSKISTKEKMFISFVGPRGVVPTSIATYFAIRLDEMGIAGGQTIVGLVFLTVIITVFLTGSMSKKVAQILEIIPMEILIIGGGNVGRILAERFENRGENVSVIDISGEECNRCRELGVRAVQGNAADIAVLKKAGIENAKYVVVTTKKDDTNLLFCQIAKAKFGFNGEQLVVRVNNVENLPAFWDLGIRAMSTTMTTAAVMDSMVGGNNLFSMCEVGNKGNIMEVRVTNPKIVGKAIKEINFPEKSLMVMIQRGSESIIAHSNLKLEYNDIATIIADKSSGKSVADILFR

SEQ ID NO: 3068 - protein, 456 aa, uncultured haloarchaeon
MTAKLYNSARSAAEDTTQFVSGSVPVAVYGLGKMGLPLAAVFADVCGSVIGVDPQQTVVETVTHGDCHVEREPGLGELVAETVADDALRTTTDGVAAASAASVHVLIVPTLLTDQNEIDLSAVEAVCDDIAAGLDPGDMVLVESTVPPQTCREVIEPTLAADSDCEHGEFGVAFCPERTMSGRAIEDIRGTHPKIVGGIDAESTRVAHVVYEQISANKIVAVSDATTAETVKIFEGLYRDVNIALANELAQFTTELGIDVNEAISAANTQSFCEIHNPGPGVGGHCIPYYPYFLLNQLETPAPMLRTARTVNDEMPQYVVDRVLTELDRQGTPPQEATVAVVGLTYRPDVAEIRATPARPIVTGLSDRGVTVSVSDPLVTDDQLAVFGDPPRLDTNDLATDTFDGYVLVTPHEEFRALDWATVCDAASFLIDCHDTLDSSSIPCPVYTIGSGRKPP

SEQ ID NO: 3069 - protein, 570 aa, Oryza sativa Indica Group
MPLGQRAGDKSESRYCGVEVLDFPAGEELPAVLSHSLSSSFDFLLAPLVDPDYRPTPGSVLPVAASDLVLGPAQWSSHIVGKINEWIDLDAEDEQLRLDSEITLKQEIAWASHLSLQACVLPPPKRSSCANYARVVNHILQGLTNLQLWLRIPLEKSEPMDEDHDGAKDNSDMVGYSLIRSTLPSMNSLGRWFGEPVIISGRSNHNVSQGGVLSGDENHTEDTAVRHALSPYLDYIAYIYQRMDPLPEQERFEINYRDFLQSPLQPLMDNLEAQTYETFEKDTVKYTQYQRAIAKALVDRVSDDDVSTTKTAAEETGRKLKVYAVEKNPNAVITLHSLIKLEGWESLVTIISSDMRCWEAPEKADILVSELLGSFGDNELSPECLDGAQRFLKPDGISIPSSYTSFIEPITASKLHNDIKAHKDIAHFETAYVVKLHRIARLAPTQSVFTFDHPNPSPNASNQRYTKLKFEIPQETGSCLVHGFAGYFDAVLYKDVHLGIEPNTATPNMFSWFPIFFPLRKPIYVPSKTPIEVHFWRCCGATKVWYEWAVTAPSPSPIHNSNGRSYWVGL

SEQ ID NO: 3070 - protein, 157 aa, Arabidopsis thaliana
MVSGLINENPIIYPKKERRLRTDTSITDELTPEPIDQLEIFDHIRDIKDPEHPNTLEDLRVVTEDSVEVDDENSYVRVTFTPTVEHCSMATVIGLCVRVKLLRSLPSRYKIDIRVAPGSHATEDALNKQLNDKERVAAALENPNLVEMVDECLPSEE

SEQ ID NO: 3071 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQALADLSSQE

SEQ ID NO: 3072 - protein, 430 aa, Clostridium perfringens ATCC 13124
MKNLNLKGNPNRGLIGATLGFFIGFAAVSLYGPTSAVFKEAFVNLNPVLLALLIAAPNLSGSLLRIPFSAWVDTTGGRKPLIVLLLLSIIGMGGLYVVLAFFSDNLNQYYYLLFALGLLSGCGIATFSVGVSQASYWFPKSKQGVALGIYGGVGNLAPGIFALLIPNLALPLLGLPGSYLAWLIFLIVGTVIYIKIGQNAWYFQLVDKGINKDEAKEIASKEYGQELFPKGKASETLLISAKSWKTWALVFIYFTTFGGFLALTGWFPNYWMTYFGLNMKVAGLLTALYSILTSLTRIYGGKVADKNGGEITTIVSLGIALIGAICMTFASTMTLAIIGIILLAIGMGVANAAVFKIVPNAVPEAMGGASGWIGGLGALGGFLIPPVMASFLNRSGFAGYSQGFSVFIVLIIVAIGVIALFQALQKKSAK

SEQ ID NO: 3073 - protein, 356 aa, Triticum aestivum
  misc_feature (44)..(44): Xaa can be any naturally occurring amino acid
REAEILCYSNDGVDEHMIWLVGLKNIFARQLPNMPKEYIASAHXVRDRTHKSMMVIRNNNVVGGITYRPYASQRFGEIAFCAITADEQVKGYGTRLMNHLKQHARDADGLTHFLTYADNNAVGYFVKQGFTKEITFDKERWQGYIKDYDGGILMECKIDQKLPYVDLATMIRHQRQAIDEKIRELSNCHIVYSGIDFQKKEAGIPRRLMKPEDIPGLREAGWTPDQWGHSKSRSTFSSDYNTYRQQLTSLMRMLLKSLVDHADAWPFKEPVDSRDVPDYYDIIKDPIDLKTMSRRVESEQYYVTLEMFVADLKRMFINARTYNSPDTIYFKCSTRLEAYFTNRIQSHLAQAASTKN

SEQ ID NO: 3074 - protein, 166 aa, Rickettsiella grylli
MQKKIKEITAQPFDFTQEADKFNIALIVSQFNPNISEKLLMGALQRLKEFNFPDSCITIVRVPGAIEIGLTAQQIAISDENCLAIICLGAIIRGETDHYDYVCQQVSYACQKIALQESIPVIFGILTTDNEELALARVDEKRCHKGRDAVDTALAMISLLEQIESE

SEQ ID NO: 3075 - protein, 392 aa, Oryza sativa Japonica Group
MPRAAGLAVAVTVDCIPPPSLLAQSCGHGAATAAAYPRVRGERGRLLPKQGPTDLSLLLLGAAAAVVAAATPRTAHAASGGVMGGRDTSPSPSSYSSSSSSSSSSSPSVRHYHYYPPSPTRSSSPPTPAAHTTSCPICPYVLLAAAVGITIIFLCTLASNQKTTVVKLQVALQALAKTMQKDLNTIAAKVDTTKTASLQIHVNGDDMFLEPSERLLVLFSLIVDEIDSWEEHFDKISIEERSKTDEETLFNVEGIKISKKYSKNPESCRKEYIVLTIILAAEGKLKFPQIRSADDLRLVLGMLNGIHASEIKGVQILWTPQEEDDALSEERLLKDYPYLRPLKQVLIGESKQLLLGESKFKQILFGESEEKQLLLGEPKEPSVQEDPNNTKG

SEQ ID NO: 3076 - protein, 566 aa, Rickettsiella grylli
MPKFKPVTDQNENVRFLETNALGSTLLTTAKLNKGTAFTESERQELGLLGKLPYRVESLQQQTQRVYQQFLKKEDNLEKHLYLRCLHNTNEILFYKLVSQHLTEMLPVLYTPTVGKAVEQFSQEFQEARGLYIAYPDNDRIDQILDNRLNPEVDIIVMTDGEGVLGLGDQGIGGMGICIAKLIVYVLCAGINPNRLLPIQIDVGTNNEQLLNDPLYLGWRHPRVSGQQYDDMIARVVSAIQRKLPRAYLHWEDFGRENARRNLECYRDTMCTFNDDMQGTGAVTLVALLSAIRRTKVPLTEQRIVIVGAGTAGTGIADQLCAGMLRQGLSRDEALSRFYLVGRHGLIQDSTPNLTAFQKPYAQRLMNKTEATWQLYDVVQKFKPTVLIGSSGQGGIFTEAIVKTMASQVEYPIIFPLSNPTEKSEATPDDLFNWTEGRALIATGSPFGQVYYKGEKIPIAQCNNALIYPGIGLGVVTAQATRLSDGMIWEACNALSHFTQTSSSKKALLPHFEDIQAMSRCIALAVAAQARREGLAQVPDSIDLTQEMDRQFWKPEYLPYRYSKSL

SEQ ID NO: 3077 - protein, 348 aa, Haloarcula marismortui ATCC 43049
MADAYVAIEGDRVIEARARAPGTARGELVFTTAYTGYEESLTDPSYEEQVLTFSYPLIGNYGVREERFESDRVHPRAAVAREMTDDVAEWLESEGIPAVDHLDTRDIVTEIRDEGAMKCGIAAGPDVTEQDALDELHECKHMSDHTDIGAQVSVDEVEVHNEGGDGATVALVDCGAKGSIAESLVERDAEVHVFPYDATEDDVAAVDPDLLFISNGPGDPENFEQAGELVETYVGDVPLAGICLGQQVVANALGGETEKMEFGHRGVNQPVRDLRSNRVVMTTQNHGYTVADPGDKLDVTQINVNDDTPEGLENDDLNIITRQYHPEANPGPHDSLGFFDDVLGMAGE

SEQ ID NO: 3078 - protein, 324 aa, Xanthomonas campestris
MSKRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVLCAKAVVGDEPFAVLLPDDLMWNRGDAALTQMADVAEASGGSVIAVEDVPHDKTASYGIVSTDAFDGRKGRINAIVEKPKPEVAPSNLAVVGRYVLSPKIFEYLESTGAGAGGEIQLTDAIAELLKQEQVDAFRFEGRRFDCGAHIGLIEATVHFALEHEKHGAPAKEIIRSALAAADARVSVRLAVLQRTAPLAPFWVRALEEWCHA

SEQ ID NO: 3079 - protein, 438 aa, Rhodobacter capsulatus
MSAVKKALDLMKAEEVEYVDIRFCDPRGKLQHVTLIADLVDEDFFEEGFMFDGSSIAGWKSIDQSDMKLIPDASSVYIDPFYAEKTMCVHCNVVEPDTAEAYSRDPRIALKAEAYLKASGIGDVAYFGPEAEFFIFDDVRYSVTPAKVAYQIDAEAAAWNTDAEVEMGNLAHRAGHKGGYFPVNPVDEAQDLRGEMLSTMKRMGMKVDKHHHEVATCQHELGLIFGGLTEQADNILKYKYVIHNVAHAYGKTVTFMPKPMKGDNGSGMHVNMSIWKDGKPLFAGDKYADLSQEALYFIGGILKHAKALNALTNPGTNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALTELEKDHDFLLAGDVFTKDQ

SEQ ID NO: 3080 - protein, 260 aa, Chlamydomonas reinhardtii
LSNGVRLPMIGFGTAMIKDPQVIKDALALGYRHFDCAWFYGNEEVVGAGLADFLAAGKRDELFITSKVWNTHHRPADVRKSVEESLAKLGCGHLDLLLVHWPEAWVAGSSMENPQPDNEAPISAMWGAMEALVDEGKVKSLGVSNFSLKQVEELIAGCRVRPVVNQVELHPMCSQRKLVGVLYRMGVQCVAYSPLGGQSAVKPNELLHDERVTAIAKEAGRSNAQVCVRWNIQRGVPVVAKTSNAERARENLEGMYEWKL

(The sequence listing continues in the following parts.)

What is claimed is:

1. A method for manufacturing non-natural, transgenic seed that can be used to produce a crop of transgenic plants with an enhanced trait resulting from expression of recombinant DNA in a nucleus comprising a heterologous promoter that is functional in a plant cell operably linked to protein coding DNA having an amino acid sequence at least 90% identical to SEQ ID NO: 1090, wherein said method for manufacturing said transgenic seed comprising:
   (a) screening a population of plants for said enhanced trait and said recombinant DNA, wherein individual plants in said population can exhibit said trait at a level less than, essentially the same as or greater than the level that said trait is exhibited in control plants which do not contain the recombinant DNA, wherein said enhanced trait is enhanced nitrogen use efficiency, (b) selecting from said population one or more plants that exhibit said trait at a level greater than the level that said enhanced trait is exhibited in control plants, and
   (c) collecting the seeds from step b.

2. The method of claim 1 wherein said method for manufacturing said transgenic seed further comprising
   (a) verifying that said recombinant DNA is stably integrated in said selected plants, and
   (b) analyzing tissue of said selected plant to determine the expression or suppression of a protein having the function of a protein having an amino acid sequence comprising SEQ ID NO: 1090.

3. The method of claim 1 wherein said seed is corn, soybean, cotton, alfalfa, canola wheat or rice seed.

4. A method of producing hybrid corn seed comprising:
   (a) acquiring hybrid corn seed from a herbicide tolerant corn plant which also has stably-integrated, recombinant DNA comprising a heterologous promoter that is functional in said plant cell and that is operably linked to a protein coding DNA encoding a protein having an amino acid sequence having at least 90% amino acid sequence identity to SEQ ID NO: 1090, wherein said herbicide tolerant corn plant has enhanced nitrogen use efficiency relative to a corresponding corn plant without the recombinant DNA;
   (b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA;
   (c) selecting corn plants which are homozygous and hemizygous for said recombinant DNA by treating with an herbicide;
   (d) collecting seed from herbicide-treated-surviving corn plants and planting said seed to produce further progeny corn plants;
   (e) repeating steps (c) and (d) at least once to produce an inbred corn line; and
   (f) crossing said inbred corn line with a second corn line to produce hybrid seed.

* * * * *